United States Patent 10,184,131 (ISOLATED POLYNUCLEOTIDES EXPRESSING OR MODULATING MICRORNAS OR TARGETS OF SAME, TRANSGENIC PLANTS COMPRISING SAME AND USES THEREOF) - sequence listing, part 2

SEQ ID NO: 8790 - DNA, 581 bp, Glycine max
ggagtcgtaaaactaagagacattacagtttgtattattgtagaagagagagggagagagatggagttgagcatgaaagtgttggtgaaagttgcttcgttgcttttcctattggaattcactgcaacagttgttgatgctcgcttcgatccaagttcattcatcactcagtttctccccaatgctgaagccaacaattactatgttaaatccacaacaaaagcgtgctgtaacagctgtccttgcacaaaatcaatccctccacagtgtcgttgttcagatattggagaaacatgtcactctgcatgcaaaacttgtatttgcactcgctcaattcctccacagtgtcattgcagtgacataaccaacttctgttatgaaccttgcaactcctctgaaaccgaagctcactaggaatattgagcatgttccagtgactaacatgtttgacagagtcactaggctttgttttcatctagctagtacttatgatgtatgggaataaataactactgaatgaataaaagctactaggccaagcagtttgttttctacaaattgctggtcgtggtgtttgtttc

SEQ ID NO: 8791 - DNA, 592 bp, Glycine max
ggcacgagagacattacagtttgtattattgtagaagagagagggagagagatggagttgagcatgaaagtgttggtgaaagttgcttcgttgcttttcctattgggattcactgcaacagttgttgatgctcgcttcgatccaagttcattcatcactcagtttctccccaatgctgaagccaacaattactatgttaaatccacaaccaaagcgtgctgtaacagctgtccttgcacaaaatcaatccctccacagtgtcgttgttcagatattggagaaacatgtcactctgcatgcaaaacttgtatttgcactcgctcaattcctccacagtgtcattgcagtgacataaccaacttctgttatgaaccttgcaactcctctgaaaccgaagctcactaggaatattgagcatgttccagtgactaacatgtttgacagagtcactaggctttgttttcatctagctagtacttatgatgtatgggaataaataactactgaatgaataaaagctactaggccaagcagtttgttttctacaaattgctggtcgtggtgtttgttttaaaaaaaaaaaaaaaaaaaa

SEQ ID NO: 8792 - DNA, 548 bp, Glycine max
cgagagacattacagtttgtattattgtagaagagagagggagagagatggagttgagcatgaaagtgttggtgaaagttgcttcgttgcttttcctattgggattcactgcaacagttgttgatgctcgcttcgatccaagttcattcatcactcagtttctccccaatgctgaagccaacaattactatgttaaatccacaactaacgggtgctgtgacaactgtcgttgcacaatatcaatctctccaatgtgtaaatgtgcagatattggagaaacatgtcacccttcatgcaaaagttgtttttgtgatattcccacgtttcctggactgtgtcaatgcattgacgtaaccaacttctgttatgaactttgtaactcctctgaaaccaaagctcactaggaatattgagcatgtagtaactatgatgtatgggaataaataactactgaattaataaaagctactaggccaagcagttcgttttctacgaattgctggtcgtgatgtttgtgtaaaaaaaaaaaaaaaaaaaaaaaaaaaaaa

SEQ ID NO: 8793 - DNA, 552 bp, Apios americana
ggattatctattctcgtggtaaaagaaaagatggagatgaagaagaaagtggtgatgaaagtagctttgttgcttttcttcttgggattcactgcaaccgttgatgctcggttcgatccaagttccttcatctctcagcttctccccaacggtgatgccagttactacgtcaaaacgacaaccaaagcgtgctgtgatctatgcttgtgcacaaaatcaatccctccccagtgccgttgtgcagatattggggaaacgtgccactctgcatgcaaagcttgtttgtgcacgcggtcatttcctccgcagtgtcgttgcgcggacggaaacgacttctgttacgaaccttgtaaatcatccttcgaaggcgaagctcactgagaatgtgcaagcaagttcctataaataactaacatgtaagacaaagtcactaggctttgttttcatgtatcatgtatcggaacaaataactacgtaataaagctactaggccaagcagtttgttttccacaaattgctggtcgtttgttggtttcaaaaaaaaaaaaaaaa

SEQ ID NO: 8794 - DNA, 585 bp, Medicago truncatula
acatcacaaagaaaagatacattgataatactaagtgagaaagagatagtgataatggatttgatgatgaacaagaaggcaatggtgatgaagttagctttgttggttttccttttgggcttcacttcaactgttgttgatgctcgtttcgacggatcatccttcatcactcaactgctctccaatggtgaagctacttacgaagtaaaatccacaacaacagcatgctgtaatagctgcccttgcacaaaatcaattcctcctcagtgtcactgtgctgatattggagaaaaatgtcactcagcttgcaaaagatgcctttgcacaagatcttttcctccacagtgccgttgcactgataccactgatttctgctatgaaccatgtagctactcctccaatggtggatctcactaagtttgagtataactatgtacctactaccatatgcatgtgatgagagacaaagtcccttaggctttgtgttttgtgtatggaaatgaataaattatcaataaaataaaactaccacttgatcttgctgtttgtttttttacaaactgtagggttaaagtctttctttta

SEQ ID NO: 8795 - DNA, 2421 bp, Glycine max; identical to SEQ ID NO: 8149

SEQ ID NO: 8796 - DNA, 2478 bp, Medicago truncatula; identical to SEQ ID NO: 8150

SEQ ID NO: 8797 - DNA, 2544 bp, Medicago truncatula; identical to SEQ ID NO: 8151

SEQ ID NO: 8798 - DNA, 1662 bp, Glycine max; identical to SEQ ID NO: 8145

SEQ ID NO: 8799 - DNA, 2009 bp, Glycine max; identical to SEQ ID NO: 8144

SEQ ID NO: 8800 - DNA, 1533 bp, Glycine max; identical to SEQ ID NO: 8153

SEQ ID NO: 8801 - DNA, 1533 bp, Glycine max; identical to SEQ ID NO: 8152

SEQ ID NO: 8802 - DNA, 1551 bp, Glycine max; identical to SEQ ID NO: 8472

SEQ ID NO: 8803 - DNA, 1639 bp, Glycine max; identical to SEQ ID NO: 8471

SEQ ID NO: 8804 - DNA, 1090 bp, Glycine max; identical to SEQ ID NO: 8465

SEQ ID NO: 8805 - DNA, 1029 bp, Glycine max; identical to SEQ ID NO: 8466

SEQ ID NO: 8806 - DNA, 2004 bp, Glycine max; identical to SEQ ID NO: 8502

SEQ ID NO: 8807 - DNA, 2062 bp, Glycine max; identical to SEQ ID NO: 8503

SEQ ID NO: 8808 - DNA, 2067 bp, Glycine max; identical to SEQ ID NO: 8504

SEQ ID NO: 8809 - DNA, 2062 bp, Glycine max; identical to SEQ ID NO: 8503

SEQ ID NO: 8810 - DNA, 2004 bp, Glycine max; identical to SEQ ID NO: 8502

SEQ ID NO: 8811 - DNA, 1412 bp, Glycine max; identical to SEQ ID NO: 8467

SEQ ID NO: 8812 - DNA, 1278 bp, Glycine max; identical to SEQ ID NO: 8468

SEQ ID NO: 8813 - DNA, 1546 bp, Glycine max; identical to SEQ ID NO: 8507

SEQ ID NO: 8814 - DNA, 1643 bp, Glycine max; identical to SEQ ID NO: 8508

SEQ ID NO: 8815 - DNA, 2067 bp, Glycine max; identical to SEQ ID NO: 8504

SEQ ID NO: 8816 - DNA, 1266 bp, Glycine max; identical to SEQ ID NO: 8509

SEQ ID NO: 8817 - DNA, 1077 bp, Glycine max; identical to SEQ ID NO: 8487

SEQ ID NO: 8818 - DNA, 1122 bp, Glycine max; identical to SEQ ID NO: 8488

SEQ ID NO: 8819 - DNA, 1551 bp, Glycine max; identical to SEQ ID NO: 8472

SEQ ID NO: 8820 - DNA, 1412 bp, Glycine max; identical to SEQ ID NO: 8467

SEQ ID NO: 8821 - DNA, 1639 bp, Glycine max; identical to SEQ ID NO: 8471

SEQ ID NO: 8822 - DNA, 1163 bp, Glycine max; identical to SEQ ID NO: 8486

SEQ ID NO: 8823 - DNA, 2004 bp, Glycine max; identical to SEQ ID NO: 8502

SEQ ID NO: 8824 - DNA, 1090 bp, Glycine max; identical to SEQ ID NO: 8465

SEQ ID NO: 8825 - DNA, 1546 bp, Glycine max; identical to SEQ ID NO: 8507

SEQ ID NO: 8826 - DNA, 2062 bp, Glycine max; identical to SEQ ID NO: 8503

SEQ ID NO: 8827 - DNA, 1266 bp, Glycine max; identical to SEQ ID NO: 8509

SEQ ID NO: 8828 - DNA, 655 bp, Glycine max; identical to SEQ ID NO: 8514

SEQ ID NO: 8829 - DNA, 734 bp, Glycine max; identical to SEQ ID NO: 8515

SEQ ID NO: 8830 - DNA, 1122 bp, Glycine max; identical to SEQ ID NO: 8488

SEQ ID NO: 8831 - DNA, 1077 bp, Glycine max; identical to SEQ ID NO: 8487

SEQ ID NO: 8832 - DNA, 1551 bp, Glycine max; identical to SEQ ID NO: 8472

SEQ ID NO: 8833 - DNA, 1639 bp, Glycine max; identical to SEQ ID NO: 8471

SEQ ID NO: 8834 - DNA, 531 bp, Glycine max
ctaatcccacactctcttttctctacctacaaaaaaaaaatcatctaagttctaacgatgaatcaccaacaacaatctcctgcagtgactgcatatccagcaggggctcagagcaacctagcagctccaccaccacctgtaggttatcccactaaggatgatcttccttcccaacaaaatgttcctgtcaaaaccactaccaggggtgatggcttctggaagggatgttgtgcgggcttgtgctgttgctgtgccctggattgttgtctctgattgaacatccctgcagtactttatggatttgagcttgttctctctgtcttttgttattttctttagcagattaattttgtatttgtctacgctaataaggatatttgtgtcctaagggacagcaaaatgtatttatgtgacggaattttgtatcttgttgatctttttgtactttgtggaaggtaactaatcacatggaccattattgcaattagaaaccataacggttcacatcaataaaaccactttatttaacgg

SEQ ID NO: 8835 - DNA, 612 bp, Glycine max
cacactctcttttctctctctacaaacaatatcaagacaacttcatctaattaaccatgaatcaccaacaacaatctcctgtgactgcatatccagcagtgagtcagagcaacccagcagctccaccaccacctgtgggttatcccacaaaggatgatgttccttcccaacaaaatgttccaatcaaaacctctactaggggtgatggcttttggaagggatgttgtgctggattgtgctgttgctgtgccctggattgttgtctctgattgaagttatggatttgggcttatcctctctgtcctttgtcattttctttactaatttaattttgtacttgtctaataagggtatttgtgtcctccgagacagcaaaattttatttatgtatgtgatggaatttgtatcttgttgatctttttttaactttggatagggaatcaatcacatggaccattgttgcaattagaaaccataacccctcctaagttttatcgttttcaatcaagaatttgatcagttattagtattactggctgaatctacgttattcataatcataagaatattgtgttccaattccaaggaaatgaataggtaaatttgttaacc

SEQ ID NO: 8836 - DNA, 2004 bp, Glycine max; identical to SEQ ID NO: 8502

SEQ ID NO: 8837 - DNA, 2062 bp, Glycine max; identical to SEQ ID NO: 8503

SEQ ID NO: 8838 - DNA, 2067 bp, Glycine max; identical to SEQ ID NO: 8504

SEQ ID NO: 8839 - DNA, 1090 bp, Glycine max; identical to SEQ ID NO: 8465

SEQ ID NO: 8840 - DNA, 1029 bp, Glycine max; identical to SEQ ID NO: 8466

SEQ ID NO: 8841 - DNA, 2062 bp, Glycine max; identical to SEQ ID NO: 8503

SEQ ID NO: 8842 - DNA, 2004 bp, Glycine max; identical to SEQ ID NO: 8502

SEQ ID NO: 8843 - DNA, 1412 bp, Glycine max; identical to SEQ ID NO: 8467

SEQ ID NO: 8844 - DNA, 1278 bp, Glycine max; identical to SEQ ID NO: 8468

SEQ ID NO: 8845 - DNA, 1110 bp, Pisum sativum
atggctgccaaaaaggcatgtgagacattctcaaagtccttgattgaggaagtgcatagatggggttgcttgaagcagacaggggtaagtctcaggtacatgatggaattcgggtccaaacccactgacaaaaatttgttgatctctgctcagtttcttcacaaggaacttgccattagaattgccagaagggctattgagcttgagaatcttccctatggtttgtctcaaaaacctgctgttttaacggttagggattggtatgtggattctttccgtgatctcagagccttccccaacatcaagaatgtgaatgatgaacaagatttcactgaaatgatcaaggccatcaaagtgaggcacaacaatgtggtacccacaatggccttgggtgttcagcaattgaagaaacgtatggatccaaagattgtttatgaagatcttgttgagattcatcagtttctagaccgcttctacatgtcaaggatcggaatccgtatgcttatcgggcagcatgttgagttgcacaatcccaatcctcctccccatgttgtgggctatatacatacaaaaatgtctcctgtggaggtagcaaggaatgccagtgaggatgcacgtgctatatgttgtcgcgaatatggaagtgcccctgatgtgcatatttatggagatcctgattttacttttccgtatgttccagctcacttgcatcttatggtatttgagttggttaagaactcactgcgtgccgtacaagagcgttttatggattctgataaagttgcacctcccattagaataatagttgctgatggaatagaggatgttaccataaaggtctcagatgagggaggtggaattgcaataagtgggttgcctaaaatttttacatatctatatagtactgcgagaaacccattggatgagcattcggatcttggaataggtgataatgtgacaatggctggatatggatatggtcttcctattagtcgtctatatgctcggtattttggaggtgatcttcaaataatctctatggaaggatatggcactgatgcatatctccatttgtctcgtttgggagattcacaagaacctttgccttga

SEQ ID NO: 8846 - DNA, 1711 bp, lipoamide
atcaatccatccgtcacctagtaaccaggttctgcaaatttcgccacttgcagatgaaaagttctaaactttcccctggttaaatcctaaccccagttttcttcctctcactttaagcactccccaatttgacaattttcccctctctcctcaaaaggggtgtgagccactttctctctcctcaattggggtgtgaaagtttctaccttttttcctttctatttttccattatctatgttagttttgcattgtgtgttgtttggcttgcaatcttgttgcatgctggttgttggtgttggtgtcccaattcactctcaaatttcagggttcttagaactagtaggaccttgcgaccatggctgccaaaaaggcatgtgagacattctcaaagtccttgattgaggaagtgcatagatggggttgcttgaagcagacaggggtaagtctcaggtacatgatggaattcgggtccaaacccactgacaaaaatttgttgatctctgctcagtttcttcacaaggaacttgccattagaattgccagaagggccattgagcttgagaatcttccctatggtttgtctcaaaaacctgctgttttaaaggttagggattggtatgtggattctttccgtgatctcagagccttccccaacatcaagaatgtgaatgatgaacaagatttcactgaaatgatcaaggccatcaaagtgaggcacaacaatgtggtacccacaatggccttgggtgttcagcaattgaagaaacgtatggatccaaagattgtttatgaagatcttgttgagattcatcagtttctagaccgcttctacatgtcaaggattggaatccgtatgcttatcgggcagcatgttgagttgcacaatcccaatcctcctccccatgttgtgggctatatacatacaaaaatgtctcctgtggaggtagcaaggaatgccagtgaggatgcacgtgctatatgttgtcgcgaatatggaagtgcccctgatgtgcatatttatggagatcctgattttacttttccgtatgttccagctcacttgcatcttatggtatttgagttggttaagaactcactgcgtgccgtacaagagcgttttatggattctgataaagttgcacctcccattagaataatagttgctgatggaatagaggatgttaccataaaggtctcagatgagggaggtggaattgcaagaagtgggttgcctaaaatttttacatatctatatagtactgcgagaaacccattggatgagcattcggatcttggaataggtgataatgtgacaatggctggatatggatatggtcttcctattagtcgtctatatgctcggtattttggaggtgatcttcaaataatctctatggaaggatatggcactgatgcatatctccatttgtctcgtttgggagattcacaagaacctttgccctgaaagtacttttcagtcagagttaccttaagtaactcactaacattgtgctaaggaaaacacttgttagaataaaaaagtactatttgctgtcaatttttacattctaataatttgacagatttcctgtaaatatgtggtacataagattgtgcatggtgatgccccccttctttgccttcagatccagctttgggaatttgtcctttttatcttctgaaaaaaaatgaatatgctcttttatccta

SEQ ID NO: 8847 - DNA, 1633 bp, Glycine max
ttttttttttttttttgtacaatcttatgtaccacatatttacaggaaatctgtcaaattattagaatgtaaaaattgacagcaaatagtacttttttattctaacaagtgttttccttagcacaatgttagtgagttacttaaggtaactctgactgaaaagtactttcagggcaaaggttcttgtgaatctcccaaacgagacaaatggagatatgcatcagtgccatatccttccatagagattatttgaagatcacctccaaaataccgagcatatagacgactaataggaagaccatatccatatccagccattgtcacattatcacctattccaagatccgaatgctcatccaatgggtttctcgcagtactatatagatatgtaaaaattttaggcaacccacttcttgcaattccacctccctcatctgagacctttatggtaacatcctctattccatcagcaactattattctaatgggaggtgcaactttatcagaatccataaaacgctcttgtacggcacgcagtgagttcttaaccaactcaaataccataagatgcaagtgagctggaacatacggaaaagtaaaatcaggatctccataaatatgcacatcaggggcacttccatattcgcgacaacatatagcacgtgcatcctcactggcattccttgctacctccacaggagacatttttgtatgtatatagcccacaacatggggaggaggattgggattgtgcaactcaacatgctgcccgataagcatacggattccaatccttgacatgcagaagcggtctagaaactgatgaatctcaacaagatcttcataaacaatctttggatccatacgtttcttcaattgctgaacacccaaggccattgtgggtaccacattgttgtgcctcactttgatggccttgatcatttcagtgaaatcttgttcatcattcacattcttgatgttggggaaggctctgagatcacggaaagaatccacataccaatccctaacctttaaaacagcaggtttttgagacaaaccatagggaagattctcaagctcaatggcccttctggcaattctaatggcaagttccttgtgaagaaactgagcagagatcaacaaatttttgtcagtgggtttggacccgaattccatcatgtacctgagacttacccctgtctgcttcaagcaaccccatctatgcacttcctcaatcaaggactttgagaatgtctcacatgcctttttggcagccatggtcgcaaggtcctactagttctaagaaccctgaaatttgagagtgaattgggacaccaacaccaacaaccagcatgcaacaagattgcaagccaaacaacacacaatgcaaaactaacatagataatggaaaaatagaaaggaaaaaaggtagaaactttcacaccccaattgaggagagagaaagtggctcacaccccttttgaggagagaggggaaaattgtcaaattggggagtgcttaaagtgagaggaagaaaactggggttaggatttaaccaggggaaagtttagaacttttcatctgcaagtggcgaaatttgcagaacctggttactaggtgacggatggattcc

SEQ ID NO: 8848 - DNA, 1555 bp, lipoamide
atttctcaaaatcatcaatcaatcaataaaaataacaattaaccacacgactcacgacccagtaaccgggttctgcaaatttcgccacttgcagatgaaaagttccaaactttccactccaatccccggttaaatcctaaccccttgttcctttcactggttcttagaactactaggaccttgccaccaccatggctgccaaaaaggcatgtgagacattctcaaagtcattgattgaggaagtgaatagatggggttgcttgaagcagacaggggtgagtctcaggtacatgatggaattcgggtccaaacccactaacaagaatttgctgatctctgcccagtttcttcacaaggaacttgccatcagaattgccagaagggccgttgaacttgagaatcttccctatggtttgtctcaaaaacctgctgttctgaaggttagggattggtatgtggattctttccgtgatgtcagagccttccctgacatcaagaatgtgaatgatgaaagagagttcactgaaatgattaaggccatcaaagtgaggcacaacaatgtggtacccacaatggccatgggagttcagcaattgaagaaaggtatggatccaaagattgtttatgaagatcttgttgagattcatcagttccttgaccgcttctacatgtcaagaattggaatccgtatgcttatcgggcagcatgttgagttgcacaatcccaatcctcctccccacgtcgtgggttacatacacacgaaaatgtctcctgtggaggtggcaaggaatgccagtgaagatgcacgttctatatgttgtcgtgaatatggaagtgcccctgatgtccatatttatggagatcctaattttacttttccgtatgttccagctcacttgcatcttatggtatttgagttggttaagaactcactgcgtgctgtacaagagcgttttatgaattccgataaagttgcacctcccattagaataatagttgctgatggaatagaggatgttaccataaaggtctcagatgagggaggtggaattgcaagaagtggtttgcctaaaatttttacatatctatatagtactgccagaaacccattggatgagcattcggatcttggaataggtgataatgtgacaatggctggatatggatatggtcttcctattagtcgtctatatgctcggtattttggaggtgatcttcaaataatctctatggaaggatatggcactgatgcatatctccatttgtctcgtttgggagattcacaagaacctttgccttgaaagtacttttcagtcagttaccgtaagtaactcagtaacattgtgctagggaaaacaccattgctagcataaaaaacaaaaagtactatttgctgtcaattttttacattctaataatttgacagatttcctgtaaatatgtggtacaaaagattgtgcatggtgatgaccccccttctttgccttcagatccagctttgggaatttgttctttttatcttctgaaaaaaaaaatgaatatgcccttttatcct

SEQ ID NO: 8849 - DNA, 1537 bp, Cicer arietinum
cacaatccctaatctcaatcaccatgtcaactttgttttccattttccctccaatttcgattctaagtctcatccatccgattcataataactcacgattcagcatttgaataatttcattattaaattctttaaacctgtgagttatggctgccattgaagcattttctaagagcttgattgaagaggttcataaatggggttgtttgaaacaaactggtgtgagtcttaggtatatgatggaatttggttctaaacctactgataagaatttgcttatttctgcacagttccttcaaaaggaacttgctattaggattgctaggagagctattgagcttgaaactcttccctatgggttgtcacaaaaacctgctgtattgaaggttagggattggtatgtggattcattccgcgatattcgatctttccctgaaatcaagaatataaatgatgaaaaagagttcactgaagttatcaaggccatcaaagtgagacacaacaatgtggtacctacaatggccttaggtgttcagcagttgaaaaaaggcttgaaaccaaatatggttaatgaagattttgttgagattcatcagttccttgatcgcttttacttgtcaagaattggaattcgcatgcttatagggcagcatgttgagttgcacaatcccaatcctccaccctatgttgtgggttatatacatacaaaaatgtctcctgtcgaggtggcgagaaatgccagtgaggatgcacgctctatatgtcttcgtgaatatggaagtgctcctgatatcaatatttatggtgatcctgacttcacttttccgtatgttccagctcatttgcatcttatggtatttgagttggttaagaactcattgcgtgccgtccaagagcgttatatggattccgacaaagtttcacctcccataagaattatagttgctgatggactagaggatgttaccataaagatatcagatgagggaggtggaatagcaagaagtggtctgcccaaaatttttacatatctgtacagtactgccagaaacccattggatgagcatgaagatcttggagtagctgatagtgtgacaactatggctggatatggatatggccttcctattagtcgtttatacgctcggtatttcggaggtgatcttcaaataatctctatggaaggatacggaactgatgcatatctccatttgtctcgtttgggagattcacaagaacctttaccctgaaatcaggttgtttcattttcagtcacactcaagagttgtgtgcagaattactcgaagtaatattgtcctaggaaaaacaagtaaaaaacgactgtgctgtcaatttttttcatattctgtttaacttgacagttttcttgtaaatatttcgtacataagattgtgtgtggtcctttatttgccttctgatccagctttgggaatttgttattttcattctttagaatgaatatacccctttctttgatgataaaggatatttcattccaaaaaaaaaaaaaaaaaaa

SEQ ID NO: 8850 - DNA, 1110 bp, Pisum sativum
atggctgcaaagaaagccattgaaacattctcaaaaagcttgattgaagatgtgcataaatggggttgtttcaagcaaactggtgtgagtttaaggtacatgatggagttcggttcaaaaccgagtgacaagaatttgctgatttctgcacagtttcttcataaggaacttgctattaggattgctagaagagccattgaacttgaaaatcttccttgtggtttgtcacacaaacctgctattttgaaggttagggattggtactgggattcctttcgcgatattcgatcgttctccgagatcaagaatatgaatgatgaaaaagagttcactgaagtgataaaggccataaaagtgagacacaacaatgtggtgcctacaatggccttgggtgttcagcaattgaagaaagatttaaatccaaagatttataaagaagatattgtcgagattcatcagttccttgatcgtttttacatgtcgcgaattggaatccgaatgcttatagggcagcatgtcgagttgcactatccgaatcctcgtcctcatgttgtaggttatatagacacaagaatgtctcctgtggaggtagcgagaaatgctagtgatgatgcgcgcgctatatgttgtcgtcaatatggaagtgctcccgatgttcatatttacggcgatcctgattttacttttccgtatgttccggctcacttgcatcttatggtattcgagttggttaagaactcgctgcgtgctgtcgaagagcgttacatgaattccgacaaagtttcacctcccataagaataatagttgctgatggattagaggatgttaccataaagatctcggacgagggaggcggaataccgagaagcggtctgcgaaagatttttacgtatctgtatagtactgctagaaatccattggatgagcatacagatcttggagtaggtgataatgtgacaatggctggatatggattcggtcttcctattagtcggctgtatgctcggtattttggcggcgatcttcaaataatctctatggaaggatatggaactgatgcatatctacatctatctcgtttgggagattcacaagaacctttgccttga

SEQ ID NO: 8851 - DNA, 1357 bp, Medicago truncatula
gtatagtacaatttctctctctttcttcaacatgcttgttattgttattgctattgttacttgttagtttcagattctgtttttctgttacaattgtttgttcaattcaaattctttggttagaacaagaaaaaaaagttttttgttaaccatggctgcaaagaaagctattgaaacattctccaaaagcttgatagaagaagtacacaaatggggttgtttcaaacaaactggtgtgagtttaagatacatgatggattttggttctaaaccaacttccaagaatttgttgatttctgcacagtttcttcataaggaacttgccattagaattgctagaagagctgttgagcttgaaaggcttccttgtgatttgtcacaaaaacctgctgttttgaaggttagagattggtacttggattcgttccgcgatattagatccttttctgagatcaagaacatgaatgatgaaaaagaattcactgaagtgatcaaggccataaaagtgagacacaacaatgtggtacctacaatggccttaggtgttcagcaattgaaaaaagatgtggacccaaagattattaatcaggattttgttgagattcatcagttccttgatcgtttttacatgtcaagaatcggaatccgaatgctcatagggcagcatgttgagttgcacagtccaaatcctcctcctcatgtcgtaggttatatacatacaagaatgtctccggtggaggtagcaaggaatgccgttgacgatgcacgctctatatgctctcgtcaatatggaagtgcccctgacgtacatatctacggtgatcctgattttacttttccgtatgttccagcacacttgcatcttatggtatttgagttggttaagaactctttgcgtgccgttgaagagcgttatatgaattccgacaaagatccacctcccataagaataatagttgctgatggattagaggatgttaccataaagatttcggatgagggaggtggaataccaagaagtggtctgcgaaagatttttacatatctgtatagtactgctagaaatccattggatgagcatgccgatcttggagttggcgataatgtgacaatggctggatatggatatggtcttcctattagtcgtctatatgctcggtattttggtggcgatcttcaaataatctctatggaaaattatgggactgatgcatatctacatctgtctcgtttgggagattcacaagagccattaccttgattacttttcagtcacactcaaaaggcacagtatgcaacattaaagaaagaacgtggtaggaaaatcacattaaaaaaaaggacatatgcgttggca

SEQ ID NO: 8852 - DNA, 1550 bp, Medicago truncatula
acaacggttattcttaaaagcttcaaaaccacgtacgataatcccttttccgtgttctatttacgttttccatttttgttttcaaccatgaatcgatgatagcaaccttcacaaacattttctcaatgtttttgttcaaacactttgtttcataatcaacaaattcagcacttgattttatggcggccattgaagcattttcaaagagtttgcttcaagaagtgcataaatggggttgtttgaagcaaactggtgtgagtttgaggtatatgatggaatttggttcacaacctactgataagaatttgttgatttctgcacagtttcttcaaaaggaacttgctattagaattgctagacgagctattgaacttgagagtcttccttatggtttgtcaaaaaaacctgctatcttaaaggttagggattggtatgtggattcattccgcgatattagatcctgccctgaggtcaaggatatgaaggatgaaagagagttcactgacgttatcaaagccatcaaagtgagacacaacaatgtggtaccgacaatggctttgggtgttcagcaattgaaaaaagagttgaaaacaaagattgatagtgaagatcttgttgagattcatgagttccttgatcgcttttacttgtcaagaattggagtccgaatgcttatagggcaacatgtcgagttgcacaatcccaaccctcctccccatgtggttggttatatacatacaaaaatgtctcctgtgtcggtggcaaggaatgctagtgaggatgcacgctctatatgtatgcgtgaatatggaagtgcacctgaaatcaatatttatggggatcctgatttcacttttccgtatgttccagctcacttgcatcttatggtattcgagttggttaagaactcgctacgtgctgtccaagagcgttatatggattctgacaaagtttcacctcccataagaataatagttgctgatggattagaggatgttaccataaagatatctgacgagggaggtggaattccaagaagtggtctgccgaaaatctttacatatctgtacagtactgccagaaacccattggatgagcatgcagatcttggagtagctgatagtgtgacaacaatggctggatatggatatggtcttcctattagtcgtttatatgctcggtactttggaggtgatcttcaaataatctccatggaaggatatgggactgatgcatatctccatttgtctcgtttgggggattcacaagaacctttgccctgaagatcgattatatcgttttcagccacactcaagaattgtggagaataactcaaagtaacattgaattcgtaaaaacatgtagaaaatgactgctgtcaattttttttcatactctattaactcgacagattatgtgtatatatttaattcatgcataagattgtgtatggtgtttaatgctcctttctttgccattgcatcagctttggaaaattggtattttcattgtttaggctgaatgagaccctttattttcaatgactattc

SEQ ID NO: 8853 - DNA, 1984 bp, Vitis vinifera
accaaaaagattagaagcgggttatctttttcaccgccatctctggttaaaactaaccagagtttacgcctttcagaggcgtcctccacttgtctgtctccctcttcttctctctccgttttgagtgtcagttctggctttgtagactccgcttgcatgttgggtctttgctctcttgttcatactcgcttctgggcggtgttgttcagccatggcggttaagaaactgtgcgagtcctactcaaagagtttcagaggtgaggtacagagatggggttgtatgaagcagactggtgtgagtttgaggtacatgatggagtttgggtccagacccactgagaaaaatctgcttatctctgctcaatttcttcacaaagaactccccataagaatcgccaggagagccattgagctcgagagcctaccctatggcttatctgaaaagcctgctgttttggaggtgagggactggtatttggactcttaccgtgaccttcgggcctttccggagatcaaggataaaaatgatgaattggaattcacgcaaatgattaagatgattaaagtgagacacaacaatgtggttcccacaatggctttgggtgttcaacagttgaagaaaggcattaatgtgaagattgtttatgaggatctggatgagattcatcaatttttagatcgtttctacatgtcaaggattggaattcgcatgcttattgggcagcacgtagagctgcataatccaaacccagctccagattgtgtgggttatatacacacaaaaatgtctcctgtggaggtagcacgaagtgccagtgaggatgcccgctctatttgcttacgagagtatggcagtgcaccggatattagtatatatggggatcccaattttacattcccttatgttccaacacacttgcatctcatggtatttgagttggttaaaaactccttgcgtgctgtccaagagcagtttatggactctgacaaagttgcacctcctgttcgaataatagttgctgatggaatagaggatgttactattaaggtctcagatgaagggggtggaatcccaagaagtggcctccctaaaatctttacatatctttatagtactgcaaagaacccgctggatgagcagtcagatattgggtcatctggtgggttaacaatggctggatatggatatgggcttccaatcagtcgcttatatgcgcgatattttggcggggatctgcaaattatctccatggagggatatgggactgacgcatatctgcatctgtctcgattgggggattcacaagaacccctcccatgaattaggttgtagcatcaagcttaacatgccgaagttcattcaagaagggatttgacatgggaaagttctacagactcgttgtcaaagaaacacattgctccctcccaaatttctcatatattccatggaattgttgttgtatattcttcagctggtgtaagaatctaagatgataattaaaggttgcaggtttttacttggaaccttttaatgttctgttttccattttcatttagttctttggcaacacagccttttgccttctgccttttggcatgtctacttgctctttgaaattttgtggctccttagaaatcaggttcatgtatgcgtgtcttgtgtcgcttcttgtgaatgttaataacagcatcagtcgacatctatctcttacttgctttctggaggaacagctaggggatagaggatgtgagcccatctatggaaggttactcaaaggtgtccaaattcagggtttcaggtaagccatttgctgagagccatactcatatcagaaatgaaatgaaaaacatgaggggggcgtatctaaagtccaaggtgagctaagatcattgtacttatgattgacttgtaagaaagtcactagttgtaatgatcttaaacctttttaaattacccactaaacaatgaagaatgaatcatctc

SEQ ID NO: 8854 - DNA, 4069 bp, Vitis vinifera
atggcaatggaagtcactcaagtgcttttgaatgcacaatcagtcgatggaaacattcggaaacatgcagaagagagtttaaaacagttccaggaccaaaatcttccaagtttcctgctatctctttctggagaactagctaatgatgaaaagcctgttgatagccgtaaattagcaggcttgattcttaagaatgcattggatgccaaggagcaacataggaaatttgagcttgtccaaagatggttgtctttggatgctgctgtaaagacccagatcaagacctgcttgttgcagaccctctcatctcctgtccctgatgcccggtcaactgcttcacaagtaattgcgaagatcgcaggcattgagctgcctcagaaacagtggcctgagctgattgggtcactgttgtcaaatattcaccagcttccagctcatgttaagcaagccacgttagagactcttgggtatttgtgtgaggaagtctccccagatgttgttgaccaagatcaagtaaataaaatactcacagccgttgttcagggtatgaattcatctgaagggaacaatgatgttaggcttgctgctacccgtgcactgtataatgctcttggctttgctcaggcaaactttaccaatgatatggagcgtgattatatcatgagagttgtctgtgaagcaacactgtctcctgaagtcaagattcggcaggctgcttttgagtgcttggtttctatttcttcgacttattatgagaaattggctccttacatccaggacatctttaacatcacagcaaaggctgttagggaagatgaggaacctgttgctcttcaagccattgagttctggagctctatctgtgatgaggagatagatatcctagaagaatacgggggcgatttctctggtgattcagatattccttgcttctattttatcaaacaagcacttccagctcttgtccctatgttgttggagactcttctcaaacaagaggaggatcaggatcaggatgaaggggcttggaatcttgcaatggctggtggaacatgcctaggtttggttgctcgaacagttggagatgatattgtcccacttgttatgccattcattgaagagaacattacaaaaccagattggaggcagagagaggcagccacatatgcatttggttccatcttagagggtccttcccccgacaagctggctcccattgttaatgttgctttgaatttcatgcttagtgccttaacaaaggacccaaataatcatgttaaggacacaacagcttggactcttggacgaatatttgaatttcttcatggttcaacaatggagacacctataattactcatgcaaactgtcagcagattatcacagttctgcttctgagcatgaaggatgttccaaatgttgctgagaaggcttgtggtgctctctattttcttgcccaagggtatgaggatgtgggttcagcatctcccctaactccatttttccaggaaattgttcaatcccttctcactgtcacccacagaaaagatgctggagagtcacgattaaggacttctgcatacgaaacattgaatgaagtggtgagatgttcaactgatgaaacagctcccatggtgctgcaacttgttcctgtcattatgatggaacttcatcagacacttgaggctcagaagctttcatctgatgaaagagaaaagcaaaatgaattacaaggcctgctctgtgggtgcttgcaggttatcattcagaagctaggatcatcagagccaactaaatatgtcttcatgcagtatgcagaccagataatgggtctcttcttgagggtttttgcttgtagaagtgccactgtgcatgaggaggcgatgcttgctattggggcacttgcctatgcaacagggccagattttgcaaaatacatgcctgagttttataagtatttggaaatgggtcttcaaaattttgaggagtaccaagtttgtgctgtcaccgtcggtgtagtcggggatatatgtagggcattggaggataagatcctgccttactgtgatgggattatgacattgctactaaaggacttgtcaagcaaccagttgcacagatctgtgaagccccccatcttctcgtgctttggtgacatagcattggcaataggcgagaattttgagaaatacttgatgtatgcaatgcccatgctccagagtgctgcagagttatcgtctcacacggcaggtgctgatgatgaaatgacagagtacaccaatcttctgagaaatgggatattggaggcatattctggcatctttcaaggctttaagaactctccaaaaactcagcttttgattccttatgcacctcacattctccagtttctagatagcatatacatggagaaagacatggatgatgtggtgatgaagactgccattggagttcttggggatctagcggacacactgggcagcaatgcaggttctttgattcagcaatctctgtcaagcaaagactttttaaatgaatgcttgtcctcagaagaccatttgattaaggaatctgccgagtgggccaagctggccattagtcgtgccatttctgtttgaggctgctgccttggtctattgttttccttttagaagtccctgcatgcattcgggtgtgttgagttgggtccgggattgcatacatgtcaggtcgtcaccattttcagacaacagaagtatcggtcttcgagttgtcactaactcttgcatcagcaccatggggtcagattcttttttccttttttctatcttttgtcatggaggaagtgggtagtgatggcgttgaagaaatggggaagacctcccttaaaacaaaagtatattattggtgccagaagattgggatagggaggtagaggtggctgtggtatgctgaatagattgcacaactcatgactgattgagttggttgctgttggtcggcccttgttattgatgagctcacaattcacgctatatcattgagacctaatgccaccatggtggtgccgtcggattggatgactgcagaaaattggttcaaagtgtccgaggcacgtcaaatcaacccagtgctatattccacattttctccttccttcaaccagttctctttcttgttccaacaacacctcccccctctctcttctaatttgtgtcttgcattgtatcgaagtctcttgtttgtcatagtcaagttgcatttcatatcattcactgttttcgtgtatactcattatgtggggttgggattcatcacccacatactcattacatcctgcatcggtcatattttatttttacaattattacagtaggtgtttctttaaagtcaaatgttaaataccatgcattcatgaaatcatgtgtgctgccatgtttcctgcctctttaagtataggttttttaaatcgtgatttggggaatgtgtaatcgtattttgatgatctccatctgtagagagtggtatattgaaaaaatgtcacgaattgtgatgacatatggaaagaggctggaaagagtattttgagtctcacttgtcaagagaggcagtgtatttgtagtcttgcctcatcttttcatgatcaagtgatatattatcttttatggatttttgtgaatttgggcattgtccatgtcctttgtatgatgccatttgaatgaaaatttttattagttgaaggagacaatagcattttggctttatgaggtttttattatattttgaagctttgaggggcagtgcccactggccatgctagatttgccatctttgtcgagatccataaggccatgttatctgcataaagacagttgcagctgttattctcctcacttgtctgaaactctgtattctcatgctctgaatattctgctgattagggttaatgagtatgtctattactcccttctagttttagtgccatctatcaaaatcaatatgattctatttgtttttgggtataattctcttttatgcttgtgcatcataagagttatcttctcttggtggatgtaggatttttccccaaaa

SEQ ID NO: 8855 - DNA, 4363 bp, Vitis vinifera
atgcgaacccacaatttccacacgagccacaccttaacgcaacaaactcataactgcagccgtccaacagtttggcgtttcctccaccgccaaccacaacttcctgaggtcatagatcaatggccttgatgctcggtgtaaaagaacaatggaattccgcgtagcatcgaataaaaaccataaaaataataaaaagaaaaataatagatatagatttgtaatttgagtccagctctacattcgcgtcttcttctctttttctctctcttcactttctctctcctagggtttctcagcgccgttttgctctcttcacgatccgtgactgcagcatagccgtggttcccaggtaatttcatcgccacctatgtcaatcccactctctattggtgtcaaaattagggttcttatggactgattcgggtgttcgatctcgggtctgctgatctgattcgttcggtatttcttcaattttggcttcaatactcagtctttgatctgtacatggtgttatttttttggggttttctttgaatcagcgttgttcggaaatgggttgtgttttttgtgttgtttaagttatctgttttactgatctgattggtccgtgcttgttcgattttggttaggaactcgatttttgatctgtatttgcttctaatttttcttggtgttccattttttattttgtattttgttaatcattggcttagtaaaggattggttttgggttttgggttttgggttaattggaatgtgaaatctgattcgatctgtcgctgttgttatgtttgttgaaatttattggttgagatggtgaatttaatttgacatggttcggttgggcatagattcgtttggttgaggttggggtttttgatggatcaattggggcttcactggaaaagccaattctgtattagtattgatgtagtactgtaattatacttatttatttcttttgaatagttcagttatttttctgtgaatttaacttaagtttggcgatctaagtaaaatctacagttgtttggttaagaaagttggaattttgcagtgttaatgtgttggggaggtatggatttccttagagatagacctaggtgtttactaaattgcccaattctgttacagtgattatttatttaatgtgtattgatttatttttattcaggcaataaccatagaaatagcttgattgatctggatacataatttagtatttgtttgaaaatataagattttcattccatgaactcttttctatgtcatgtttgtattatgacaagtagttcgattactaatctcgtcacaacacttgtttggatttgttgggattggtgttttagatcattttgtgcactgaggcattatgaaaaccctaattaggtttgttctctgtttggttgctggaaaaaccaaggacgagcagaaagcacaattttgaaacctctctttcatggagttttgtttgggaaaaaaatacctcgaccaagtcatgtttagttttgtcttggtttctgaacttgacttatttcctcctcaatattttcggttctttattgaatatgcaatgtggggtaaaaactcatcttgcttctggagttatgtagttatagttaattgaatatttgatactttcaggtataatatggcaatggaagtcactcaagtgcttttgaatgcacaatcagtcgatggaaacattcggaaacatgcagaagagagtttaaaacagttccaggaccaaaatcttccaagtttcctgctatctctttctggagaactagctaatgatgaaaagcctgttgatagccgtaaattagcaggcttgattcttaagaatgcattggatgccaaggagcaacataggaaatttgagcttgtccaaagatggttgtctttggatgctgctgtaaagacccagatcaagacctgcttgttgcagaccctctcatctcctgtccctgatgcccggtcaactgcttcacaagtaattgcgaagatcgcaggcattgagctgcctcagaaacagtggcctgagctgattgggtcactgttgtcaaatattcaccagcttccagctcatgttaagcaagccacgttagagactcttgggtatttgtgtgaggaagtctccccagatgttgttgaccaagatcaagtaaataaaatactcacagccgttgttcagggtatgaattcatctgaagggaacaatgatgttaggcttgctgctacccgtgcactgtataatgctcttggctttgctcaggcaaactttaccaatgatatggagcgtgattatatcatgagagttgtctgtgaagcaacactgtctcctgaagtcaagattcggcaggctgcttttgagtgcttggtttctatttcttcgacttattatgagaaattggctccttacatccaggacatctttaacatcacagcaaaggctgttagggaagatgaggaacctgttgctcttcaagccattgagttctggagctctatctgtgatgaggagatagatatcctagaagaatacgggggcgatttctctggtgattcagatattccttgcttctattttatcaaacaagcacttccagctcttgtccctatgttgttggagactcttctcaaacaagaggaggatcaggatcaggatgaaggggcttggaatcttgcaatggctggtggaacatgcctaggtttggttgctcgaacagttggagatgatattgtcccacttgttatgccattcattgaagagaacattacaaaaccagattggaggcagagagaggcagccacatatgcatttggttccatcttagagggtccttcccccgacaagctggctcccattgttaatgttgctttgaatttcatgcttagtgccttaacaaaggacccaaataatcatgttaaggacacaacagcttggactcttggacgaatatttgaatttcttcatggttcaacaatggagacacctataattactcatgcaaactgtcagcagattatcacagttctgcttctgagcatgaaggatgttccaaatgttgctgagaaggcttgtggtgctctctattttcttgcccaagggtatgaggatgtgggttcagcatctcccctaactccatttttccaggaaattgttcaatcccttctcactgtcacccacagaaaagatgctggagagtcacgattaaggacttctgcatacgaaacattgaatgaagtggtgagatgttcaactgatgaaacagctcccatggtgctgcaacttgttcctgtcattatgatggaacttcatcagacacttgaggctcagaagctttcatctgatgaaagagaaaagcaaaatgaattacaaggcctgctctgtgggtgcttgcaggttatcattcagaagctaggatcatcagagccaactaaatatgtcttcatgcagtatgcagaccagataatgggtctcttcttgagggtttttgcttgtagaagtgccactgtgcatgaggaggcgatgcttgctattggggcacttgcctatgcaacagggccagattttgcaaaatacatgcctgagttttataagtatttggaaatgggtcttcaaaattttgaggagtaccaagtttgtgctgtcaccgtcggtgtagtcggggatatatgtagggcattggaggataagatcctgccttactgtgatgggattatgacattgctactaaaggacttgtcaagcaaccagttgcacagatctgtgaagccccccatcttctcgtgctttggtgacatagcattggcaataggcgagaattttgagaaatacttgatgtatgcaatgcccatgctccagagtgctgcagagttatcgtctcacacggcaggtgctgatgatgaaatgacagagtacaccaatcttctgagaaatgggatattggaggcatattctggcatctttcaaggctttaagaactctccaaaaactcagcttttgattccttatgcacctcacattctccagtttctagatagcatatacatggagaaagacatgtgagttcttactaagacctgttttagttcctgtaattcttgatttaaattatatcttcttttgatgatttagtaactgacttatcgatttgcatgcagggatgatgtggtgatgaagactgccattggagttcttggggatctagcggacacactgggcagcaatgcaggttctttgattcagcaatctctgtcaagcaaagactttttaaatgaatgcttgtcctcagaagaccatttgattaaggaatctgccgagtgggccaagctggccattagtcgtgccatttctgtt

SEQ ID NO: 8856 - DNA, 3293 bp, Glycine max
aacattggcgtctctgctttttcccacactctgctagggtttcagagtcgccgcgctccctcacttcagtttcaactcgctttctcaatcgccgattccactcgttaactcgccgttcagagatggccatggaggttactcaaatccttttaaatgcccaagcagtggatggaacattaaggaaacaagccgaggaaagcctgaaacaatttcaggaacagaatcttccaagtttcttattttctcttgctggggaactggcaaatgacgagaagcctgcagagagtcggaagctagcaggtttaattctcaagaatgctctggatgctaaagagcagcacagaaaaatagaatttgtccaaagatggctgtcattggacccaaccttgaaagctcagattaaggcattcttgttgaggacactttcttccccttctcttgatgcccgatcaactgcatcacaggttattgctaaagttgctggcattgagttgcctcataaacagtggcctgaattgataggatccctgttgtctaatgctcatcagcttcctgcccctacaagacaggcaacacttgagacccttggatacatctgcgaagaagtttccccagatgtagtagaccaggatcatgtaaataagatactcactgctgttgttcaagggatgaattcaacagaagaaaacaacgatgtcaggcttgctgccataaaagcattgtacaatgcattgggttttgcccaggcaaatttttcgaatgacatggagcgggattatatcatgagaattgtgtgtgagacaacacaatctcctgaactgaagattcgacgagcagcatttgagtgcttggtagctatttcttcgacatactatgaaaagttagctccttatatccaagatatcttcaacatcactgccaaggctgtgagggaagatgaggagccagttgcacttcaggcaattgagttttggagttcaatatgtgacgaagaaattgatatactagaagaatatggaggtgatttcagtggggattcagaggttccctgcttttattttattaaacaggcactttcatttcttgtccccatgttattggagacactgctgaagcaagaagaagatcaagaccaggatgaaggagcatggaacattgctatggctggaggtacctgcttgggattagttgcacggacagttggtgatgacattgtacctttggttatgccgtttattgaagagaatataaccaaaccagattggaggcaaagggaagctgcaacttatgcctttggctctattttagaaggtccatctcctgataaacttgtgccattggtgaatatggctttgaatttcatgctcactgcattgatgaaagatccgaataatcatgtgaaggacacaactgcatggactcttgggcgaatgttcgaatttttgcatggatcagctctggatactcccattatcactccagcaaactgccaacagattattactgtgctgcttcagagcatgaaagatgttccaaatgttgctgagaaggcttgtggtgctctttattttcttgcccaaggctatgaggatgctggatctgcatcctctccgttgacccccttcttccaagaaattgttcatgctctcctcactgtaactcacagagaggatgctggagaatcccgccttagaacagcagcctatgaagcgttaaatgaagtagtgaggtgttctaatgatgaaacagctcctatggtggtacaacttgttcctctcatcatgatggaactccatcagactcttgagaatcagaaggtttcatccgacgagaggcagaatgagttacaaggccttctatgtggttgcttgcaggttatcatacagaagttaggatcatctgaaccaacaaaatatcatttcatgcagtatgctgaccaaattatgggtttgtttttgagagtgtttgcttctcgaagtgcaacagctcatgaggaggctatgcttgccattggggctttggcctatgcaaccggtgctgattttgcgaaatacatgacagaattttacaagtatttggagatgggtctccaaaatttcgaggactaccaggtttgtgctatcacagtgggtgtggttggtgatgtatgcagagccttggaggagaaaatactgccttattgtgatgggataatgacccaacttcttaaggatttgtctagcaatcagttgcataggtccgttaagcctcctattttttcatgttttggagacattgccttggcaattggagaaaactttgagaaatacctgttatatgcaatgcctatgcttcagagtgccgcagagctctctgctcatacatctggtgctgatgacgatatgacagaatacactaattctttgagaaatggaattctagaggcatactcagggatcttccaagggtttaaaggttccccaaagacccagcttctgatgccatatgctcctcatgtgctgcaattcttggatagtttgtataatgagaaggacatggatgatgttgtgactaagacagcaattggcgtgcttggagatttagctgatactttgggtagtaacgctggcccgttgattcagcaatctgtgtccagcaaagacttccttaaagagtgtttatcatctgatgatcatttgattaaggaatctgcggaatgggccaagttggcaatcagtcgagcaatttctttttgaggctgttgctatttcctggcttctagttctcttgcatacatttgcatttgttgcgtgtgggggtctcaactgcatacatgagtcgggtcatcaccatttttgggaacaggtgttcggtcctttggttgtctgcatttcatgtcagcaacatggtcatggagtctgctttttcatttttatttttttaaaatttattgttctgcattgctatggaggaagtcggtgggtgatgaccaatctttctgctaacttggcagaaaagatgcggtttcgtacaggaggagaaacagggtgaaatggggggaaggagcaagaaaggagatatcccatgatatctgccaataccgtaactattgggcttgcatgagttattgaatgttttggagtctatggtggtggtccagatattatgtcctttactatttttttttccttttactattggctgtagagtgaaacaatcatcttagtccatccatgtgtttgggacaaggtaatgcaacatattttagccgttccttgaaattattcaaatatttttttgtctcccgcatcaaa

SEQ ID NO: 8857 - DNA, 3585 bp, Glycine max
acttgaaacattggcgtctctgctttttcccacactctgctagggtttcagagtcgccgcgctccctcacttggcttcgactcgctctctcaatcgctgattccactcgttatctcgtcgtcactaagttcagatggccatggaggttactcaaatccttttaaacgcgcaagcagtcgatggcacattaaggaaacaagccgaggaaagcttgaaacaatttcaggaacagaatcttccaagtttcttgttttctcttgctggggaactggcaaatgacgacaagcctgcagagagtcgcaagctagcaggtttaattctgaagaatgctctggatgctaaagagcagcacagaaaaatagaatttgttcaaagatggttgtcattggacccaactttgaaatcccagattaaggcattcttgttaaggacactttcttctccttctcttgatgcccggtcaactgcatcacaggttattgctaaagttgctggcattgagttgcctcataaacagtggcctgaattgataggatccctcttgtctaatgctcatcagcttcctgcccctacaagacaggcaacacttgagacccttggttacatctgtgaagaagtttcccctgatgtagtagaccaggatcatgtaaataagatactcactgctgttgttcaagggatgaattcaacagaagaaaacaatgatgtcaggcttgctgccataaaagcattgtacaatgcattgggttttgctcaggcgaatttttctaatgacatggagcgggattatatcatgagaattgtgtgtgagacaacacaatctcctgaattgaagattcgacgagcagcttttgagtgcttggtagctatttcttcgacatactatgaaaagttagctccttatatccaagatatcttcaacatcactgccaaggctgtgagggaagatgaggagccggttgcacttcaggcaattgagttttggagttcaatatgtgacgaagaaattgatatactagaagaatatggtggtgattttagtggggattcagaggttccctgcttttattttattaaacaggcactttcatttcttgtccccatgttattggagacactgctgaagcaagaagaagatcaagaccaggatgaaggagcatggaacattgctatggctggaggtacctgcttgggattagttgcacggacagttggtgatgacattgtacctttggttatgccgtttattgaagagaatataaccaaaccagattggaggcaaagggaagctgcaacttatgcctttggctctattttagaaggtccctcccctgataaacttgtgccactggtgaatatggctttgaatttcatgctcactgcattgatgaaagatccaaataatcacgtgaaggacacaactgcatggactctagggcgaatgttcgaatttttgcatggatcagctctggatactccgattattactccagcaaactgccaacagattattactgtgctgcttcagagcatgaaggatgttccaaatgttgctgagaaggcttgtggtgctctttattttcttgcccaaggctatgaggatgctgcatctgcgtcctctccattgacccccttctttcaagatattgttcatgctcttctcactgtaactcacagagaggatgctggagaatcccgccttagaacagcagcctatgaagccttaaatgaagtagtgaggtgttctaatgatgaaacagctcctatggtggtacaacttgttcctctcatcatgatggagctccatcagactcttgagaatcagaaggtttcatctgacgagaggcagaatgagttacaaggccttctatgtggttgcttgcaggttatcatacagaagttaggatcatctgaaccaacaaagtatcatttcatgcagtatgctgaccaaataatgggtttatttttgagagtgtttgcttctcgaagtgcaacagctcatgaggaggctatgcttgccattggagctttggcctatgcaactggtgctgattttgcgaaatacatgacagaattttacaagtacttggagatgggtctccaaaattttgaggactaccaggtatgtgctatcacagtgggtgtggttggtgatgtatgcagagccttggaggagaaagtactgccttattgtgatgggataatgacccaacttcttaaggatttgtccagcaatcagctgcataggtctgttaagcctcctattttttcatgttttggagacatagccttggcaattggagaaaactttgagaagtacttgttatatgcaatgcctatgcttcagagtgctgcagaactctctgctcatacatctggtgctgatgatgatatgacagaatacacaaattctttgagaaatggaattctagaggcatactcagggatcttccaaggatttaaaggttccccaaagacccagcttctgatgtcttatgctcctcatgtgctgcaattcttggatagtttgtatatggagaaggacatggatgatgttgtgactaagacagcaattggcgtgcttggagatttagctgatactttgggcagtagtgctggccccttgattcagcaatctgtgtctagcaaagacttcctcaaagagtgtttatcatctgatgaccatttgattaaggaatctgccgaatgggccaagttggcaatcagtcgagcaatttcattttgaggctattgctatttcatggcttctagttcttgcatacatctgcatttgttgcgtgggggtctcaactgcatacatgagtcgggtcatcaccatttttgggaacaggtgttcggtcatttgggtctgcatttcatgtcagcaacaacataacatggtcatggagtctgctttttcatttttatttttaaaaatttattgttctgcattgctatggaggaagtcggtgggtgatgaccaatctttcttctgctaacttggcagaaaagatgtggtttttacgtacaggaggagaaacagggtgaaatgggggaaggagcaagaaaggagatagatgatatcccatgatatctgctgataccgtaactataggagtctatggtggtccagatattatgtcctttacttttttttttcttttcctattactattggctgtagagtgaaacaatcatcttagtccatccatccatgtgtttgggataggtaatgcaacatattttagccgttccttgaaattattcaaataattttttgtctcccgcatcaaagtttttttttaattctttgatcacctatgtttaaagtcgcatactcgcatgtatgaggaatgtgtcatggggcgtgtttcttattcgctgccttttagttttgaagttcgtatgtcgtgtaatataatatatcgtacatggtttttagatgcccttactatcaaggccttaccttttagtggtacacataggtggccgttacatgattaaaatgtcgtagccaagccaattgttggtagcgtgtttatatggcattcaatttgagttgagtgtttggttataccaagttgg

SEQ ID NO: 8858 - DNA, 3811 bp, Arabidopsis thaliana
gctggaactgatttttttcttctctctctctctctctcttccttctgggcttctagggtttgtcctctccagtccccgatttccgctttatccgatcggccgccgccgagattctagataaacctatggcaatggaggttacgcagttgctcattaatgctcagtcgattgatggaactgtacgtaagcacgcggaagaaagtcttaagcagtttcaggagcaaaaccttgcgggtttcttgttgtcgcttgctggagagcttgcgaatgatgagaagccagtagatagcaggaaattagctggtttagtccttaaaaatgctcttgatgctaaggaacaacacaggaagtatgagcttgttcagagatggttggctctagacatgtcaacaaagtcgcagatcagagctttcttgttgaagacactgtcggcacctgtgcctgatgttcgttcgactgcatctcaggtcattgctaaggttgcaggtattgagttaccacagaagcagtggcctgagctcatagtgtctcttctctcaaatattcaccagttacctgctcatgtcaagcaagccactttggagactcttggatacctatgtgaagaagtgtcacctgatgttgttgaacaggagcatgtaaataagatactcacagctgttgttcagggtatgaatgctgctgaaggtaatactgatgttagacttgctgcaacccgtgctttatacatggctctcggattcgcccaagcaaatttcaacaacgacatggagcgtgattatatcatgagagttgtgtgtgaagcaaccctgtcccctgaggtgaaaattaggcaggcagcttttgagtgtttggtatctatcgcttccacatactatgagaagttggcgcattacatgcaagatatattcaacatcacagctaaggctgtaagagaagatgacgagtctgttgctctacaggcaattgagttctggagttctatttgtgacgaagagattgacatcttagaagaatatggtggtgagttcgctggggattctgatgttccatgcttttattttactaagcaggctctccctggtcttgtgcctctactgctggagactcttctgaagcaagaagaagatcaagatttggatgaaggggcttggaatattgcaatggcaggtgggacatgcctcggtttggttgctagggcagttggagatgacattgttccacatgtcatgccgtttattgaagagaaaatatcaaagcctgattggagagagcgagaagctgcaacttatgcttttggttccattttggaaggcccttctgccgataagttgatggcaattgttaacgcagcgttaacatttatgctcaatgctctaacaaatgacccaagcaaccatgtgaaagacacaaccgcatggacccttggtcggatatttgagttccttcatggttcaacaatcgagacacctattattaatcaggcaaactgccagcagataatcacagtactcatccagagcatgaatgatgcgcctaatgttgccgagaaggcttgtggggctctgtacttccttgctcaaggctatgaggatatcggtcccagttctccgttaacacccttcttccaggaaattattaagtcacttttagctgttgcacacagagaggatgcaactgaatcacgcttgcggactgcagcatatgaggcattgaatgaagttgtcaggtgttcaactgatgaaacgtctaccatggttctgcaattagtaccagtgataatgatggagcttcacaatactttggaaggggaaaagctttcattggatgagagggagaaacaaaacgagttgcagggacttctatgtggatgcttgcaggtcatcatacagaaattaggatctgaaccaaccaagtctaagttcatggagtatgcagaccaaatgatgggacttttcctgagggtgtttggttgtagaagtgcaactgcacatgaggaagccatgcttgccattggtgctcttgcttatgcagcaggtcccaattttgccaaatacatgcctgagttttataagtacttggagatgggtcttcaaaactttgaagaataccaagtgtgtgctgttactgttggtgttgttggggatgtctgcagagcattggaggacaagattttaccttattgcgatgggattatgacacagcttctgaaagatttgtcgagcaaccaattgcaccgatcagtgaagccaccgatattctcctgttttggtgacatagcacttgctatcggtgaggattttgataagtactggaggtattcaatgccgatgcttcagagtgccgcagagttatctgctcactcggctggagctgatgatgaaatgacggagtacacaaactcattgagaaacggaatccttgaggcttattcaggcatatttcaaggtttcaagaactccgccaaaacccagctcctgattcctttcgcaccccatatcctccagtttttggacagtatatacatggagaaagacatggacgaggtggtgatgaagacagcgattggggtcttaggagatttagcagatacactagggagtcatgtgggtggtttgatacaacagtcagtgtcaagtaaagagttcttaaacgaatgtttgtcttctgaagaccacacaattaaagaagcagccgaatgggcgaagcatgccataacccgtgccatatctgtttgaaggctcttcttttgcctataagaaagaaaattccttttgctttttagtaaagtctgcatgcatctctgggtgggttgagtcggtcggggggaggggtagagctgcaacatccgagtcacatcagcatcatcagcatcagtttcatttgcatcatcagcataactggggtcagtcagggaatcgttgagtcgtggatgtggggaatgatgagttttggggtaaataatgaaactggaagagtcacgggtgaaagtttcccgggtaaggttaaatccccgggagtagaaagaggaggaagtgagtcatggtcgttttctggtgggttttgggacaaagttataccaaaaaaaaaaaggtttcatggaacatctcataatacattcttgttttttcttttctctcatatgttcttcaaccccttgaggagggagaggtctcaggtttttatcaagtgggggcattattagaggacaatcccttgattttttcttttgttttcttttattatttggttagttgcagtctttgcatcatcattttgtcttttgggggggtttgtatgtttgattaaaagcattattcacatttttatttttatataaagaagtttcacatgtctgtctatcttctctttgctatgatgcagtttagggggttttgcatatatacttgtgttttgtttgcaatcaagtttcaaatgtcacatacaggaacatttttattatatggtgtcatgtcttagggtcttaaagaggtccacatctattcattttactatggaactgtttacaatcgtttagaatccattatttgatttggctcgaactatatgggaaagggcacatgttaataggagaaaacgtcctgccttactctgcttccaaagagtcaagttaagagatcgaagaacatttcacattcacgctgtttatggaaacctcaattttgattgtatgtgttgcttttttttggttttccaaacgccaaatgcaactgataccgaacctatattttgaaaaatgttttcatgtgtatttgaaacattctagaccattcaagttatggtttaaatt

SEQ ID NO: 8859 - DNA, 3712 bp, Hordeum vulgare subsp. vulgare
gagatttcctccctcccctctcccctcctcctctcgcaggctccctcaccgccgtcgccgaatcgcggagctcccgcgccgcccaatcgcagggctcgccccgtcgcccaatcgcagagctaccgcctcggctccatcccgcgaccttggacgtctgaagctccgtcgcgccgtccagctccgtcacacccgtcgtcgccaactacctccccatctcagcagccagcaagaagagtcagcatgtcgttggatgttactcaaatactcttgagtgcgcaatctgctgatggctcgattagaaagcatgctgaagaaagcctcaagcagtttcaggagcaaaacctcccaggttttttgctctccctctcaagtgagttggccaacaacgagaaacctgaggagagccgcaggttggctggtttgatcctcaagaatgcgctggacgcaaaggagcagcacaggaagaatgaacttttccagagatggctggcactggatgctggtgtcaaggcacaagtgaaagcgttgttgctacaaactctctcatctcctgttgcaagtgccagatctacatcttctcaagtcatcgcaaagattgccagcattgagatccctcagaagcaatggcccgagcttataggatcattgctatcaaacatacatcaagtacagccaaacgtaaagcaggcaacgctcgagacacttggctatttatgcgaggaagtttctccagaagctgtcgaccaagaccaagtcaacaagatacttacagctgttgttcagggtatgaatgcttctgaagggaactctgaagtgaggcttgcagccacacgggcattgtataatgcattgggcttcgctcaggttaatttctccaatgacatggagcgtgattatatcatgagagttgtctgtgaagcaacacagtcaccagatgtgaagataaggcaggctgcctttgagtgtttggtggctatttcgtctacttattacgataagctggcgacatacatgcaggatatatttaatattactgcaaaggctgtgaggggagatgaggagtcggttgcacttcaggccatggaattctggagttccatatgtgatgaggaaatcgacattttggacgagtacagcagtgaatttacagctgattctgatgttccttgctactattttatcaagcaagctcttcctgccctagtgccaatgctgttggagactctcctcaaacaggaggatgaccaagatttggatgaaggtgcttggaatcttgcaatggctgggggtacttgtttgggcctggtggcaaggactgttggggatgatattgttcctctcgtgatgccattcgttgaggagaacataacaaaacctgaatggagacacagagaagctgcaacatatgcttttggttccattttggagggtccatcagctgataaactgactcctctagttaatgtcgccttgaattttatgctgtctgcgttagtaaaggacccaaataaccatgtgaaggacacaactgcttggaccctcggaagaatattcgagtttcttcatggttctgcacttgaaactgctcccgtcattacagctgagaactgccagcaaattcttaccgtgctgcttcaaagcatgaaggatgtcccaaatgtggcggaaaaggcatgcggggcactctatttccttgctcaaggctatgtggatgctggatccgcgtcaccattatcccctttctttcaagatattgttcagagccttcttgtgaccagtcatagagaggatgctggtgaatccaggctgcgtactgcagcttatgagactctaaatgaagtcgtcaggtgctccactgaggagacagctcctattgttatgcagctagtacctgttattatgatggaactccatcagacacttgaagcggggaagttatcaactgatgagagggagaagcggagcgatctgcagggccttctttgtggttgcctacaggttattatccagaagttgggagggatggagtcaacaaagtttgccttcttacagtattcagatcagatgatggatctgtttttgagagtttttgcttgccgaaatgccacggtgcatgaggaggctatgcttgctatcggtgcactggcatatgcagccggttcgaactttgcgaagtacatggcacaattctatcagtatttggaaatgggacttcagaactttgaagagtatcaggtatgtgccattacggtgggtgttgtgggcgacttgtgcagggcactggaggacaaaattttgccctactgtgatggcatcatgacccagctcctgaaggatctatccagcaatcagttgcacagatctgtaaaaccacctatattctcatgcttcggtgatattgcactggcaattggagagaacttcgagaagtatttgatctatgccatgcccatgctacaaagtgcagcagatttgtcggcgcacacaactgcaactgatgatgaaatgcttgactacaccaatcaattaagaaatggcatcttggaggcctactctggtattcttcaaggattcaagagttcccctaagacacagttactcatgccgtatgctccacatattcttcagttccttgatgcccttcataatggaaaggatatggatgattctgtgatgaagactgcaataggtgtcttaggagatcttgcagacacattgggcgtcaatgctggtcctttgatcaatcaatccacatcaagcaagcaatttttggatgagtgcttatcatctgatgatcctttggtcaaagaatcagctgactgggcaaggattgcaatcagccgtgcggtttcgggttgacgtgacatttgtcttgagtctgcatatgcatccatccacgagtcgagtccaggtcttcggttgcatcatgtctagacctgctctttggagaagtcgaacatcctcaaagcagagtcggagggtcctcactaactcatgcatcagtacatgtgtcaacccagcctttttcacttctgcggaaaagagggttaagttggccacctgctaacttctctaaaaagggaatccaggagcttccattgttgcctgcgttaccaatggtccgtcggcgtggcatccatgcttatggtctgggtgctctcgctttaccttgcatccattgcatgcatcgaactttggtcatatggtcactcattaaaaggcccgattgcttattcatccattatgcataaggggctcgcgggcattgtcacaggattatttttgtactactcagggtgtccaacttcaccatgtgggacatgttcctcctgagccggtagtttttttttcctttcgcatttgcattgttttgcattcatcccagactgttttgtaagggttcttttggttaaaaactgagacggcatgcggttgtgtctgtttatttcaaggtgttgtcggagcagtgcgtgattgcgctcttttttttggtcatctatgctgctgttccatttcagcttctttgaagcttgtgctggcgggtggaaaagaacaattgtagctcttggagtggttttgttcggggggcagctgtcgagttgtatttgtttattacaggaactgtattattttgtggaactctgcctcctaccagacacgtcatatcattggctgtgtatacgagaatacgatgatgcatgtgttcaatgcc

SEQ ID NO: 8860 - DNA, 1546 bp, Glycine max; identical to SEQ ID NO: 8507

SEQ ID NO: 8861 - DNA, 1643 bp, Glycine max; identical to SEQ ID NO: 8508

SEQ ID NO: 8862 - DNA, 2067 bp, Glycine max; identical to SEQ ID NO: 8504

SEQ ID NO: 8863 - DNA, 1266 bp, Glycine max; identical to SEQ ID NO: 8509

SEQ ID NO: 8864 - DNA, 1692 bp, Glycine max
caagtttcaagttccattacacaacacacctattttagttgtagacaaagccacataaatagacccaagaggtttaacttaggcaacgacgagacgcctctcttatcctccacttccagtttcaaccatgtcctgccggaaaagacaaaagacttcgccggacaaaacctccgacgacttcttcgactctctccccgacgaccttgtcctctctatcctctgcaagctcagctccaccgcaacttccccctccgatttcattagtgtcttaataacgtgcaagagactaaactccttaggccttcactctcttgtgttatcaaaagcttcccacaaaacattctcagtcaaagccaaaaactggtgcgactctcttcaccgtttcctcaaacattgtgcagatgccggaaacattgaagcctgttacactctcggcatgattcggttttactgcttgcaaaacagagggagcggcgcgtcgctgatggcgaaggcggcgatgaactctcacgcgccggcgctgtactcgctcgcggtgatacagttcaacggaagcggcggcaccaaaaacgacaaggaccttcgagcgggtgtggcgctttgcgcacgcgctgcgttcctcggtcatatcgacgcgctgcgtgagcttggtcattgcttgcaagacggttacggcgttaagctaaacgtaacggagggacgacggtttttggtgcaagcaaacgctcgtgaactcgccgccgtgctctccgccgggaataccaagcgcccctggctgacctggagccaccaccctgtcacccacccgcggctccggtcgggttgcccgttgatgagtgattacgggtgcaatgttccggcgccggatgctcacccggcgagtcagtttatgtcggagtggtttgatatccggggcgggtttccgggtccggatatgaggctttgttctcattcgggttgcgggcgacccgagacaaggaggcacgagtttcgaaggtgttcggtttgcggtttggtgaattattgctcacgcgcttgtcaggcgcttgattggaagttccggcacaaggcggaatgtgctaccgttgagaggtggctcgatgacgacggcgaaggcgtcgccggtgagaatgacggcggcggagatgacggggtaatgatggttaatagttagaagactagactatttttacaaacgttaacggtaaatgaagtctgcttggaagtttcaacgggtatgaatttattttttacatggggtaaaagaaaaaaatctcattttttgccgtggttatgcgaagtgcaaacttcaatgacagtgttttgcttcgacctctgttccttttactttttctgttactgttgtatagaaccgtaaatgaattctcctgaaaaacaaaatgaaggagatagtttttgttatagagcaactatcatccttgattaattgttaattctggtaaattatagtgtatgaactttttatgtttgtacttccaatttatttaattactttttatttgcttgataatattataagtatagtgcagaatttgccaactcattgaacttcaaatgttggtaggttttttttatttttttctgacacccaactaaatcagatcctttccattgatataaatttcaaggatacaatgaggagctacattgaaagtaatgggaggttattta

SEQ ID NO: 8865 - DNA, 1381 bp, Glycine max
cttatcttccaaccatgtcttgccggaaaagacaaaagacttcgccggacaaaacctccgattgcttcgactctctccctgacgacctcgtcctctctatcctctgcaagctcagctccaccgccacctccccctccgatttcatcagtgtcttaataacgtgcaagagactaaactccttaggccttcactctcttgtcttatcaaaagcttcccacaaaacattctcagtcaaggccaaaaactggtgcgactctcttcaccgtttcctcaaacattgtgccgacgccggaaacattgaagcctgttacactctcggcctgattcggttttattgtttgcaaaacagagggagcggcgcggcgctgatggcgaaggcagcgatgaactctcacgcgccggcgctgtactcgctcgcggtgatacagttcaacggaagcggcggcacgaaaaacgacaaggaccttcgagcgggtgtggcgctttgcgcacgcgcggctttcctcggtcacatcgacgcgcttcgggagcttggtcattgccttcaagacggttacggcgttaaacaaaacgtaacggagggtcgacggtttttggtgcaagccaacgtgcgtgaactcgccgccgtgctctccgccgggaataacaagcgtccctggctgacgtggagccaccaacctgtcccccacccgaggctccggtcggaaaccgggtcgggttgtccgctgttaagtgattacggctgcaacgttccggcgccggaggttcacccggcgagtcagttcatgtcggagtggtttgatattcggggcgggtttccgagtgcgggtatgagactctgttctcaatcgggttgcgggcgacccgagacaaggaggcacgagtttcgaaggtgttcggtttgtggtgtggtgaactattgctcacgcgcgtgtcaggcgcttgattggaagtttcggcacaaggcggaatgtgctcccgttgagaggtggctcgatgacgacgacgaagatgtcgccggcgagaatgacggcggagatgacggagtaatgatggttgatagttagaaaactagactatttttacaaacgttaacggtgacggtaagcctgcttggaagtttcgacgggtatgaatctatttttaacatggggtaaaatggggggaaaaatctcatttattaccgtggctttgcaagtgcaacttcaatgacagggttttgcttcgacctcttttccttttacttttactgttgtatagaaccgtaaattaattctcctgaaaaacaaaatgaaggggatattttttattatagagcaactatcatccttaattaattgttaattctgcaaaattaaaatatatgaactttttatgtttg

SEQ ID NO: 8866 - DNA, 1272 bp, Medicago truncatula
atgcgaaccagaacaggtttgtgttatcctcaaacacttcaactatcaaacatgttttcagacacaaacaataacaaaagacacaagagaatgccacaaaacacttctgatttctttgaacttttgcctgatgacatagttctctctatacttggaaaacttagctccaccgctacttctccttcagatttcatcagtgttctaatcacatgcaaaagactaaacggtttaagtcttaactctgttgttttgtccaaagcttcgaacaaaacattatcagtcaaagctaaaaactggtgtgactctgctcaccgttttctcaaacgctgtgttgatgctggaaacattgaagcctgttacactcttggaatgattcggttttactgtttgcaaaacagaggaagcggcgcgtcgttgatggcaaaagcagctatgaaatctcacgcaccgtctttgtattcattggcagtgattcagttcaatggaagcggaggaacaaaaaacgacaaagatttacgcgccggtgttgctttatgtgcacgcgctgcatttctcggtcacatcgacggtttacgtgagcttggtcattgtttacaagacggttacggtgttaaacagaacgttattgaaggtcgacggtttctagtccaagcaaacgcacgtgaactcgctgccgttttatctaacggcaataacaacaaacaaccgttgctgacgtggagtgttaacccgggttcaagccaacctccacagcttcgtgttttagctggtgctggttctgtttctggttcgggttgtcctttgctgagtgattttggttgtaacgttccggttcaggagactcacccagcgaaccggtttatgacagagtggttcgatattcgaggtgggtttcctggaccgggtatgaggttatgttcgaattctggttgtggaagacctgagacaagaaagcatgagtttcgaagatgttcggtttgcggtgttgtgaattattgttcacgcgcttgtcaagcgcttgattggaagtttcgacataaggcggagtgtgcaccggtggagaggtggttagaggaggaggaacatattgccggggaaggtgacggtggcgttaacgttgatgaggtggttgtgcttgatagttgataggtttagattgtttatccaaacgttaacgatgacagtaacggaagattgttttggaactgtattttttggcattggatactgaaacatggaaaaagttaaaatattaattgtctcatttattac

SEQ ID NO: 8867 - DNA, 1820 bp, Glycine max
gggtttggagattcaatacattacattacccctcttatatataacatataacttgttacctaggttttcctaccttctttatctctcaaaagagagacacaacaaaaggaaccagagtggattaattagggacatgagaacaaggagaggagcgtgttactctggagtagtctcaaggatgtgttccgatgcgagggtttccaagaaaaaaaacaaggatctgcacatgcacatgcatatgcatatgcatgtccccgccggagactccattatttacagccggaaaaggcagaagaaaacgccggagaaaaccgccggcgctgattacgaatttttcgagtctttgccggacgacctcgtaatctccatcttctgcaaacttagttccaccgccactaaaccttccgatttcgtcaatattttaatcacgtgcaaaagattaaacagattagcacttcattcgcttgtattatccaaagcctcgccgaaaactttcactattaaagcaagagattggtgcgattcggcacacaaattcctcaaacactgtgccgatgccggaaacgttgaagcttgctatactttaggcatgattcggttctactgtttgcaaaaccgagggagcggcgcgtcgtttatggcgaaggcggccattaactctcacgcgcgggctctgtatgcgctggccgtgattcagttcaacggcagcggtggcacgaagagcgacaaggacctacgcgccggcgtggcgctgtgcgccagagcggcgtttcttggccacgtcgatgcgatgcgcgaactcggccactgcctgcaggacggttacggcgtgcggcagaacatcgccgagggacggcggttcctcgtgcaggcaaacgcgcgcgagctcgccgccgtgctgtctaccggcgccgccgcgcgcacctggctgagttggaatcttcagccgcagcagctccggcaggggtccgggtgtccgcttctcagcgatttcggatgcaacgtaccggcgccggaggtgcaccccgcgagcctgttcatggcggagtggttcgccgcgcggggcggttcgccgggaccggggctgagactctgttctcacgcggggtgcgggaggcccgagacgaggaagcacgagtttcgaaggtgttctgtgtgcggcgtggtgaattattgctcacgcgcgtgccaagcgcttgattggaagttccggcacaaggcggagtgctcccccgtgcaacggtggctcgaggaggacggcgaagatgtcggtaacgacgacggtgacggagaggtggaggttatggtagatagttagacaatttttacaacagtaacggtaacggaagtcgctttggacggaaaaatgaatatttttggcgaagtgaaagaaaaaaaggaattacttgtgatgatttattcgccgtctcaaaaaggtagaaaagagtatatggcttcttttcttttttccttgtataggtcgaaaattctcccgaaaaaaacgagaggagattatttttctttttttattttattttgcaatttcggagtttaaagttaatttagaaattcaatgctaaaactaagaggttactagttactgctataatttttgttattaatttaattgatttgaatttaattaatagttttaagttttagtgctatattaaaacttgagattcacataaatatagtttgcgttttttctaaaatttaaatgtaacactatatattttgcacatttatctacaatcacgttattttgtttggatttgagatattagtggaatacgacaaaattaaatgtgatttggttg

SEQ ID NO: 8868 - DNA, 1640 bp, Glycine max
gttgtggtccgggttttggagattcattacattaccctcttatatataacttgttacttagatttttcttcttctttttttatctctcaacggagagacagaaaaaaagaaagaacgaaagagtgattaattagagggacatgagaacaaggagaggtgcgtgttatcctggtgtagtctcaaggatgtgctccaatgtgagggttacgaagaaaaaaagcaaggatctgcacatgcatatgcatgttcctgccggagactccattatttatagccggaaaaagcagaagaaaacgccggaaaaactcgccgccggtcgttacgattttttcgagtccttgccggatgacctcgtaatctccatcttctgcaagcttagttccaccgccactaaaccttccgatttcgtcaatgttttaatcacgtctaaaagattaaacagattagcacttcattcgcttgtattatccaaagcctcgccgagaactttcactattaaagcaaaatattggtgcgattcggcacacaaattcctcaaacactgtgccgatgccggaaacattgaagcttgctatactttaggcatgattcggttctactgtttgcaaaaccgagggagcggcgcgtcgttgatggcgaaggcggcgattaactctcacgcgcgggctctctacgcgctggccgtgattcagttcaacggaagcgggggcacgaagagcgacaaggacctacgcgccggcgtggcgctatgcgcaagagcggcgtttctcggacacgtcgacgcgctgcgcgagctcggccactgcctacaggacggttacggcgtacggcagaacatcgccgagggacggcggttcctcgtgcaggccaacgcgcgtgagctcgccgccgtgctgtccaccggcgccgccgcgcgtaccttgctgagttggaatcttcagccgcagcagctccggcaggggtccgggtgtccgcttctcagcgatttcggatgcaacgtgccggcgccggatgtgcatccggcgagcctgttcatgactgagtggttcgccgctcacggcggttctccgggaccggggctgagactctgttctaacgcggggtgcgggaggcccgagacgaggaagcacgagtttcgaaggtgttctgtgtgcggcgaggtgaattattgctcacgcgcgtgccaagcgcttgattggaagttccggcacaaagcggagtgcgcccccgtggagcgatggctcgacgaggacggcgaagatgtcggtaacgacgacggtgacggagaggtcgaggttgttatggtagatagttagacaatttttacaacagtaacggcaacggaagtcgctttggacggaaaatgaatctatttttggcgaagagaaattacttgtcgtgatttattcgccgtctcaaaaaggtagagagaatatggcttcctttcgttttttccttgtatagtttgaaaattctcccgaaaaaaaaaaaagacgaggggagattatttttctttttttttttgttgcaatttcggagtttaacgttaactagaaattagaaattcaatgctaagaggttactagttactaatttttgttattaatttaatcgatttgaacgtaattagtagctttgaa

SEQ ID NO: 8869 - DNA, 1195 bp, Vitis vinifera
tgttatacaaaatctcacgggagagagattcagagatatgagaaccagaagaggggtttgttaccgtgaagtggacatgtgtacggacaatagagtagtgaagagaagaggggatttttccggcgacaacgtcgtttgctgccggaaacgccagaggctagcgccggagtccgccggaaagtctgatttctttgaagccttgccagatgatctcgtcatttgtattctcagcaaactcagctcctctgctggatgtccttcggatttcatcaacgttttgctcacatgcaaaagatttaacggattaggtcttcattctctagtgctatccagagcttcttcgaaatcgctcgccgttagagcgaagaactggtctgagtcggctcttcggttcttgaaactttgcgccgatgccggcaacgtcgaggcgtgctacactcttggcatgattcgtttctactgtttacaaaatcgagtgagcggagcttcgctgatggctaaagccgctataagttcgcacgcgccggcactgtactcgcttgccgtgatacagttcaacggtagcgtcggctccaagaacgacaaggatcttcgagccggcgtggctctctgtgccagagctgccttcctcggccacatcgacgcgcttcgcgaacttggccactgcctccaagacggctacggcgttcgccaaaacgttgctgaaggacggcggttccttgtccaagctaacgccagagagctagccgccgtcctctcctcggcatcttcggcagtttcgtcgcgctcgtggctcacgtggaatccacaccaacatcatcgccatgtaaccggctcgggatgtccgttattaagcgatttcggctgcaacgtgccggcaccggaggcgcatccagcaagccgcttcttggcggagtggttcgccgctcgtggtggcgttcccggtccagggctgaggctttgctctcacgccggttgtggacgtccggagatgagacgacacgagtttcgtcgctgttccgtgtgtggtatcgtgaactattgctctcgcgcgtgtcaagcactcgactggaagttgcgccacaaggcggcgtgcgcgccggtggagcgttggctagtcgacgacggtgatgctaacggagaaggtgctgtagccggcgccgcagcggaggacgacgtcatcgtcgctagttaa

SEQ ID NO: 8870 - DNA, 1090 bp, Glycine max; identical to SEQ ID NO: 8465

SEQ ID NO: 8871 - DNA, 1412 bp, Glycine max; identical to SEQ ID NO: 8467

SEQ ID NO: 8872 - DNA, 1278 bp, Glycine max; identical to SEQ ID NO: 8468

SEQ ID NO: 8873 - DNA, 1412 bp, Glycine max; identical to SEQ ID NO: 8467

SEQ ID NO: 8874 - DNA, 1639 bp, Glycine max; identical to SEQ ID NO: 8471

SEQ ID NO: 8875 - DNA, 860 bp, Helianthus annuus; identical to SEQ ID NO: 8477

SEQ ID NO: 8876 - DNA, 974 bp, Vitis vinifera; identical to SEQ ID NO: 8478

SEQ ID NO: 8877 - DNA, 2132 bp, Vitis vinifera; identical to SEQ ID NO: 8479

SEQ ID NO: 8878 - DNA, 990 bp, Arabidopsis thaliana; identical to SEQ ID NO: 8480

SEQ ID NO: 8879 - DNA, 1160 bp, Glycine max; identical to SEQ ID NO: 8481

SEQ ID NO: 8880 - DNA, 1008 bp, Dimocarpus longan; identical to SEQ ID NO: 8482

SEQ ID NO: 8881 - DNA, 1029 bp, Vitis vinifera; identical to SEQ ID NO: 8483

SEQ ID NO: 8882 - DNA, 1191 bp, Glycine max; identical to SEQ ID NO: 8484

SEQ ID NO: 8883 - DNA, 1630 bp, Glycine max; identical to SEQ ID NO: 8485

SEQ ID NO: 8884 - DNA, 1163 bp, Glycine max; identical to SEQ ID NO: 8486

SEQ ID NO: 8885 - DNA, 1077 bp, Glycine max; identical to SEQ ID NO: 8487

SEQ ID NO: 8886 - DNA, 1122 bp, Glycine max; identical to SEQ ID NO: 8488

SEQ ID NO: 8887 - DNA, 1551 bp, Glycine max; identical to SEQ ID NO: 8472

SEQ ID NO: 8888 - DNA, 1630 bp, Glycine max; identical to SEQ ID NO: 8485

SEQ ID NO: 8889 - DNA, 1191 bp, Glycine max; identical to SEQ ID NO: 8484

SEQ ID NO: 8890 - DNA, 2004 bp, Glycine max; identical to SEQ ID NO: 8502

SEQ ID NO: 8891 - DNA, 1546 bp, Glycine max; identical to SEQ ID NO: 8507

SEQ ID NO: 8892 - DNA, 2062 bp, Glycine max; identical to SEQ ID NO: 8503

SEQ ID NO: 8893 - DNA, 1266 bp, Glycine max; identical to SEQ ID NO: 8509

SEQ ID NO: 8894 - DNA, 2613 bp, Medicago truncatula
gatccctctgcgttgcttcctccttttgttgggtgcatagcatagtttgtgttgcagcctgcaacttttctctctctttttcttcgaagtcaccgcaacttcaacttcaacagtttctccatgaggttgtgcatctgcgacctactgttgaaagatgtttgaccgaagtgattacaaatcacagtacatggatggccagcgagaaagttcttttaggtgggatttcttggattctaaactatcttcatcttccgatgttagagttacaaaatctggattcagtattgataaattaaaccatggtagtcatggaagcagcacaacctctaggtcttttaaaaaaggaatgagaaagggatctgaaggactgaagttaattggtcgatcacttgggctgggggtatctaaggcagtgtttccagaagatcttaaagtgtctgaaaagaagatatttgatccccaagacaaatttttactcttatggaataaattatttgttatctcatgcattttttccgtgtttgtggatccactgtttttttatctccctgtcatcaatgatcaattacactgtctgggtatagaccgaaagttggcgataatagtcaccaccttgaggacagtcattgatgctttctatttgctaaacatggctctccaatttcgtactgcttacattgctccatcatctcgtgtctttgggcggggagagcttgtgatagattcggcacagatagccaagcgatacttgcgacgatatttcatcgttgatttcctatctgtgttgccagtaccacagattgttgtttggagatttcttcagaggtcaaaaagttctgatgtactagcaacaaagcaggccttgctgttcattatcttgcttcagtatattcctagatttcttcgaatggtgccattaacttcagaacttaagagaacagccggtgtctttgccgaaactgcatgggcaggtgctgtatattatttgctgttgtacatgcttgccagtcatatagttggtgctttttggtacttgttagctattgaacgcaatgactcgtgctggcagaatgcttgcagcgacaatgggtgcaacaaaaactacttgtactgtgagaaccagcacacggaaggttatagtgcctggcaaaacaaaagcaaagctatttttaagtcaaagtgctctgtagatgatgatcctccaccttttgattatggaatttttaagcaagccttgtcatctggtatcatttcatctaagaagtttatcacaaaatatctttactgtttatggtgggggctccagaatttaagtacccttggtcaggggcttcaaactagcacatatcctggggaggttatcttttcaatagcacttgccatagcaggtctcatcctcttcgcgcttctgattggcaacatgcagacatatcttcagtcccttacccttaggctggaggaaatgagagtcaaaaggcgtgattcagaacaatggatgcatcatcgcttgctcccaaaagagcttagagagcgtgtgagacggtatgatcaatataagtggttggcaacacgtggtgtagacgaagatattttagttcagagtctaccaaaggatcttcgaagagatattaagcgtcatctctgtttggctttagtgaggagggttccactatttgagagtatggatgagagattgcttgatgccatatgtgagagactgaaaccatgtttatttacagagaatacttatattgttcgggaaggagatccagttgatgagatgcttttcatcatacgtgggcgtcttgagagtgttaccacagatggtgggaggagtggttttttcaaccgcacatatctaaaggaggccgaattctgtggggaggagcttttaacatgggccctggaccccagatctggttctaatcttccaacctctactcgaactgtgaaggcgttaacagaggttgagacttttgccttaaccgccgatgagctgaaatttgttgccagtcagtttagacgtcttcacagtagacaggttcaacacacttttcgtttttactctcaacaatggagaacctgggctgcttgttttattcaagcagcatggcgtcgatattgtaaaaagaaaattatgaagcttcgtatgaaggaagaagaagcggatgagtctcacggcaatgccagtggcagttcctccagccttggtgccgccttattagcctcaaagtttgccgcgcgcactctccgtggtgtacaccgcaatcgactcgccaagactgccagagagttggtgaaattacagaaaccccccgagcctgactttacagcagatgatgcagactaaaattttcatgtgtaactgctcttgaaattcttgtttttcatttactattatgatttatgactgatcttgtgaaaaaggtcaaaagcaatgtatcctttgtaaataattgtattatagtatacattaagcctaactggctgtcatattaggtttgccaccagtatgtaacttatttaccgttgtcaattgtaatattgaaattatgtgttggaagaattaaggttgattttatttgtggtcaatatttaatgagatttgatgat

SEQ ID NO: 8895 - DNA, 2500 bp, Glycine max
cggcatcgctaatttctctccgtcgaggttgttcgtatgtgatcaactgttgaaagatgtttgactgtggtcccaagtcagaatacatgggtggccagcgggaaaattttttgaggttggaggccttggattctacactatcttcatcttctgatgccggagttatcaaatctggatttagtattgataaattaagccatggtcatggaaacagcacaacttctaggtctttcaaaaggggaatgagaaggggatctgaaggactgaaatcaattgggcgatcgcttgggttgggagtatctagggctgtgttcccagaagatcttaaagtgtcagaaaagaagatatttgatcctcaagacaagtttctgctcttatggaataaactttttgttatctcatgcattttggccgtctctatagatccactatttttttatctcccagtcattaatgattcatttcattgtcttggcatagaccgaaagttggcaacaatagttacaaccttaaggacattggttgatgctttctatcttctacacatggctctccaatttcgtactgcttatattgctccatcttctcgtgtctttgggcgtggtgagcttgtgatagattcagcacagatagccaagcgatacttgcagcggtatttcatcattgatttcctatccgtgttgccgataccacagattgtggtttggagatttcttcagaggtcaaaaggttcagatgtactagcaacaaagcaggccttgttgttcattatcttgcttcagtatgttccaagatttctccgaatggtaccattgacttcagagcttaagagaacagccggtgtctttgctgaaactgcatgggcaggggctgcatattatttgctgctatacatgcttgccagtcatatagttggtgccttttggtacttgttagctattgaacgcaatgactcatgctggcagaaggcttgcagtgacattaggtgcaataaaaatttcctatattgtgggaaccagcacatggaaggttatagtgcttggaataaaacaagtgaagatattcagtcaaggtgctctgcagatggtgatcctgcgcattttgattatggaatttttgggcaagtcttgtcttctggcatcatttcatctaagaagttcatctccaaatactgttactgtttatggtgggggctccagaatttgagtacacttggccagggacttcaaactagcacctatcctggggaggttatcttttcaatagcactagctataagtggcctcatcctttttgcccttctgattggcaacatgcagacatatcttcagtctctcaccattaggcttgaggaaatgagagtcaaaaggcgtgattcagaacagtggatgcaccatcgcttactcccacaagatcttagagagcgtgtgagacggtatgaccaatataagtggctggcaacgcgtggtgtagatgaagaaaatttagttcagagtctaccaaaggatcttcggagagatattaagcgtcatctctgtttggccttagtgaggagggttccactatttgagagtatggatgagagattgcttgatgctatatgtgagagattgaaaccgtgtttatttacggagaatacttacattgttcgggaaggagatcctgttgatgagatgctgttcatcatacgtggtcgccttgagagtgttaccacagatggtgggaggagtggatttttcaaccgcggttttctaaaagaggctgacttctgtggggaggagcttttaacctgggccctggatcccaaatctggttctaatctcccatcttctactagaacagttaaggcattaatggaggttgaggcttttgccttaactgctgatgagttaaaatttgttgctagtcagtttaggcgccttcacagtagacaggttcaacacactttccgtttttactcccaacaatggaggacctgggctgcatgctttattcaagcagcatggcgtcggtattccaaaaagaaaattatgaagcttcgtcaaaaggaagatgagtcagacggagctcatgaaaatgttggtggcagttcctacagctttggtgctgccttgttagcctcaaagtttgctgcgcacaccctacgtggtgtacatcgcaatcgacttgccaagactgccagggagttagtgaaactacagaaaccccctgagcctgacttctctgcagatgatgctaactaaaaattttcatgtataactactctcttaaaatacttgttttcgttgactattatgattgaatttgtgaagaaaggtcgaaagcaaagtattacacaattatcctggttacagttgtgagggtttcaagacttgtaatgactcttgatctgtttccttgtaaataatagtaatcagccattttggctgtctgctaccgagcatgtaaacttatgtactattctcaattaatgaagttatagttactggttggcagaatc

SEQ ID NO: 8896 - DNA, 2609 bp, Glycine max
ccgctcttgtgatgacagcgacttaatctgtgagggaccgagattccgccataaatgctttcttctcattctcgctcctcactccatcttctcgttccgttcagcatcgctcatttctctccgacgaggttgttcatatgtgatcaactgttgaaagatgtttgactgtggtcccaagtcagaatacatgggtggccagcgggaaaattttttgaggttggaggccttggattctacactatcttcatcttctgatgccggagttataaaatctggatttaatattgataaattaagccatggtcatggaagcagcacaacttctaggtctttcaaaaggggaatgagaaggggatctgaaggattgaaatcaattgggcgatcgcttgggttgggagtatctagggcagtgttcccggaagatcttaaagtgtcagaaaagaagatatttgatcctcaagacaagtttctgctcttatggaacaaactttttgttatctcatgcattttggccgtgtctatagatccactatttttttatctaccagtcattaatgattcatttcattgtcttggcatagaccgaaagttggcaacaatagttacaaccttaaggacaatggttgatgttttctatcttatacacatggctctccaattccgtactgcttatattgctccatcttctcgtgtctttgggcgtggtgagcttgtgatagattctgcacagatagccaagcgatacttgcagcggtatttcatcattgatttcctatccgtgttgccgataccacagattgtggtttggagatttcttcagaggtcaaaaggttcagatgtactagcaacaaagcaggccttgttgtacattatcttgcttcagtatgttcctagatttctccgaatggtaccgttgacttcagagcttaagagaacagccggtgtctttgctgaaactgcatgggcaggggctgcatattatttgctgctatacatgcttgccagtcatatagttggtgctttttggtacttgttagctattgaacgcaatgacacatgctggcagaaggcttgcagtgacattgggtgcaaagaaaatttcctatattgtgggaaccggcacatggaaggttatagtgcttggaataaaacaagtgaagatattcagtcaaggtgctctgcagatggtgatcctgcacattttgattatggaattttcgggcaagtcttgtcttctggcatcatttcatctaagaagttcatctccaaatactgttactgtttatggtgggggctccagaatttgagtacacttggccaggggcttcaaactagcacctatcctggggaggttatcttttcaatagcactagctataagtggcctcatcctttttgcccttctgattggcaacatgcagacatatcttcaatctctcaccattaggcttgaggaaatgagagtcaaaaggcgtgattcagaacagtggatgcaccatcgcttactcccacaagatcttagagagcgtgtgagacggtatgaccaatataagtggctggcaacgcggggtgtagatgaagaaaatttagttcagagtctaccaaaggatcttcggagagatattaagcgtcatctctgtttggccttagtgaggagggttccactatttgagagtatggatgagagattgcttgatgccatatgtgagagactgaaaccgtgtttatttacagagaatacttacattgttcgggaaggagatccagttgatgagatgttgttcatcatacgtggtcgccttgagagtgttaccacagatggtgggaggagtggatttttcaaccgcggttttctaaaagaggctgacttctgtggggaggagcttttaacctgggccctggatcctaaatctggttctaatcttccatcttctactagaacagttaaggcattaatggaggttgaggcttttgccttaactgctgatgagttaaaatttgttgctagtcagtttaggcgccttcacagtagacaggttcaacacactttccgtttttactcccaacaatggaggacctgggctgcatgctttattcaagcagcatggcgtcggtattcaaaaaagaaaattatgaagcttcgtcaaaaggaagatgagtcagacggaactcatgaaaatgttggtggcagttcctacagctttggtgctgccttgttagcctcaaagtttgctgcgcacactctacgtggtgtacatcgcaatcgacttgccaagactgccagggagttagtgaaactacagaaaccccctgagcctgacttctctgcggatgatgctgactaaaatttccatgtgttctcttaaaatgcttgttttggttgactatgatgattgaatttgtgaagaaaggtcgaaagcaatgtattatacaattatcctggttacagttgtaagggtttcaagacttgtaatgactcttcatctgtgtccttgtaaattatagtattatacattaagccaacttggctgtgggccaccgagcatgtaaacttatgtactattctcaagtttattattgaagttatataattactggttgacagaatat

SEQ ID NO: 8897 - DNA, 2584 bp, Glycine max
aaaagtaaaagtaaaagtgtggatgtaggtggtggattggtagaaagaaggaaacaatggcagcgttcgtgaagggagcaccttttcgagtcgtagttgaccttcttcattgattactatttctccctcagatttcgcttcaatcttccatccccgttccgttcaattctactttcaaggttgtgtattacatgaatcgttggttgaaagatgtttgactgtggttacaagtcgcaatatgtgggtgggcaatgtgaaaaatttgtgaggttggatgacttggattctagactatcatcatcttctgaagctgcagttaaaacatgtggatttagtattgataaattaagccatggtggccatggaagcagtactacttctcggtcttttaaaagaagaattagaaagggatccgaaggactgaagtcaattggccgatcacttggattaggggtatctagggcagtgttccctgaagatcttaaagtttcagaaaagaagatatttgaccctcaagacaagtttttgctcacctggaataagctttttgttatatcatgcattttagctgtgtctgttgatccattgtttttttatctccctgtcatcaatgattcatttcactgtcttggtatcgaccgaaagttggcaattacagttaccaccttgaggacattcattgatgctttctatctcgtacacatggccctccaatttcgtactgcttatattgctccatcatctcgtgtttttggacggggtgagcttgtgatagatccagcacagatagccaaacgatacctgcggcggtatttcattgttgattttctatcagtgttgcctttaccacagattgtggtttggagatttctgcagaggtcaaaaggttcagttgtacttgcaacaaagagggcccttctgttcatcattttgcatcagtacattcctagatttttccggatggtaccgttgacttctgaacttaagagaacagctggtgtctttgctgaaactgcatgggcaggggctgcatattatttgctattatttatgcttgctagtcatatagttgggtcgttttggtacttgttagctgttgaacgcaatgacttttgctggcaaaaggcttgtagtggcaatgggtacaataaaaatttcttgtattgtggcaaccaatacatggaaggttatagtgcctggcagaatagaagtaaagatattcttacatcacagtgctctgtagataatgataattcaccttttgactatggaattttcaaacaagccttgtcatctcgtattgtttcatctaagaagttcttctccaagtactgttactgtttatggtgggggctccaaaatttaagtacacttggccaggggcttgaaacaagcacctacactggggaggttgtcttttcaatagcactagccatagctggccttatcctatttgcacttctgattggtaacatgcagacatatcttcagtctcttacaattagacttgaggaaatgagagtcaaaagacgtgattcagaacagtggatgcatcatcgcttgctcccacaagagcttagagagcgtgtgagacgatatgatcaatacaagtggttggcaacacgtggtgtagatgaagaaagtttggttcagagtttgccaaaggatcttcgaagagacattaagcgtcacctttgtctggctctagtgagaagggttccactatttgagagtatggatgagagattgcttgatgccatatgtgagagactgaagccatgcttatttacagagagtacttacattgttcgtgaaggagatccagttgatgagatgctcttcatcatacggggtcgccttgagagtgttactacagatggtgggaggagtggattcttcaatcgtggttttttaaaagaggccgacttctgtggggaggagcttttgacctgggcactggatcccaaatctggctctaatctcccatcttctactcgaacagttaaagctttaacagaagttgaagcttttgccttaactgctgaagagttaaagtttgttgccagtcagtttaggcgcctgcacagtagacaggttcagcacacctttcgcttttactcccaacagtggaggacttgggctgcatgctttattcaagcagcctggcgtcgctattccaaaaggaaaactatggagcttagtcagaaggacgaacctgaggagtcagaaggaactcgtggcaatgccagtggcagttcgtacagccttggtgccaccttcttggcctccagatttgctgcaaatgctcttcgtggtgtacatcggaatcgggaagccaagagtgccagggagttggtgaaactacagaaacctccagagcctgacttcactgctgatgatgcagactaaattttcatatataaactacacttgttttcaacttctcatttactattttgaatataactttctattaacggttaaaggtaaaacattatacaatttgttagaaaatatgagaaatatctgatatcttttgatataaaatatatttagtcacatccgttgtatcttttctttgcaa

SEQ ID NO: 8898 - DNA, 2555 bp, Vitis vinifera
ctctctatatccaaacctcactcctctggactcgacttcatgaaatgaactgccggattacagcgtgatgtctatgtctttgattgtgaaagatgtttgattgtggtcataagtcacagtacatgggggtccaacgagagaagtttgtaaggttggatgacttggactccaaactatcgatttcttctgatccaggagttaatagatgcggattcagtattgacgggttaagccatgttggtcttgcgagaagtacatcatctagatctttgaagaaaggaatgagaaaaggatctgaaggactaaagtcaattggccgatcacttggatttggggtttctcgagcagtattcccagaagatcttaaagtgtcagaaaagaagatatttgaccctcaacacaaattccttcagttgtggaataaactttttgtcatatcatgtattcttgcagtatctgtggaccctctgttcttttatcttccagtcattgatagttcatcaaaatgccttggtatagatcgtaagttagcaatcacagcgacaacattgcggacaattattgatgctttctatcttatccatatggctctccaattccgaacagcttatattgccccatcatctcgggtttttgggcgaggtgaacttgtgatagatcctgcaagaatagctaaacggtatttgcgaacgtacttcatcattgattttcttgctgtgctgccactaccacagattgtggtctggagatttcttcatagttcagatggttcagatgtattgtctacaaaacaagctctgttcttcatagtcttacttcaatacatccctaggctgtttcgaatgctacccttatcttcagaactgaaaaggacttctggtgtctttgctgaaactgcttgggctggtgctgcatattatttgcttctgtacatgcttgctagtcatatagttggggctttctggtacttactagctgtagaacgtaatgattcatgctggcagagggcttgtgctcatagcggaaattgcaagacagatttcttgtattgcagtaacaggcacacggagggttatgatgcctggctcatagacagtgacaatgttcttaattcaaattgctctgtagaaggtgacaatccaccatttaattatggaatctataccaacgctctgtcatctggcattgtttcatccaagaagttcttatctaaatactgttactgtttgtggtggggtctacagaatttaagcacactcgggcaggggcttcaaaccagcatctatcctggagaagtaatattctctatagctcttgccatacttggtctcatactctttgcacttctgattggcaacatgcagacctatcttcagtctcttaccatacggcttgaagagatgagggtcaaaaggcgcgactcagagcagtggatgcatcatcgcttactcccacaagaactcagggaacgggttagacgatatgatcaatacaaatggttggaaacacgtggagtagatgaagaaaacttggttcaaagtctaccaaaggatctcagaagggatatcaaacgccacctctgtctggctttggtgaggagggttcctctatttgagaatatggatgagaggttgctggatgctatttgtgagcgactgaaaccaagtttattcacagaaaataccttcattgtgcgagaaggagatccagttgatgagatgctgtttattatacggggtcgccttgagagcgtaaccactggtggtgggaggagtggatttttcaaccgcagtttgctgaaagaaggggatttctgtggggaggaacttctaacttgggcgctggatccaaaatcgggttctaaccttccatcttctacacggacagtgaaggcccttacagaggtggaggcttttgctctaatagctgaggaattgaaatttgtggccagccagttcaggcgcctgcacagtagacaggttcaacacaccttccgtttttactcacagcaatggagaacttgggctgcgtgctttatccaagcagcatggcgccggtactccaagaggaagattctggagcttcggcggaaggaagaagaagaggaagaagcagcagcagctgcggcagcagaagggctgagcgggaccaacaataatgttcgaggaggctcatatagtctgggagccactatcttagcttccaggtttgcagcaaatgctctaaggggggttcataggaaccgtatcactaagagtgctagggaactggtgaagctacagaagcctccagagccagatttctctgctgatgatgcagattaataatatgataaatatgctcatctgaaatagctggttgtttattgagactgtttctagatttcattttgctttcagaagggctaagaacaaatgtattataaatacacaccccagtacagccttttttttttttaattgcgtcactgtaaggctttgcactagcaaaattatatggttgaatcttatgtattgtctcttacttcagtcgtatctcgtaacctcttcgttata

SEQ ID NO: 8899 - DNA, 2659 bp, Arabidopsis thaliana
gtaagcctttgtctttgtctctttctcttgcttcagcaagttcacgtctgctctatttctaattttgttctaagattcaattctccttttttctatgcgagaaatttaagattggttctctagctctacctctttaaatttgttactatgtgtcggtgtccatcattcatcaaattttttccttttttatccatttgagttgatgtaatgatgttgcttcgcttcatactgcttgcttaatgattagagtcttaaagctgtgctctttcttcatcgatttgagcaagtgatcttggaaggctcttgagttctgaattccttgtaagcaatcatggcagggaaaagagaaaactttgtgagggtggatgatttggactctaggttaccatcatcatctgtagccttccaacagaactacgcctccaatttcagtggacaacttcatcctattcatgcaagcaatgaaacttctagatccttcaagaaaggtatccagaagggttccaaagggcttaagtcgatcggacgttcacttggtttcggtgtttatcgagcagtgttcccagaagaccttaaagtatctgaaaagaagatatttgatcctcaggataaattccttttgtattgcaataaattattcgttgcgtcatgtattctttcagtgtttgtggacccttttttcttctatcttcctgtgattaatgctgagtccaagtgcctgggtattgacagaaaactggctatcacagcaagtacattgcggacttttatcgatgtgttttatctcgctcacatggctctccagcttaggactgcttatattgcaccttcatcacgggtctttgggcgaggtgaactcgtgattgatcctgcacagatagcaaagagatatctacaacgttggtttattattgactttctctcagtacttcctctccctcagattgtagtttggaggttcttgcaaagttcaaatgggtcggatgtattggctacaaagcaggccttgcttttcattgttttggtccagtatataccgcgattcctacgtgtcttacccttgacgtcagaattgaaaaggacagcaggtgtctttgctgaaacggcttgggctggtgccgcttattatctgcttttatatatgcttgcaagtcatatagttggagctttttggtaccttttagccttagaacgtaacgacgcctgctggcaggaggcctgtatagatgcagggaattgcagcacagatttcttgtactgtggcaatcaaaacatggacggctatgctgtttggaacagagccaaggaatctgttcttaagtccaagtgccgagctgacctcgatgataataatcctccatttgactttgggatttatacacaggctttatcgtctggaattgtctcgtcccaaaacttcatcgtaaaatattgttattgtttgtggtggggccttcagaacttgagtacacttggacaagggcttgaaaccagtacatacccaatggagattatattttccatatctctcgccatttctgggttgatcctctttgctcttctcattggaaacatgcagacatatctccaatctcttaccatccggcttgaagaaatgagagtaaagaggcgtgattcagaacaatggatgcatcacagaatgttaccacaagatcttagggagcgtgtgaggcgctatgaccagtataaatggttggagacacgtggtgtagatgaagagtatctcgttcagaatcttcccaaggatctccggagagacatcaagcggcatctctgtctggctttagtgcgaagggttccattgtttaagagcatggacgacaagctgctggatgcgatctgtatgcggctgaaaccatgcttgttcacagagagtacctacttagtgcgggaaggagatcctgtagacgagatgctattcataatacgtggtcgcctcgagagtgtgacaacagatggaggcaggagcggtttcttcaaccgcagtctcctgaaagaaggagaattctgcggggaagagcttctgacatgggcattggatccaaaatcaggtgtaaatctcccgtcttccacgaggaccgtgaaagctctgacagaagtagaggcgtttgcgctgacctcagaggagctgaagtttgtagcaagccagttccggcgcttacatagcaggcaagtgcagcacacattcaggttttactctcaccaatggaggacttgggctgcttgtttcatccaggctgcctggcgtagatactgcaagaggaagaaaatggaagaggcagaagccgaggccgcggctgtgtccagctcaaccgctggaccttcatactccattggggctgcatttcttgccactaagtttgcggctaatgcgcttcgcaccattcacaggaaccggaacacaaagattagggatttggtgaagctgcagaagcctcctgagcctgatttcactgctgactgatgattgagcagcttgtagacattattgtttataatttatgggaatcattacggttgagataaacaaatattgcttggctttaaagctgcttgtgctgtctgtaaaattaatatatgaagtgtagaaacaaagagattatagccgttggatttaataaatgtacggttaggatca

SEQ ID NO: 8900 - DNA, 2307 bp, Arabidopsis thaliana
atggcagggaaaagagaaaactttgtgaggttaccatcatcatctgtagccttccaacagaactacgcctccaatttcagtggacaacttcatcctattcatgcaagcaatgaaacttctagatccttcaagaaaggtatccagaagggttccaaagggcttaagtcgatcggacgttcacttggtttcggtgtttatcgagcagtgttcccagaagaccttaaagtatctgaaaagaagatatttgatcctcaggataaattccttttgtattgcaataaattattcgttgcgtcatgtattctttcagtgtttgtggacccttttttcttctatcttcctgtgattaatgctgagtccaagtgcctgggtattgacagaaaactggctatcacagcaagtacattgcggacttttatcgatgtgttttatctcgctcacatggctctccagcttaggactgcttatattgcaccttcatcacgggtctttgggcgaggtgaactcgtgattgatcctgcacagatagcaaagagatatctacaacgttggtttattattgactttctctcagtacttcctctccctcagattgtagtttggaggttcttgcaaagttcaaatgggtcggatgtattggctacaaagcaggccttgcttttcattgttttggtccagtatataccgcgattcctacgtgtcttacccttgacgtcagaattgaaaaggacagcaggtgtctttgctgaaacggcttgggctggtgccgcttattatctgcttttatatatgcttgcaagtcatatagttggagctttttggtaccttttagccttagaacgtaacgacgcctgctggcaggaggcctgtatagatgcagggaattgcagcacagatttcttgtactgtggcaatcaaaacatggacggctatgctgtttggaacagagccaaggaatctgttcttaagtccaagtgccgagctgacctcgatgataataatcctccatttgactttgggatttatacacaggctttatcgtctggaattgtctcgtcccaaaacttcatcgtaaaatattgttattgtttgtggtggggccttcagaacttgagtacacttggacaagggcttgaaaccagtacatacccaatggagattatattttccatatctctcgccatttctgggttgatcctctttgctcttctcattggaaacatgcagacatatctccaatctcttaccatccggcttgaagaaatgagagtaaagaggcgtgattcagaacaatggatgcatcacagaatgttaccacaagatcttagggagcgtgtgaggcgctatgaccagtataaatggttggagacacgtggtgtagatgaagagtatctcgttcagaatcttcccaaggatctccggagagacatcaagcggcatctctgtctggctttagtgcgaagggttccattgtttaagagcatggacgacaagctgctggatgcgatctgtatgcggctgaaaccatgcttgttcacagagagtacctacttagtgcgggaaggagatcctgtagacgagatgctattcataatacgtggtcgcctcgagagtgtgacaacagatggaggcaggagcggtttcttcaaccgcagtctcctgaaagaaggagaattctgcggggaagagcttctgacatgggcattggatccaaaatcaggtgtaaatctcccgtcttccacgaggaccgtgaaagctctgacagaagtagaggcgtttgcgctgacctcagaggagctgaagtttgtagcaagccagttccggcgcttacatagcaggcaagtgcagcacacattcaggttttactctcaccaatggaggacttgggctgcttgtttcatccaggctgcctggcgtagatactgcaagaggaagaaaatggaagaggcagaagccgaggccgcggctgtgtccagctcaaccgctggaccttcatactccattggggctgcatttcttgccactaagtttgcggctaatgcgcttcgcaccattcacaggaaccggaacacaaagattagggatttggtgaagctgcagaagcctcctgagcctgatttcactgctgactgatgattgagcagcttgtagacattattgtttataatttatgggaatcattacggttgagataaacaaatattgcttggctttaaagctgcttgtgctgtctgtaaaattaatatatgaagtgtagaaacaaagagattatagccgttggatttaataaatgtacggttaggatca

SEQ ID NO: 8901 - DNA, 1122 bp, Glycine max; identical to SEQ ID NO: 8488

SEQ ID NO: 8902 - DNA, 1077 bp, Glycine max; identical to SEQ ID NO: 8487

SEQ ID NO: 8903 - DNA, 3094 bp, Glycine max
atggggaaaaaatcgagtccggcggagggggaagaagcggtgccggagcatctgcggtgcagccgtacggacgggcggcaatggcggtgccggcggcgagtgaaggaaaacctaaagctgtgcgagattcactacgtgcaagctcggcgtcggcagcacaagaagacgctgaagcttaagagaaagaggcaaaacgacgccgttgaggttcagattggggccaagcgggaccgaaaatcgagagaggcattggtcaataggaggaaccaattggagctcataaggatggttctgcagagggaggttgagaagaagaagaagaagcaatcgcaattgaatttgaatttgcatttgcatttcaatcacgagttgaagaaggaactgccgaatggggttatggctattgcgtccaatatggcatcttctcgttacttcaggtccaagaatgctgagaggggctctgttagtaagttgcaggttgtgcagtgtggacaaagcataaagaaggggaggaggaagaagtgtcattggtgtcagagaagtgattcttggagtcttgtaatgtgttcaagctgccagagagagtttttctgcatggagtgcattaaacaacggtattttgctactcaaaatgaggttaagatggcatgtccagtttgtcgaggaacttgcacctgtaaagattgcttgtcaagtcaatacgaagagagtgaaagtaaggaatatttggctggtaaaaacagagttgataggatattgcattttcattatttggtctgtatgctccttcctgtactaaaacaaataaaagaagaccatcatgtaggcgtagaaaaaacagcaaaaatcaaaggtgggaaaagaacttctgatattatcatcaagcctgtcgattttgtctgcaacgagaaaaattactgcaattactgcaaaacacccattttggatcttcatagaagctgccttagttgttcctacagtctttgcttaagctgttctcaggcattaagtcaaggaagcacctctgaagaaatcaactcttctatatccaacctacctgacaaaataaatgcatgcatttttagtgaaggtcaccttttggatgataaggtcatttctaatggcaatttaactgatacctcaacattagttgagtggacaaattgtaatggtgctgacattgtgtcatgcccacctacaaagcttggtgattgtggtgatagccaccttgatttgaaatatgtctttcccttaagttggatcaaagaaatggaagtaaaggcagaagaaatagtttgcagctatgactttcctgaaactttggatagaagttcaagctgctcactgtgtgttgacaaagatcataaaactagcagatacaagcagttaccagaagcagctcaaagagaagattctaatgataatttcttgttttatcctacaattttggacatcagttgcaatcattttgaacactttcggaaacactggggaataggccatcctgtagtagtgcgagatgtgctccaaagtatgccaaaccttagttgggatccactggtcatgttctgtacttatcttgagaggagcatgacaagatatgagaataataaggacttacttgaagcttgtttggattggtttgaggtggagattaacgttagtcagtactttactgggtctcttaaatgtcaacctcagaaaaataattggcatgagatgctgaaacttaaaggatggttgtcttcccaactattcaaagaacaatttccagctcattttgctgaagtaattgattctcttccaattcaagaatacatgaatccctggtctggtcttctgaatttagctgcaaatttgccacaggggagtacaaaacatgacataggacctcatgtttatatttcatatggctgtgctgatgaagaagctgattccgtgacaaatctttgttacgactcatatgatatggttaatattatggcacataccatggacatccctctctctacagatcagcttgctaaaataagtaagttgttgaaaaaacacaaaactctatgtcagaaggtgtcatcatctaaaactactagtgagcattcagaagacagggaacaaaatgaaatgcatggtatggtaagagaaggaactgactttctaaggagagtcaatagaacagcttccatctctactgaagccaaaccgatatctaatcagaagttagacaccaatatttctgatgatgaagaatgtggttccgattctgaaactgaaaaggcacaaagctctttacctttccaaaggagagttctaagcactgaaatgtctccagatcataatcctagaaatccctttgaaaactcaaacagtgataaaaggaagaagtttactgagaattctggtgctcattgggatgtctttcgaagacaggatgtgcccaagctcttagaatacctcaaaagacactctgatgaattttcttataatagtgaatgtcacgagaagatggttcatccaattctggatcagagcttctttcttgacaatactcacaagatgagacttaaggaggagtttaaaattgaaccatggacttttgagcaacatgttggagaagctgtcatcattccttctggatgtccataccagattaggaatcctaagtgttgtgtacatgtggaattggaatttgtgtcccctgagaatgtctctgagtgtatccaattgattgatgaggtccggctgcttccagaagaccataaagcaaaaggagaaaagctggaggtgaaaaaaatggccctttatagcatgagtacagcaatagaagaaatacgtgagcttacctgcaaaacatgattgcacgagctaaaatatatatattcttaagatgcatctgaacctcgctcatgtcacaggctccataccatgtattctttttgtatagattagttcttaaactcattaagatatagcaaggtacttaaattggttacttccagattttttttttgttacatttatgccttacctgaatctgaaataaaaattacatggtctgtatatgtttctctattgtttattttttggagcgaaa

SEQ ID NO: 8904 - DNA, 2769 bp, Glycine max
atggggaaaaaatcgaatccggcggagggagaagaagcggtgccggagcatctgcggtgcagccgtacggacgggcggcaatggcggtgccggcggcgagtgaaggaaaacctaaagctgtgcgagattcactatgtgcaagctcggcgtcggcagcacaagaagacgctgaagctgaagagaaagaggcaaaacgacgccgttgaggctcagattggggcaaagcgggaccgaaaatcgagagaggcattggtgaataggaggaaccaattggagctcataaggatgttgaagaaggaacttccgaatggtgttatggctattgcgtccaatgtggcttcttctcgttacttcaggtccaagaatgctgacagcggctctgttagtaagttgcaggttgtgcagtgtggacgaagcatgaacaaggggaggaggaagaagtgtcattggtgtcagagaagtgattcttggagtcttgtaatgtgttcaagctgccagagagagtttttctgcatggagtgcattaaacaacggtattttgatactcaaaatgaggttaagatggcatgtccagtttgtcgaggaacttgcacctgtaaagattgcttgtcaagtcaatacgaagacagtgaaagtaaggaatatttggctggtaaaaacagagttgatgggatattgcattttcattatttggtctgtatgctccttcctgtactaaaacaaataaaagaagaccaccatgtagatgtagaagaaacagcaaaaactaaaggcaaaagaacttctgatattctcatcaagccggttgattttgtctgcaacgagaaaaattactgcaattactgcaaaacacccattttggatcttcatagaagctgccttagttgttcctacagtctttgcttaagttgttctcaggcattaagtcaaggaagcacctctgaagaaatcaactcttctatatccaacctacctgacaaaataaatgcatgcatttctagtgaaagtcaccttttggatgataaggtcatttctaatggaaatttaactgatacctcaacattacttgagtggacaaattgtaatggtgctggcattgtgtcatgcccacctacaaagcttggtgattgtggtgataaccaccttgatttgaaatatgtctttcccttaagttggatcaaagaaatggaagtaaaggcagaagaaatagtttgcagctatgactttcctgaaacttcggataaaagttcgagctgctcactgtgtgttgacaaagatcataaaactagcagatacaagcagttaccggaagcagctcaaagagaagattccaatgataattacttattttatcctacaattttggacatcagttgcaatcattttgaacactttcggaaacactggggaaaaggccatcctgtagtagtgcgagatgtgctccaatgtacaccaaaccttagttgggatccagtggtcatgttctgtacttatcttgagaggagcatgacaagatatgagaataataaggacttacttgaagcttgtttggactggtttgaggtggagattaacgttagtcagtactttattgggccacttaaatgtcaacctcagaaaaatacttggcatgagatgttgaaacttaaaggatggttgtcttcccaactattcaaagaacagtttccagctcattttgctgaagtaattgatgctcttccgattcaagaatacatgaatcccttgtctggtcttctgaatttagctgcaaatttgccacaggggagtacaaaacatgacataggaccatatgtttatatttcatatggctgtgctgacgaaggagatgatttcgtgacaaatctctgttacgactcatatgatatggttaatattatggcatatagcatggacattcctctctctacagatcaacttgctaaaataagtaagttgttgaaaaaacacaaaactctatgtcagaaggtgtcatctaaaactactagtgagcattcagaagacagggaacaaaatggaatgcatagtatagtaaaagaaggaactgactttctcaggagagtcaatagaacatcttccatctctactgaagccaaaacgatatctaatcagaagttagacaccaatatttctgatgatgaagaatgtggttccgattctgaaactgaaaaggcacaaagctctttaccttcccacaggagggttctaagcactgaacggtctccagatcataatcctagaaatccctttgaaaactcaaacagtgataaagggaagaagtttactgagaattctgctgctcattgggatgtctttcgaagacaagatgtgcccaagctcttagaatacctcaaaagacactctgatgaattttcttatactagtgaatgtcatgagaagatggttcatccaattctggatcagagcttctttcttgacaatactcacaagatgagacttaaggaggagtttaaaattgaaccatggacttttgagcaacatgttggagaagctgtcatcattccttctggatgtccataccagattaggaatcctaagtgttgtgtacatgtggaattggaatttgtgtcccctgagaatgtctccgagtgtatccagttgattgatgaggtccggctgcttcctgaagaccataaagcaaaagtagaaaagctggaggtgaaaaaaatggctctttatagcatgagtacagcaataaaagaaatacgtgagcttacatgcaaaacatga

SEQ ID NO: 8905 - DNA, 1508 bp, Glycine max
tccaaacacgcccttagcagaatggaccctaatccccgcactatccgcagcctagtctcgaagctcagctccgtctccgaagccgcccgcatcgacgccctctcccagctccgcctcatgtcaaaacaatcccccgaaacgcgccccatcatcgcccaagcaggcgcaatcccctacatcgcagaaaccctctattcctcttctcacccctcccaagaagacgccgctaccacactcctcaacctctccatcaccctaaaggagcccctcatgtccacacgtggcgtcctcgacgccatcgcccacgtcatctctcaccaccacaccacctcctctccccctgcggttcagtccgccgccgccaccatccacagcctcctctcctcggtcgactcctaccgccccgttgtcggctccaagcgcgagattgtctactccctcatcgacatcctccgctgccacctctcgtctcctccccgcactatcaaggattcgttaaaggcgttattcgccatcgcgcttcatccgattaacagatctacgatgattaaccttggtgcggttcccgcgcttttttcgctggtgttgaaggacggtagggttgggattgtggaggacgcgacggcggtgatcgcgcaggtcgcgggatgcgaggacgccgtggatgcctttcgcaaggcctccggtggtgtcggcgtccttgccgacctcctcgacctcgccaccgccgccagcatgcgcaccaaggagaacgccgtctcggcgctgctcaatttggtgcggtgcgggggcgacaaggtcgccgccgacgtgcgcgacgtcgtggcgtttggagcgctagatggaattgcggatgtgagggatgggggtagtgtaaaggggaagaacaaggctgctgaattgatgaaggttttgctcggtcaaaacaatggcgatgttgttgtgtttaacagtgatacttgttcttcgtttggttccaccaggaatcatgattcggaatgaatttgattcgtgtttggttggaattttatgattctttttgttctttgtagactggaaatagattctatacattgacacattcgttcaggcattcatgaattggaacggttgactgaaagataagatggttcacattttggatacatatgttaagtttgttacatttaggatgaaaacctagatgcagcttcttatgcgcttttggcgatgttttccaatcagaattagaggtttaccttggtaatttatgttgctgacatttatttcgaatctatatatatattatgctaattactgaggtgaatctccaattctgacgggagaataacgctgataccactgaagatttgtatattcattcaattgttctgaatagctgaatgtgtgaattctggagtttcctggttgtagggaattctggtcgatttaggtttagataagcggatttggtgtacaaattaggtgataatttttgttgttttgatgatattctattgattattgtg

SEQ ID NO: 8906 - DNA, 1136 bp, Glycine max
tccttcttccgccaacccaatcaatccaaacacgcccttagcagaatggagactaatccccgcacgatccgcagcctagtctcgaagctgagctccgtttccgaagccgcccgcgtcgacgccctctcccaactccgcctcatgtccaaacagtcccccgaaacccgccccctcatcgccgacgccggcgcaatccccttcgtcgccgaaaccctctattgctcttcgcaccccccccaagaaaacgccgctgccacactcctgaacctcagcatcacccaaaaggagcccctcatgtcgacacgtggcgtcctcgacgccatcgctcacgtgatctctcaccacaacaccacctcctcccccgcggcggtccagtccgccgccgccaccatccacagcctcctctcctccgtggactcctaccgccccgtcgtcgggtccaagcgcgagattgtctactccctcatcgacatcctccgctgccacgtctcgtctcctcctcgcaccatcaaggactcgttaaaggccttattcgccatcgcgcttcatcctcttaaccgatctactatgattaatcttggcgcggttcccgcgcttttttcgttggttgccaaggacggtagggttgggattgtggaggacgccaccgccgtcatcgcgcaggtcgccggttgcgaggacgccgccgaggccttttttaaggcctccggagtcggcgtcctcgctgacctcctcgaccttgccaccgccgccagcatgcggactaaagagaacgccgtctcggcgttgctcaatttggtgcggtgcggcggtgacaaggtcgccgccgacgtgcgcgacgccgtggcgttcggcgcgttggatggaattgcggatgttagggacggcgggagcggcaaggggaagaacaaagctgcggagttgttgaaggttttgctcggtgagaacaatggcgatgttgttgcgttgaacagtgatacttgttcttcgtttggttcctcgaggaatcatgattcggaatgagtttgattctttttgttaggaaatggattctttgcattcgcggattcattcaggcattcatgaattggaatggttgaatgaagataagatggttcacattttggatacatgtg

SEQ ID NO: 8907 - DNA, 1557 bp, Medicago truncatula
cttcttactagttcttacttcttatccaaattttgtctgcaaaaaacaactataacatgtatgaaaccaccatgactattggtcataacatcaacaataataaagtcttattattaagacgtgttgccctttccaagttgcaattgcaatctttctaaaacccactcatacaatcttcttaaacaaaaaaactcttacacgttttttcctctctctccttccaacccaaaatatggacgctaaccgccgcgtcgtgcggacgctagtatcaaaactaagctccgtttcagaaaaaacccgaatcgaatcactcatcgagcttcgtcaattatcaaaacaagatccatcaacccgacccataatagccgaatcaggcgcaatcccttacctcgctgaaaccctctattcttctttacacccttctcaagaaaacgctacagcaacacttttaaacctttccataacggaaaaagaacctatcatgtccacgcgcggtgttctcgacgcgcttgcgcatgtgatttctcatcattcatctacctccgccgccgctgctgttcaatccgccgccgctacgattcacagccttctttcctcggtggatgattatcgtactgttgttggatctaaacgtgagattgtttatgcgcttgttgatattcttcgttgccaccgttcctcaccgccaagaacggtgaaggattcattgaaagcgctttttgcaatcgcacttcatccattgaatcgtgctacgatggttcaatttggtgttgttcccgcgttgttttcgttgatcgttaatgatggtagagtagggattgttgaagatgcttccgcagttattgcgcaggttattacaatttttgatagtactcatatctatagaaatgtatatagaaagaagaagttgaatttaattaagtgctcgtttgaattgtcttatattttagtcgccggttgcgaggaaagtgttgaggcgtttaagaaggtttctggtgtgggagtgctggcggatttacttgatcttgctaccggttcgagtatgaggacgagggaaaatgcggtgtcggcattgcttaatcttgtgagatgtggtggagatgtggtggctggagatgtaagagacgcggtggcgtttggtgcgatggatggaattgctgatgttaaagataaaggaagtgttaaggggcagagtaaggcgatggagttgatgagagtgatggttggtgatgttcgtagtcacggtgatgttcgtagtcaaggtgatgttcgtaatcatggtaatgttggtttgaatagtgattcgtcgtttggttcttatatgaatgaagatagtggtacgtcattttgaatgatggtttgtcgttttggtctcttggtgaaatgagttttaggttggcggatcatgtacaaaaatagattagaattctgttgttgttgctgttactattaatgacatgttgttatgattctattgatttttatgttatgatatgagaaatatcatgatatgttgtacattctaacaaagaaaacgctcattaattgaaaaggtta

SEQ ID NO: 8908 - DNA, 825 bp, Glycine max
ttcgttttctccttaaccatgaagaagctctaccgtaaaggaaccgtccacccctctccctcgccgtcgccgccaaccatctccgaccacctatccttcctccccgccgccatcctcaccctcactctttccctctccccgaaggaccaagaagtcctcgcatacctcatctcatgctcctcttcctcatcctccaccaccaacttttccggcaaccatcgccggaaccctaaggttgtcgtggacggcgatcaccctcctgtcttcaactgcagctgcttccgctgctacatgagctactgggtccgctggaactcctctcccaaccaccaactcatacacgaaatcatcgacaccttcgaagactctctggctcacaccacaaaaccttctagaaaggataagagaaacaagaggggctccaaaaccaagccttccgagttgactcgctccgagtttccctcttcgccgccggaatcggtgccggagagtagcagtagcagcgccggtgccggtgaggttgaggctggtcagggcggtgatggtggcggcgatgaggagaaagggtcggtgagaaggtttgttagtttcattggagaaaggatttggggcgcttgggctcagtgaatgaattttcaaggggaaaggtgggtttaacttcaccctttctttctctcttttggttcttctttttttatttatttataaacttttttttttctttttgtacattaatcacttctctgcaatgtataaaaggaaaatggcagtttcgttttttgcgtttcattaagttgtcgatcttatggtatagtttcaattaaa

SEQ ID NO: 8909 - DNA, 803 bp, Glycine max
agccttctaaggccaaacttttgttctcttctcttcgttttctccttaaccatgaagaagctctaccgtaaaggaaccgtccacccctctccctcgccgtctccgccaaccatctccgaccacctctccttcctccccgccgccatcctcaccctcactctttccctctcttcggaggacagagaagtccttgcatacctcatctcatgctcatccaacaacaacttttccggcaaccctcgccggaaacctaaggttgtcgcggacggcgatcaccctcctctcttcaactgcagttgcttccggtgctacatgagctactgggtccgctggaactcctctcccaaccaccaactcatacacgaaatcatcgacgccttcgaagactctctcacccacaccgcaaagccttctagaaaggacaagagaaacaagaggggttcaaaacccaagcctcccgagatgactcgctccgagtttccctcttcgccgccggaatcgttgccggagagtagcagtagcggcgctggtgccggcgaggttgaggctggtcaaggcggtgacgatgaggagaaagggtcggtgagaaggtttgtgagtttcattggagaaaggatttggggcgcttggggtcagtgaatgaattttcaaggggaaaggtgggtttaatcttcaccctttctttctctcttttgtttcttcttttcttttattatttataaactttttttttttgctttttgtacattaatcacttctctgcaatgtataaaaggaaagtggcagcttcgtttttttgtgtt

SEQ ID NO: 8910 - DNA, 1263 bp, Glycine max
cgtgtccgcagaagatggaaagtggattacctttgcttaattatctcttgcagcagactctcagaaccatttgcacttctcccaattcttccactccttctaagtgggtatatgctgtcttctggaggatattacctcgcaactttcctccaccaaggtgggaatttggaggaactgctcttgatctctccaaaggaaataaaaggaactggatccttgtctgggaagatgggttctgcgattttaacgaatgcgagcaaaggaagagtggtagtggttacttgaacggtagatttggagctgacgtattcttcaaaatgtcgcatgaggtttacaattatggagagggactcgtgggaaaagttgccgcagataatagtcacaaatgggtttacaatgagagtcacaatgagtgtgaatctagctatattgcttcatggaatgcttcagtcgaacctcaaccaaaggcgtgggagtttcagttcaattcaggcattcagagtatagtcataatcgccgtcagagaaggcgtagtgcaattgggttcttttaacaagatatcagaggacctgaatctggtgatcagcatacagaggcaattcagctaccttcagagcatacctggtgtgtttggtattcaaagaccatacctacctcttcaacatccatacattgtgaagccaagtttcatagaaaacaatgcaatgactctatatgatatggggtggaacaccaaccctcagaatggagcaccaggcccatctctttgttcaggttctccttctctaccactaccaaccatgccctgtagttttggagctttgctatcaaagttaccatctggaatcccaccctataattccactcaagtccttgatgcagggacacaaagcaccattgagagagtgaagatagaggattgtgaatttcatcctacccttgatgacgatcacaaaggaagaaaggtcggttccctgaacaagtagcatggatttggaattggaagattaattaattaagagacaggaaccactttgaccataatgactcctaaatcatagtcagtatgttaagaaatggttagttatttattttctttcacttggccacaatgtgtattgtggtatgtttattggtggccgacaacctatcaatcatagcgatcactgttactgtttctttctgcgcgcatttatgtaatgatcaatgcaatgcagacattattatctagattagaacaaaactacattcagctttgcttct

SEQ ID NO: 8911 - DNA, 1211 bp, Glycine max
atggaaagtggattacctttgcttaattgtctcttgcagcagactctcagaaccatttgcacttctcctaattcttccactccttccaagtgggtatatgctgtcttctggaggatattacctcgaaactttcctccaccgaggtgggaattaggaggaactgctcttgatctctccaaaggaaataaaaggaactggatccttgtctgggaagatgggttctgcgattttaacgaatgcgagcaaaggaagagtggtagtggttacttgaacggtagatttggagctgagttattcttcaagatgtcgcatgaggtttacaattatggagagggactcgtggggaaagttgccgcagataatagtcacaaatgggtttacaatgagagtcacaacgagtgtgagtctagctatgttgcttcatggaatgcttcagtcgaacctcaaccaaaggcgtgggagtttcagttcaattcaggcattcagagtatagtcataatcgccgtcagagaaggcgtagtgcaattgggttctttcaacaagatagcagaggacctgaatctggtgatcagcatacaaaggcaattcagctaccttcaaagcatacctggtgtgtttggtattcaaagaccatacttacgactccaacacccatacattgtgaagcctagtttcatagcaagcaatgcaatgcctctatatgatatggggtggaacaccccacagaatggagcaccaggcccatctctttgttcaggttctccttctctaccattaccaaccatgccttgcaattttggagctttgctatcaaagttaccatctggaatcccttcccataattccactcaagtccctaatgcagggacacaaagcatcattgagagagtgaagattgaagattgtgaatttcatcccacccatgatgatgatcacaaagtaaaggtcggttccttgaacaagtagcatggatttggaattggaagattaattaaattgagacaggaaccactttgaccacaatgactttttaaatcatagtcaatatgttaagaaaatggttagttatttattttctttcacttggccagaatgtgtattgtggtatgtttattggtggccgacaattatcaatcatagcgaccactgttactgtttctttctgcgcgcatttacgttaatgatcaatgcaatgcagacaatattttcta

SEQ ID NO: 8912 - DNA, 1720 bp, Glycine max; identical to SEQ ID NO: 8139

SEQ ID NO: 8913 - DNA, 1479 bp, Glycine max; identical to SEQ ID NO: 8141

SEQ ID NO: 8914 - DNA, 832 bp, Glycine max
ggatcttcatctccaacaagtgtttctgtaaccatggcatccaccactctatcccctacaaccccttctcagctatgctcaggaaagagtgggattttcagtccctcacaggcacttcttgtgaagccagtgaagaggcagatgatggggaagagcaagggaatgagaattgcatgccaagccaccagcattcctgctgatagagtccctgacatgggcaaaagacagctcatgaatctgcttcttcttggtgccatttcactcccctctgctggaatgcttattccctacacctacttttttgtccctccaggttcaggttcttcagctggtggtactgttgccaaggatgctgttggaaatgatgtaattgcagagaattggctcaaggcacatggacctggtgaccgaacccttgcacaaggattgaagggagatcctacctatcttgttgtggagaaagacagaacccttgcaacatatgcaattaatgccgtgtgcactcaccttggatgtgtcgtgccatggaatcaagcagagaacaagttcatctgcccttgccatggatctcagtacaatgaccaaggaagagttgcgagaggacctgctcccttgtctctggcattagcacattgtgatatagatgatgggaaggtggtgtttgttccttgggttgaaacagatttcagaacaggtgatgctccatggtgggcttagactccttaaagccgtccctctgttgtcatgtatatttaaacatgaaattcaaacattctgttttgtattaatgcataaatatattttgtaatcaaattgatattttgtgaactga

SEQ ID NO: 8915 - DNA, 1096 bp, Glycine max
gaagaacatgtggctatgtggcacctatatgttgattagtgccttatccagcaactgttgtgttgacagttgtggtggtcgttcaagatttttaacctgaaatcttcacttcacatctctctatcctctcattctcatcaccaacaagtgtttctgtaaccatggcatccaccactctatcccctacaaccccttctcagctatgctcaggaaaaagtgggattttcagttcctcacaggcacttcttgtgaagccagtgaagaggcagatgatggggaagagcaagggattgagaattgcatgccaagccaccagcatttccgctgatagagtccctgacatgggcaaaagacagctcatgaatcttcttcttcttggtgccatttcactccccactgctggaatgcttattccctacacctacttctttgtccctccaggttcaggttcttcagctggcggtactgttgccaaggatgccgttggaaatgatgtaattgccgagaattggctcaaggcacatggacctggtgaccgaacccttacacaaggattgaagggagatcctacctatcttgttgtggagaaagacagaacccttgcaacatttgcaattaatgccgtgtgcactcatcttggatgtgtcgtgccatggaatcaagcggagaacaagttcatctgcccttgccatggatctcagtacaatgaccaaggaagagttgtgagaggacctgctccattgtctctggcattagcacattgtgatatagatgatgggaaggtcgtgtttgttccttgggttgaaacagatttcagaacaggtgatgctccatggtgggcttagactccttaaaacctctgttgtcataatatatatttaaacatgaaattcaaacattctgttttgtattaatgcataaatatattttgtaatcaaattgatattttgtgaactgaagctaagatgaaaaagaacctgaacaggtcacttttttccgtgtaatttttcaccatcacctctcccgtggcctttctctcccttttattttcttcatttaattcaatacatagcttatagtgttgccaaatatttaa

SEQ ID NO: 8916 - DNA, 884 bp, Glycine max
ccttgagccaattctcatcaccaacaagtgtttctgtaaccatggcatccaccactctatcccctacaaccccttctcagctatgctcaggaaaaagtgggattttcagttcctcacaggcacttcttgtgaagccagtgaagaggcagatgatggggaagagcaagggattgagaattgcatgccaagccaccagcatttccgctgatagagtccctgacatgggcaaaagacagctcatgaatcttcttcttcttggtgccatttcactccccactgctggaatgcttattccctacacctacttctttgtccctccaggttcaggttcttcagctggcggtactgttgccaaggatgccgttggaaatgatgtaattgccgagaattggctcaaggcacatggacctggtgaccgaacccttacacaaggattgaagggaggtcctacctatcttgctgtggagaaagacagaacccttgcaacatttgcaattaatgccgtgtgcactcatcttggatgtgtcgtgccatggaatcaagcggagaacaagttcatctgcccttgccatggatctcggtacaatgaccaaggaagagttgtgagaggacctgctcccttgtctctggcattagcacattgtgatatagatgatgggaaggtggtgtttgttccttgggttgaaacagatttcagaacaggtgatgctccatggtgggcttagactccgtaaagccgtccctctgttgtcatgtatatttaaacatgaaattcaaacattctgttttgtattaatgcatagatatattttgtaatcaaattgatattttgtgaactgaagctaagatggaaaggaacctgaacgggtcactttttaccgtgt

SEQ ID NO: 8917 - DNA, 796 bp, Glycine max
ggaaccatggcatccaccactctatcccctacaaccccttctcagctatgctcaggaaaaagtgggattttcagttcctcacaggcacttcttgtgaagccagtgaagaggcagatgatggggaagagcaagggattgagaattgcatgccaagccaccagcatttccgctgatagagtccctgacatgggcaaaagacagctcatgaatcttcttcttcttggtgccatttcactccccactgctggaatgcttattccctacacctacttctttgtccctccaggttcaggttcttcagctggcggtactgttgccaaggatgccgttggaaatgatgtaattgccgagaattggctcaaggcacatggacctggtgaccgaacccttacacaaggattgaagggagatcctacctatcttgttgtggagaaagacagaacccttgcaacatttgcaattaatgccgtgtgcactcatcttggatgtgtcgtgccatggaatcaagcggagaacaagttcatctgcccttgccatggatctcagtacaatgaccaaggaagagttgtgagaggacctgctccattgtctctggcattagcacattgtgatatagatgatgggaaggtcgtgttttttccttgggttgaaacagatttcagaacagtgatgctccatggtgggcttagactccttaaaacctctgttgtcatatatatatttaaacatgaaatcaacattctgtttcgtataatgcataatatattttgtatcaaattgatattttgtgactgag

SEQ ID NO: 8918 - DNA, 1116 bp, Vitis vinifera
ggcaccatccatcttccatcaaacaatcaccttatctactatctgctctgtccacattctctctcagcctcaccttcacaaaacctcacttgattaccacctgttgttgcccaaaaatctcagccatggctgcctccactctctcccctgcaacctcttctcagctgtgctctatcaggaatggggtgttgtcaccatcccatgctctgctgcccaagctcacaaggacgagtccatttgtggggaagggaaagggcttgaagatcaagtgtcaggccaccagcattccggccgatcgagttcctgacatgggcaagaggaagctcatgaacttgcttttgttgggtgctatttccctcccctcagctggcatgttgattccttatgccaccttctttgcacctcctggaacaggatctgctggaggtggtattgtggccaaggatgcacttggaaatgatgttattgcagatgaatggcttaagactcatggccctggtgacagaaccctaacacaagggttgaagggagaccccacctaccttgttgtggagaatgacaaaacccttgccacatatggtattaatgcagtctgcacccatcttgggtgtgttgtgccgtggaatgcagctgagaacaagttcatctgcccatgccatggatctcagtacaacaaccaaggcagggttgtcagaggacctgctcctctgtcgttggcgctggcacatgcagatattgatgatgggaaggtattgtttgttccttgggttgagacagatttcagaacaggtgaagatccatggtgggcctaaactgcaactcaaaattattcattgtcgcctcaaggtaatcagtcaaaacataatcatttataaaaccagaaatcttgtaagttgtaatgaagatccaaactgaaattggcattattactcttttaagtattaacaattttatatagaatccttatatttgtttggcattgagaatgagaaattttgatacaagttcttctatattagtattgtaaatctttaaatttagccttgggggaacaccagtggatgatatatttctgcggcaaagcttggttctttaactagatgatagttaaattgt

SEQ ID NO: 8919 - DNA, 1023 bp, Citrullus lanatus
ttacccacattttagtttcttagaaaattcctctccactccttgctctgatccatccatggcgtcttccactctatcttctgcaactccctcacagttatgtgccagcagaagtgctttgttctgtccctctcaagcccttttgaggaaacccaaaaacactcaaatgggagcaaagggaaaggaggttaaaatctcttgtcaagccactagtattccagctgatcgagtcccggatatgggtaaaaggaaaaccatgaatttgcttcttttgggtgccattggccttcccactgctactatgttgtatccttacacctatttctttgtccctcctggtactggaggtgccggtggtgggattgttgccaaggatgctcttggaaatgatgttcttgcagaggaatggctaaaggcacacggccccggagaccgaaccctcacacaggggttgaggggagaccctacctaccttgtggtcgagaaggataaaacgcttgcgacatatggaatcaatgcagtttgcactcaccttggatgcgtcgtgccatggaatgcagctgagaacaaattcatctgcccttgccatggatcccaatacaacgatcaaggcagggtggtcagaggacctgcacctttgtctcttgcattggttcatgctgatgtagatgacgggaaggtagtgtttgtcccgtgggtcgaaaccgatttcagaactggcgagaatccatggtgggcttaagcctccttctcatgtaacatctctccacatccatctcttcaatttgaagcaaattttttttcttccatctcctctcagttttctccagtttgtatattttggttttgttggatgaaatatataaaatacaagacaattgaatcctaggctttgtattgataagctttgttattaagtaccactctctattgttctacattctcttcatcttgtattcagtacatggattctgggtggattagctagctgctgcaaataatagtgttatagttcatatgcatt

SEQ ID NO: 8920 - DNA, 991 bp, Vitis vinifera
atggctgcctccactctctcctctgcaaccccttctcaggtctctagaggagagaatggggtgttgtcaccatcccatgctctgctgcccaagctcacaaggatgagtccatttgtggggaagggaaagggcttgaagatcaagtgccaggccaccagcattccggccaatcgagttcctgacatgggcaagagaaagctcatgaacttgcttttgttgggtgttgtttccctcccctcagctggcatgttgattccttatgccaccttctttgcacctcctggaacaggatctgctggaggtggtactgtggccaaggatgcacttggaaatgatgtcattgcagatgaatggcttaagactcatggccctggtgacagaaccctaacacaagggttgaagggagaccccacctaccttgttgtggaggatgacaaaacccttgccacctatggtattaacgcggtctgcacccatcttgggtgtgttgtgccgtggaatacagctgagaacaagttcatctgcccatgccatggatctcagtacaacaaccaaggcagggttgtcagaggacctgctcctctgtcattggcgctggcgcatgcagatattgatgacgggaaggtagtgtttattccttgggttgagacagatttcagaacaggtgaagatccatggtgggcctaaactgcaactcaaaattattcattgtcgcctcaaggtaatcggtcaaaacataatcatttataaaaccagaaatcttgtaagttgtaatgaagatccaaactgaaattggcattattactcttttaagcattaacaattctatatagaatcattatatttgtttggcattgagaatgagaaattttgatataagttcttctatattagtattgtaaatctttaaatttagccttgggggaacaccagtggatgatatatttctgcggcagagctttgttctttaactagatgatagttaaattgt

SEQ ID NO: 8921 - DNA, 796 bp, Glycine max; identical to SEQ ID NO: 8917

SEQ ID NO: 8922 - DNA, 913 bp, Medicago truncatula
attacattcacctttcattctcaaaccaaccaaaatcttcctcatcaaccatgtcttccaccactctatcccctgcaaccccttctcagctatgttctggaaagagtggaatttcatgtccttcaataggattacttgtgaagccaacaagaactcagatgattggtaaaggtaagggaatgagcatcacttgccaggctactggcattcctgctgatcgtgtacctgacatgagtaagagagagaccttgaatcttcttcttcttggtgctctttcacttcctactgctggaatgcttgttccttatggatccttccttgttccaccaggctcaggttcttccactggtggtaccgtagcaaaggatgccgttggcaatgatgtggttgcagcagaatggctaaagtcacatggacccggtgaccgtactcttacacaaggattaaagggtgatcctacctatcttgtggtagagagtgacagaacacttgcaacatttgcaattaatgccgtatgcactcacctcgggtgtgtcgtgccatttaatcaagctgagaagaagttcatctgcccctgccatggatctcagtacaatgaccaaggaagagttgtgagaggacctgctcctttgtctcttgcattggcacattgtgatgttggtgtggatgatgggaaggttgtgtttgttccttgggttgaaacagatttcagaacaggtgatgctccatggtggtcttagacttcttaaagctgtctctatattgtaatatatattcaaacctgaaattcaaacatttctgttttgtattaatgcataaacacattttgtaatcaaattaatattatgtcaattgaagatggtataaggtgaaaaggaacatggacattgcttgcttttccccataaattttc

SEQ ID NO: 8923 - DNA, 1499 bp, Glycine max; identical to SEQ ID NO: 8168

SEQ ID NO: 8924 - DNA, 1858 bp, Glycine max; identical to SEQ ID NO: 8191

SEQ ID NO: 8925 - DNA, 2030 bp, Glycine max; identical to SEQ ID NO: 8192

SEQ ID NO: 8926 - DNA, 1254 bp, Cucumis melo subsp. melo; identical to SEQ ID NO: 8193

SEQ ID NO: 8927 - DNA, 1627 bp, Vitis vinifera; identical to SEQ ID NO: 8194

SEQ ID NO: 8928 - DNA, 1757 bp, Arabidopsis thaliana; identical to SEQ ID NO: 8195

SEQ ID NO: 8929 - DNA, 1726 bp, Arabidopsis thaliana; identical to SEQ ID NO: 8196

SEQ ID NO: 8930 - DNA, 1720 bp, Glycine max; identical to SEQ ID NO: 8139

SEQ ID NO: 8931 - DNA, 2030 bp, Glycine max; identical to SEQ ID NO: 8192

SEQ ID NO: 8932 - DNA, 1858 bp, Glycine max; identical to SEQ ID NO: 8191

SEQ ID NO: 8933 - DNA, 1533 bp, Glycine max; identical to SEQ ID NO: 8152

SEQ ID NO: 8934 - DNA, 1533 bp, Glycine max; identical to SEQ ID NO: 8153

SEQ ID NO: 8935 - DNA, 2461 bp, Glycine max; identical to SEQ ID NO: 8526

SEQ ID NO: 8936 - DNA, 2224 bp, Glycine max; identical to SEQ ID NO: 8527

SEQ ID NO: 8937 - DNA, 1907 bp, Medicago truncatula; identical to SEQ ID NO: 8528

SEQ ID NO: 8938 - DNA, 4275 bp, Vitis vinifera; identical to SEQ ID NO: 8529

SEQ ID NO: 8939 - DNA, 4269 bp, Vitis vinifera; identical to SEQ ID NO: 8530

SEQ ID NO: 8940 - DNA, 2321 bp, Vitis vinifera; identical to SEQ ID NO: 8531

SEQ ID NO: 8941 - DNA, 2630 bp, Vitis vinifera; identical to SEQ ID NO: 8532

SEQ ID NO: 8942 - DNA, 4269 bp, Vitis vinifera; identical to SEQ ID NO: 8533

SEQ ID NO: 8943 - DNA, 3715 bp, Vitis vinifera; identical to SEQ ID NO: 8534

SEQ ID NO: 8944 - DNA, 762 bp, Medicago truncatula
atgtcaattttgcctaaactacgctgtgtcactatagatgttaccggcaccctaatggcttacaaaggggagcttggtgactactattgcatggcagccaaagcttccggccgtccatgcccagactacaaacgtatgcatgagggctttaagtatgcatataaggacatggcaaagaagtatccgtgtttcgggtttgcagccaaaatgccgaacattgtgtggtggaaaacctgcgtgcgagattcttttgtcagggctggatatgaatacgacgaggagacatttgaaaagattttcaggcgcatctattcatcctttggttcatctgcgccatatactgtctttccagattccaaaccatttcttagatggcttcgcggaaagggtctcaaagttggcattgttagcaatgctgagtatcgatatcgagatgtgattcttccagctttaggtttaaatcagggatctgagtgggactttggcgtgttttccggccttgaaggtgttgagaagccagacccaaaaatttatgagattgcacttgagagggctggtaatattgcacctgaagaagctttgcatattggcgatagcatgcgcaaagactatgagccagctaagagcatagggatgcatgcactattgttggatagatttaagacaccagaagctgtggaatggaggaagtccggcgcagttgttcttcccgacttaacgacaacacaagaatggctctcttcagagaagtcaacttcctag

SEQ ID NO: 8945 - DNA, 1292 bp, Glycine max
attcttgggttggagaagaaggaagcatcataaccggccaaagcttctctctcttccatttatcccccataaataaaactaggtgaaaaaaatatactctgtgcttctcatgatgatagtgtagctgaagctgcttctgctgcagcattggtgatttggacacaaaaaaagtttcaaacttttcagttctctgagcttctggtttatcaattttgaaggagttcaatactttaccctattagttggttccctgaaatttgtattggtattgctgtatcagaaattcttctgaacaatctctttaatcaaccatgtcattattggctaaactacgctgtgtcaccatagatgttactggtaccctaatggcttacaaaggggagctcggtgactattattgcatggcagccaaagctgcaggcaaaccttgcccagactacaaacgtatgcacgagggttttaagcttgcatataaggaaatggcaaagaattatccatgttttggacatgcagccaaaatgccaaacattgtgtggtggaaaacctgtgtgcgagattcttttgtcagggctggatatgaatacgatgaagagacatttgagaaaatcttcagacgtatatatgcgtcctttggttcatctgctccatatactgtatttccagactcccaaccatttcttagatggcttcgtggagagggtctcaaagttggtattgtgagcaatgccgagtatcgatatcaagatgtgattcttccagctttgggtttaaacgagggatctgagtgggactttggtgtgttttccggccttgaaggcgtcgagaaaccaaacccgaaaatttatgagattgcacttgagagggccggaaatattgcacctgaagaagctttgcacatcggggacagcatgcgcaaagactatgagccagctaagagcatagggatgcatgcactattgttggataggtttaagaccccagatgctgtggaatggaggaaatctggtgcagttgttcttcctgatttattggcagcaaaagaatggctctcttcagataagtcaaattgctagagattagagaatggctctatctttgctcaagtagtatttatgtatcatcttcacccctcaaatgatattactgaggcttgtgacattctaccattacatatgtggctgaatatttctctctagagccatacttgagaatctgatggctaagagttagatgtagctcaaacttaatttggcaatacaaatatattcgaaagtatctctcttttttacatt

SEQ ID NO: 8946 - DNA, 1280 bp, Glycine max
ggaagaaggaaacaacataaccgtccaaagcttctctctcttccatttcccacctataaaactagatggaaaaaatacacactgtgcttctcatgatgatagtgtagctgaagctccttctgcagcagcatttatgatttggacacaaaaaagttccaaacttttcagttctctgagtttctgacttatcaattttgaaggagttcaatactttgccctattagttggttctgtgaaatttgtattggcattgctacatcagaaattcttccgaacaatcccataatcaaccatgtcattattggctaaactacgttgtgtcactatagatgtcactggtaccctaatggcttacaaaggggagctcggtgactattattgcatggcagccaaagctgcaggcaaaccatgcccagactaccaacgtatgcacgagggttttaagcttgcatataaggaaatggcaaagaattatccatgttttgggcatgcagccaaaatgccaaacattgtgtggtggaaaacctgtgtgcgagattcttttgtcagggctggatatgaatatgatgaagagacatttgagaaaatcttcagacgtatatatgcatcctttggttcatctgctccgtatactgtatttccagactcccagccatttcttagatggcttcgtggagagggtctcaaagttggtattgtgagcaatgctgagtatcgatatcaagatgtaattcttccagctttgggtttaaacgagggatctgagtgggattttggcgtgttttccggccttgaaggtgtcgagaaaccaaacccgaaaatttacgagattgcacttgagagggctggaaacattgcacctgaagaagctttgcacattggggacagcatgcgcaaagactatgagccagctaagagcatagggatgcatgcactattgttggataggtttaagaccccagatgctgtggaatggaggaaatctggggcagttgttcttcctgatttattggcagcaaaagaatggctgtcttcagataagtcaaattgctagagatcagataatggctctatctttgctcaaatgtatttaagtatcatcttcacccctcaaatagtattaccgtggcttgtgatattctaccattacatatgtggctgaatatttctctctagagccatacttgagaatcagatggctaagagttagatgtagctcaaatccaactttgcaatacaaatatattcgaaagttactctcaaaaaaaaaaaaaaaaaaa

SEQ ID NO: 8947 - DNA, 1279 bp, Glycine max
ggggagaagaaggaagcatcataaccggccaaagcttctctctcttccatttatcccccataaataaaactaggtgaaaaaaatatactctgtgcttctcatgatgatagtgtagctgaagctgcttctgctgcagcattggtgatttggacacaaaaaaagtttcaaacttttcagttctctgagcttctggtttatcaattttgaaggagttcaatactttaccctattagttggttccctgaaatttgtattggtattgctgtatctgaaattcttctgaacaatctctttaatcaaccatgtcattattggctaaactacgctgtgtcaccatagatgttactggtaccctaatggcttacaaaggggagctcggtgactattattgcatggcagccaaagctgcaggcaaaccttgcccagactacaaacgtatgcacgagggttttaagcttgcatataaggaaatggcaaagaattatccatgttttggacatgcagccaaaatgccaaacattgtgtggtggaaaacctgtgtgcgagattcttttgtcagggctggatatgaatacgatgaagagacatttgagaaaatcttcagacgtatatatgcgtcctttggttcatctgctccatatactgtatttccagactcccaaccatttcttagatggcttcgtggagagggtctcaaagttggtattgtgagcaatgccgagtatcgatatcaagatgtgattcttccagctttgggtttaaacgagggatctgagcgggactttggtgtgttttccggccttgaaggcgtcgagaaaccaaacctgaaaatttatgagattgcacttgagagggccggaaatattgcacctgaagaagctttgcacatcggggacagcatgcgcaaagactatgagccagctaagagcatagggatgcatgcactattgttggataggtttaagaccccagatgctgtggaatggaggaaatctggtgcagttgttcttcctgatttattggcagcaaaagaatggctctcttcagataagtcaaattgctagagattagagaatggctctatctttgctcaagtagtatttatgtatcatcttcacccctcaaatgatattactgaggcttgtgacattctaccattacatatgtggctgaatatttctctctagagccatacttgagaatctgatggctaagagttagatgtagctcaaacttaatttggcaatacaaatatattccaaaaaaaaaaaaaaaaaaa

SEQ ID NO: 8948 - DNA, 1207 bp, Vitis vinifera
ttttttttttttttatctcttcttgtgtgcttatttctgcaaaacctgcatttctgcctccctgtacctactgcttttcccctctctgatgctgggactgttggatctgttgaagaagctcgtttttccataggttccctcagcaccttgatgatcctacccagtttgctggagtttccctgatatttttgagtttgttcagttcccagaacttgcaccactgctataatgtcaatgttatcaaaattacgctgtatcaccttcgatgtcacgggtacactcatagcttacaaaggtgagcttggtgattactattgcatggcagccaaatctattggattgccatgtcctgactacaaaagggtccacgagggcttcaaacttgcatacacagagatggcaaagaagtatccatgttttggatatgcagcaaaaatgcctaacattgtgtggtggaaaacttgtgttagagactctttcgtcagggcaggatatgattacgatgaggagacatttgagaaggtgttcagacgtatatactcaacatttggttcatctgcaccatataccatcttccccgactcccaaccatttctcagatgggtacatgaaaagggtcttaaagttgggatcattagcaatgcagagtatcggtataaagatgtcatccttcctgccttgggtttgaaccagggaaccgaatgggattttggcgtgttctctggtcttgaaggtgtagagaaaccaaaccccaggatttatgagattgcccttgaaagggctggaaacattgcaccagaagaagtgttgcacattggtgacagcatgcgcaaagactatttgccggcgaagggtgtggggatgcatgcacttctgttggacagatttaagacccccgacgccattgagtggtccaaatctggcgcaactgtgcttcctgatttggtgtcggtgcaggaatggctcacttcacagaactaaacctgcctgctaatgacttcccatcctttccaagaactcacccatcctctgtattttttcccccttggacatgatcatatcatggctattacttaccagtgggtttgcccttcttaagatttgtgggttttgatgggagaaacagatactattaccataatagccaaatgttatgagcttgatcttaaagaaagttacagatgttcttcattctgttttcttttgc

SEQ ID NO: 8949 - DNA, 1337 bp, Oryza sativa Japonica Group
ccctcgccattttgacgcttctatctcgcccaccggccaccgctgccgtctccatccatcccgcgaggcgccgccgccgactccgcctccgcctccgcctccggcgatccccatccatcacgcgaggcgccgcctccgcctccggcgacccccatccatcacgcgaccgccgcttcgtcggcatcctcccaccgcatccatcctgaagaagatcatcgtcaaaacatgtcgctcatttcgaagctgcggttgatcactgtggatgtcaccggtactctgcttgcctacaaagggcagcttggtgattactactgtatggcagctaaggctgctgggaagccatgtcctgactaccagcgaatgcatgagggcttcaagcttgcatacaccgagatggcaaggcaatacccatgctttggatttgcagcgaagatgccgaatatcgactggtggaggatgtgcgtcaaggattcttttgttaaggctggttatgagtatgacgaggagacatttgagaagattttcaaacggatttactcttcttttggctcgtctgctccgtactcggtattccctgatgcgcagcccttcatgaggtggcttcgcgggaaggggctcacggttggaattgtcagcaacgcagaataccgttacaaagacgtcatcttgcctgctctaggactgaaccagggctccgagtgggactttggggtgttctctggaatagttggtgtggagaagccagatccaagtatctacaggattgcactggaaatggcgggcaaggtcgcgccagaagaggcgcttcacataggcgacagcatgcgcaaggactacacccctgcacggagcatcggaatgcacgcgctgcttctggaccgattcaagaccgccgatgctgagagctggaggaagtctggagcaactgtgctccctgacctggtagctgctcaggagtggctcagcaagaatctcaaggatgagccagtagcagctgaacaaaatgtctgaccttagaaaattcagttcccctgtcactgagctgaattccctcttgtttcctagttatgaaacgagggaggcaaaagaaatgtgccattgatgtatttgtattgtactgatggaataggttatgtgatggttcttggctgctggattatgtaagctgtttggtgttgaactgttgatgctgattgctgaatatgtcaagcaaatcagtgtggcagagcattgttgtagtctcccatgaactgtgtttcagcgaagaaaactagttttgtttggcatcttcgcctgtctgaagcaataaaagcagggcaatttcagttctgtttgtc

SEQ ID NO: 8950 - DNA, 759 bp, Silene latifolia
atggccatgtctcttctcccaaagttgcgttgtataacagttgatgttactggtactctattagcttacaagggggaactaggagattattattgcatggctgctaaagctgcaggattaccttgccccgactacaaacgtgtacatgaaggcttcaaacttgcatatactgatatggccaagaagtatccttgtttcggtcatgcagcaaagatgcctaatatcgtttggtggaagacatgtgttacggactcctttaaaaaggctggatatgagtatgatgaggagacatttgagaaaattttcaggcgcatttattcatcttttggctcttctgcaccttatgttttattccctgattcaattcctttcctaagatggcttcgcgtgaatggtatcccagttgggcttgttagcaatgcagagtaccgttatcgagatgtgatacttccagccttaggtttgcatcagggttctgaatgggattttggagtgttctctggtctggaaggcgtggaaaagccagatcccaggatttacgagattgctttggagagggccggaaatgttgcaccggaggagactttacacattggagatagtttccgtaaggattatcttccagcgaagagtttgggaatgcatgcaatactacttgatagatttaaaattcccgatgctgagaactggagaaaggacggcattcctgtttatcctgatttggcatctgtacaagagtttctagattcggataacttg

SEQ ID NO: 8951 - DNA, 759 bp, Silene latifolia
atggccatgtctcttctcccaaagttgcgttgtataacagttgatgttactggtactctattagcttacaagggggaactaggagattattattgcatggctgctaaagctgcaggattaccttgccccgactacaaacatgtacacgaaggcttcaagcttgcatatactgatatggccaagaagtatccttgtttcggtcatgcagcaaagatgcctaatatcgtttggtggaagacatgtgttacggactcctttaaaaaggctggatatgagtatgatgaggagacatttgagaaaattttcaggcgcatttattcatcttttggctcttctgcaccttatgttttattccctgattcaattcctttcctaagatggcttcgcgtgaatggtatcccagttgggcttgttagcaatgcagagtaccgttatcgagatgtgatacttccagccttaggcttgcatcagggttctgaatgggattttggagtgttctctggtctggaaggcgtggaaaagccagatcccaggatttacgagattgctttggagagggccggaaatgttgcaccggaggagactttacacattggagatagtttccgtaaggattatcttccagcgaagagtttgggaatgcatgcaatactacttgatagatttaaaaatcccgatgctgagaactggagaaaggacggcattcctgtttatcctgatttggcatctgtacaagagtttctagattcggataacttg

SEQ ID NO: 8952 - DNA, 2009 bp, Glycine max; identical to SEQ ID NO: 8144

SEQ ID NO: 8953 - DNA, 1662 bp, Glycine max; identical to SEQ ID NO: 8145

SEQ ID NO: 8954 - DNA, 1479 bp, Glycine max; identical to SEQ ID NO: 8141

SEQ ID NO: 8955 - DNA, 2421 bp, Glycine max; identical to SEQ ID NO: 8149

SEQ ID NO: 8956 - DNA, 2478 bp, Medicago truncatula; identical to SEQ ID NO: 8150

SEQ ID NO: 8957 - DNA, 2544 bp, Medicago truncatula; identical to SEQ ID NO: 8151

SEQ ID NO: 8958 - DNA, 1533 bp, Glycine max; identical to SEQ ID NO: 8153

SEQ ID NO: 8959 - DNA, 1533 bp, Glycine max; identical to SEQ ID NO: 8152

SEQ ID NO: 8960 - DNA, 1662 bp, Glycine max; identical to SEQ ID NO: 8145

SEQ ID NO: 8961 - DNA, 2009 bp, Glycine max; identical to SEQ ID NO: 8144

SEQ ID NO: 8962 - DNA, 3371 bp, Glycine max
atgggtcttagcttgaagatgcagaaccaccatcctgtggctttgaggttgcatgatcaaatggggtctaagagaaagtacactttcattcaagctcatagagcttggcttccaaagtttctgctgctgtggatcctgctaatggctttgatcagttggtgcatctatagcaaaatggatgatgacactaaagtcagaaggaaagaggttttgggtagcctctgtgatcaaagggcaagaatgttgcaagaccagtttagtgttagtgttaaccatgtccatgcccttgccatccttgtttcaaccttccattactacagttacccttctgccattgaccaggaaacctttgctgagtatacagccaggacggcctttgaaaggccattgctgagtggtgtggcctatgcacaaagagttgttaactctgagagggagagatttgagaaagaacatggatgggtcataaagacaatggaaagaaagtcttcactggttagagatgagtatgcgccggtgatcttcgcgcaacaaactgtctcatatcttgagtctattgatatgatgtctggggaggaggatcgagaaaacattttaagggctagagccactgggaaagcggttctgactagccctttcaggctgttgggttctcaccatcttggtgtggttttaacattccccgtgtacaaatctaagctcccccagaagccaacagtggaagaacgcattgaagcaactgcaggatatgttggaggatcctttgatgttgagtcccttgtaaagaatttacttgggcaacttgatggtaaccaagcaattttggtgaatgtatatgatgttacaaactatactaatcccctaatcatgtatggcaaccaatatcaagaaggcgatatgtctcttgcccatgaaagcaagcttgattttggagatccatacaggaaacatcagatgatatgtaggtaccatcagaaggcaccgacaaattggatagctcttaccacggcattcctattctttgtgatactttttttagtgggttacattttatacagtgctggaaatcatattgttaaagtcgaagatgatttccatgaaatgcaggaattgaaagtccgagcagaagcagctgatgttgccaagtcccagtttctagctacggtctctcatgaaattagaacacccatgaatggtattttaggaatgcttgctctgcttctggataccgaattgagttcaacccaacgagattatgctcagactgctcaagcatgcggcaaggcactgataacattaataaatgaggtgctggaccgtgctaaaattgaagctggcaagttagagctggaggctgttccatttgatcttcggtccataattgatgatgtcctttctcttttttctgagaaatctagacacaaaggtttagagctggctgtgtttgtttctgacaaagttccagatattgtcatgggagatcctgggagattcagacaaataataacaaatcttgttggcaactctgttaaatttactgaacaagggcatatatttgttaaagtccatctagcggacaaccgaaagtccatgatgaatggaaaacacgagacttttctaaatggagaatcagatgaagttttctatatatctggtgattatcatttcaaaaccttaagtggatgtgaagcagctgatgaacggaacagttgggataattttaagcatctaatagctgacaaagaatatggccttgattcttctagagaaacaatggctgcttgtgaatcttccgagcaagtcacattgagggtatgcgtggaggacactggaattggaattcctttctcagctcaggataggatattcatgccatttgtgcaggctgacagctcgacctcacgaaattatgggggtactggaattggcttgagtatcagtaaatgtctggttgagctaatgggtggtcagataaacttcataagtcgaccccaggttgggagcaccttttcttttactgcagtttgtggagcatttaagaaaagttcagttactgacaagaaggaaaatttggaagatctgccttcaaattttagagggatgaaagtcattgtggttgatgggaagcctgttagagcttccgtgactagataccatttgaagagactagggatactagttaaagttgcaaatagcatcagtaaggctgttgctttatgtggtaaaactggttctttgacatcaggaatgttccagcccgatattatcatggttgagaaggacacatggatatctggagaggatggcattttcaatatatggaaacagaatggtcgtatgtttaagatgcctaaaatgatccttctggcaaccaatattattagtgccgaatttgataaagctaaggccacaggttttactgatactgtgatcatgaagcctctgagagctagtatggtggctgcttgtcttcagcaagttttggggatggggaagaggaggcagctagggaaagacatgcctaatggttttctacatagccttctctatggaaagaaaattttggtggtcgatgacaatggggtaaaccggagagttgcagcaggtgcactaaaaaagtttggtgctgatgtgaagtgtgctgaaagtggcaaagccgcacttgaaatgcttcaattgcctcacaattttgatgcttgcttcatggacattcaaatgccagaaatggacggatttgaagcaaccagccgaattcggatgatggagagcaaggcaaatgaggagatgaataatgggaatgagtggcatgtgcctatactggccatgacagctgatgtgatccatgctacatacgacaagtgcatgaaatgtggcatggatggatatgtctcaaagccatttgaggaagagaatctgtatcaggaagttgcaaagtttttcaaatcaaaaaccatgtcagattcatgacaaatgtgcttccttacttggcaaccaactagatgattggatttggagacaacacattttagtttgatcactgctagcactttcatgtcacatgtaacttgttacttttgctttcttgcatagagtaacacttgtttttgcaacatatttgagttgagttcgttgagggatcattactattactaatcggctgcagtttggcattattagagtaaaatgtataccacgccacaccccccaattgtgtacagattctgggtaagggatgagtgaaattatgtaaattcaatgtttttccccatctcgttacttccccatcagagaaggtttttaatttttatagcaatagctttttatgtaaagggatcttgtattgtaatagatttggtcactatgttaaaaaa

SEQ ID NO: 8963 - DNA, 3391 bp, Glycine max
atgggtcttagtttgaagatgcagagccaccatcctgtggctttgaggttacatgatcaaatggggtctaagagaaagtacacattcattcaggctcatagagcttggcttccaaagtttctgctgctgtggatcctgctaatggctttgatcagttggtgcatctatagcaaaatggatgatgacactaaagtccgaaggaaagaggttttgggtagcctctgtgatcaaagggcaagaatgttgcaagaccagtttagtgttagtgttaaccatgtccatgcccttgccatccttgtttcaaccttccattactacagatacccttctgccattgaccaggaaacctttgctgagtacactgcccggacagcatttgaacggccgttactgagtggtgtggcctatgcgcaaagagttgttaactctgagagggagagatttgagaaagaacatggatgggttataaaaacaatggaaagaaagtcttcactggttagagatgagtatgcaccggtgatattcgcgcaagaaactgtctcatatcttgagtctcttgatatgatgtctggggaggaggaccgagaaaacattttaagggctagagccactgggaaggcggttctgactagtcctttcagtcttttgggttctcaccatctcggtgtggttttaacattccctgtgtacaaatctaagctccctcagaagccaacagtggaagaacgcattgaagcaactgcaggatatgttggaggatcctttgatgttgagtcccttgtaaagaatttacttgggcaacttgatggtaaccaagcaattttggtgaatgtatatgatattacaaactatactaatcccctagtcatgtatgggaacctatatgaagaaggcgatatgtctcttgtgcatgaaagcaagcttgattttggagatccatacaggaaacatcagatgatatgtaggtaccatcagaaggcaccgacaaactggatagctcttaccacggcattcctattctttgtgattctttttttagtgggttacattttatatggtgctggaaaccatattgtcaaagttgaagatgatttccatgcaatggaggaattgaaagtccgagcagaagcagctgatattgccaagtcccagtttctagctacggtctctcatgaaattagaacacccatgaatggtattttaggaatgcttgctctgcttctagatacagaattgagttcaacccaacgagattatgctcagactgctcaagcatgtggaaaggcactcataacattaataaatgaggtgcttgaccgtgctaaaattgaagctggcaagctagagctggaggctgttccatttgatcttcgttccataattgatgatgttctttctcttttttctgagaaatctagacacaaaggtttagagctggctgtgtttgtttctgacaaagttccggatattgtcatgggagatcctgggagattcagacaaataataacaaatcttgttggcaactctgttaaatttactgaacaagggcatatatttgttaaagttcatctagcagacaatcgaaagtccataatgaatggaaaacacgatacttttctaaatggagaatcagatgaagttttccatatatctggtgattatcatttcaaaaccttaagtggatgtgaagctgccgatgaacggaatagttgggataattttaagcatctaatcgctgacgaagaatatggccttgattcttctagagaaacaatggctgcttgtgaatcttctgagcaagtcaccttgagggtgtgcgtggaggacactggaattggaattcctttctcagctcaggatgggatattcatgccatttgtgcaggctgacagctcaacctcacgaaattatgggggtactggtattggcttgagtatcagtaaatgtctggttgagctaatgggtggtcagataaacttcataagtcgaccccaggttgggagcaccttttcttttactgcagtttgtgaagcatttaagaaaagttcagttaccaacaagaagaaaaatttggaagatctgccttcaagttttagagggatgaaagtcattgtggttgatgggaagcctgttagagctgctgtgactagataccatttgaagagactagggatactagttaaagttgcaaataggatcagtaaggctgttgctttatgtggtaagagtggttctttgaaatcgggaatgttccagcctgatattatcatggttgagaaggacacatggataactggagaggatggcattttcaatacatggaaacataatggtcgtacgattaagatgcctaaaatgatccttctggcaaccaatattagtaatgccgaatttgataaagctaagttcacgggtttcactgatactgtgatcatgaagcctctgagagctagtatggtggctgcttgtcttcagcaagttttgggtatggggaagaagaggcagctagggaaagacatgcctaatggttttctacatagccttctctatggaaagaaaattttggtggttgatgacaatggggtaaaccggagggttgcagcaggtgcactaaagaagtttggagctgatgtgaagtgtgctgaaagtggcaaagtcgcccttgaaatgctgcaattgcctcacaattttgatgcttgcttcatggacatccaaatgccagaaatggacggatttgaagcaactagtagaattcggatgatggagagcaaggcaaatgaggagatgaatggcagtgagtggcatgtacctatactggccatgacagctgatgtgatccttgctacgtacgacaagtgcgtgaaatgtggcatggatggatacgtctcaaagccatttgaggaagagaatctgtatcaggaagttgcaaagtttttcaaatccaagaccatctcagactcatgacaatgtgctttgaacttggcaaccaactagaagattgattggagacaacacattttagtttttttattttatcattactagcactttcacatgtcacttgtaactagttacttatgcatgctctcatgcctagagtaatgcttgttttcctaacatctttgagttgagttcgttgagggatccttacaattaccaaccggctgcgtttggcattattagagtaaatggtataccacgctacaccccccaattgtgtacagattttgggtaagggatgagtgaaattatgtaaattcaatgtttttccccatctcgttacttccccatcagaaggtttttatagcaatagctttttgtgtaaaggcatcttgtattgtaatagatttggtcattatgttaaaaaatgcatgcttatgtgtagtgtagc

SEQ ID NO: 8964 - DNA, 2991 bp, Lotus japonicus
atgggtcttagcttgaagatgcagagtcaccatgatcaaatggggtctaaaagaaagtacactttcattcaggaccatagagcatggctaccgtggtttttgtttatgtgggtcctgctaatggcttttatcagttggaatatctatagtaaaatggatgatgacactaaagttagaaggaaagaggtgttgggtagcctctgtgatcaaagggcaagaatgttgcaagatcagtttagtgttagtgtgaaccatgtccatgctcttgccatccttgtttcaactttccattattacagaaacccttccgccattgatgaggaaacctttgctgagtatacagcaagaacagcatttgaacggccattactgagtggtgtggcttacgcacaaagagtaattaactcagagagagagagatttgagaagcaacacggatgggttataaagacaatggaaagggagtcttcacaggttagagatgagtatgcaccagtgatatttgctcaagaaactgtctcataccttgagtctcttgatatgatgtctggggaggaggaccaagagaacattttaagggctagggccactgggaaagcagttctaacaagtcctttcaggctgttgggttctcatcatcttggcgttgttttaacatttcctgtgtacaaatctaagctccctccaaagccaacactagaagaacgcattgaagcaactgcaggatatgttggaggatcctttgatgttgagtcccttgtggagaatttacttgggcaacttgctggtaaccaagcaattttggtgaatgtgtatgatatcacaaattgtagtaatcccctaaccatgtatggaaatcactccgaagaagctgatatgtctctttcctatgaaagcaaactcgatttcggagatccatacaggatacatcagatgatatgtaggtatcatcagaaggaaccaacaaattgggtcgcccttaccacggcagtcctattctttgtgattcttatattagtgggttacattttatatgaagctggaaatcatattgtcaaagttgaagatgattttcatgaaatgcaggatttaaaagtccgagcagaagcagctgatgttgccaagtcccagtttctagctacagtctctcatgaaattagaacaccaatgaatggcattttaggaatgatggctctacttctagatacagaattgagttcaacccaacgagattatgctcagactgctcaagcatgtggaaaggcactgataacattgataaatgaggttcttgaccgggctaaaattgaagctggcaagttagagctagaggctgttccatttgacctccgttccatacttgacgacgtcctttctcttttctctgagaagtctagacacaaaagtctagagttggctgtgtttgtttctgataaagtcccagatattcttatgggagatcctggaagattcagacaaataataacaaatcttgttggcaactctgttaagtttactgagcaaggacatatatttgttaaagttcatctagaggataacataaatcccgtaatgaatggaaaacatgaaactattctgaatggagagtcagatgaggttttccatttatctggtgattgccatttcaaaaccttaagcggatgtgaagcagttgatgaacagaacagctgggagaattttaagcatctgattgcaaatgaagaacgttacttcgattgttcaagtaaaatggcagccactagtgaatcatcggagcaagtcaaattgagagtctgtgtggaggacactggaactggaattcctttctcagcccaggatacaatattcatgccttttgtgcaggctgacagctcaacttctcgaaattacggcggtactggcattggcttgagtatcagtaaatgtctggttgaactaatgggtggtcagataaacttcacaagccggccccaggtcgggagcacattttcatttactgctgctttcggaatgtttaagaaaaattcagttagtgacatgaagaaactaaatttggaagatcttccttccagttttagaggcctgaaagtcatagtggtcgatggaaaaccagttagagctgctgtgactagataccttttaaagagactagggatactcgttaaagttgcaaatagcatcagtcaggctgtggctttatgtgggaaaaatggttctttaacatcaggaatgttccaacctgatattatcatggttgagaaggacacatggatatctggagagcatggaggtttcaacatatggaagctggacttcaaacagaatggacatgtatttaagatgcctaaaatgatccttctggcaaccaatattaagaataccgagttcgaccaagctaaggccacaggttttactgatactgtgatcatgaagcctctgagatctagtatggtggctgcgtgtcttcagcaagttctggggatagggaagaagaggcagctaggacaggacatgctgaatggttcttcttttctacaaagccttctctacggaaagaaaatcttggtggtcgatgacaatgtcgtgaaccggagagttgctgcaggtgcattaaaaaagtttggagctgatgtgaagtgtgttgaaagtggcaaagctgcacttgaaatgcttcaattgcctcactgttttgatgcttgcttcatggacattcaaatgccagaaatggacggatttgaagcaactagtaaaattcgtatgatggagagaaaggcgaatgagcaggtgaacggtgaattaggcgaaggaaatacccgaaaaagcgagtggcatgtcccaatactggccatgacagctgatgtaatccatgctacatatgataagtgcttgaaatgtggtatggatggatatgtttcaaagccatttgaggaacagaaactctatcaggaagttgcaaaatttttcaaatccaaaaccatctctgactcatga

SEQ ID NO: 8965 - DNA, 3402 bp, Glycine max
atgggtcttggtttgaagatgaagagcctgaggcaccaccccatggccttgaagttacatgagcaagcggggagcataagaaagtacactttcattcaggcacatagggcatggctgcccaagtttttgatgctgtggatccttctcatggctctaattggctgtttcatctatagtaaaatggatgctgacactaaggttagaaggaaagaggtgctgggtagcctctgtgatcaaagggcaagaatgctgcaagatcaattcagtgtcagtgtcaaccatgtccatgcccttgccatccttgtttcaaccttccattactacagaaccccttctgccattgaccaggaaacctttgcagagtatacagcccggacagcatttgaacgaccattactcagtggggtggcctatgcacaaagagtagttaactcagagaggggaacatttgagaagcaacatggatgggttataaagacaatggaaagagagccttcactggttagagatgagtatgcaccggtgatatttgcgcaagaaacactctcttacctcgaatctcttgatatgatgtccggggaggaggaccgagagaatattttgagggctagggccactgggaaagctgttctcactagtcctttcaatctgttgggttctcatcatcttggtgtggttttaacatttcctgtttataaatctaagctccctccaaagccgacaatggaagagcgcattaaagcaactgcaggatatgttggaggatcctttgatgttgagtccctcgtggagaatttacttggtcaacttgctggtcaccaagcaattttggtgaacgtatatgatatcacaaattctactaaccccttaatcatgtatggcaaccaaaacgaagaaggtgatatgtctcttgtccatgaaagtaagcttgattttggagatccatacaggaaccatacaatgatatgtaggtatcaccagaaggcaccaacaaattggatagcacttaccacggcattcttattctttgtgattcttttattagtgggttatattttatatggtgctggaaatcacattgtcaaagtagaggatgattttcatcaaatggaggaattaaaagtccgagcagaagcagctgatgttgccaagtcacagtttctagctactgtctctcatgaaatcagaacacccatgaatggcattctaggaatgcttggtctgcttctaaagacagaattgagttcaactcaacgagattatgcccagactgctcaagcatgtgggaaggctctgatagccttaataaatgaggtacttgaccgggctaaaattgaagctggcaagttagagctggaagcagttccatttgacattcgttccatacttgatgatgtcctttctcttttttctgagaagtccaggaacaaaggtttagagctggcggtgtttgtttctgataaagttccagatattgttatgggagatcctgggagattcagacaaatagtaacaaatcttgttggcaactctgttaaattcactgagcgaggacatatatttgtgaaagtccatctatctgaaaatagtatgtccacaatgaatggaaaaactgagaaatttataaacagaggatcaggcgaacctgtgcatatgtctggtgcttataattccaaaactttaagtggatatgaagcagctgatgagcggaacagctgggacaattttaagcatctaattgctgatgaagaatttttctttgatgcttctgttaaaaaggcagccagtgaatcttatgagcaagtcaccttgatggtcagtgtggaggacactggaattggaattcctttctcagcccaagataggattttcatgccttttgtgcaggcagacagctcaacctctcgacattatggtggtactggcattggcttgagtatcagtaaatgcctggttgaactaatgggtggtgagataagtttcataagccaactgcaggttggcagcacattttcatttactgcaggttttggaacgattgagaaaaatgcaataactgacatgaagaaacataatttggaagatctgccttccaattttagagggcttaaagccatagtggttgatggaaaacctgttagagcagcagtgactagataccatctgaagagactagggatacaagctaaagttgcaaatagcatcaataaggctgtttctttatgtgggaaaaatggttctttgacctcggtattatttcagcccgatattatttttgttgagaaagattcatgggtttgtggagaggacgagatcttcaatgtgtggcaactggactggaaacaaaatgggcatatgtttaagatacctcaaatgatccttcttgcgaccaacatcggtaatgctgaatttgataaagctaaagctgcaggtttcagtgatactgtgatcatgaagcctctaagagctagcatggtggctgcttgtcttcagcaagttcttggaacagggaagaagaggcagcatgggaaagacatgaagcctaatggttccactttggtacgaagccttctttgtgggaaaaaaatcttagtggttgatgacaatgtggtaaaccggagggtcgctgcaggtgcattaaaaaattttggagctgatgtgacgtgtgcagaaagtggcaaaactgctcttgaaatgctgcagttgcctcacaattttgatgcttgcttcatggatattcaaatgccagaaatggacgggtttcaagcaactcagcgaattcggatgatggagacaaaggcaaatgagcagcagatgaatggtgaaggaaatgggtggaaagacaagtaccatatacctatattggccatgacagctgatgtaattcacgccacatatgatgagtgcgtgaaatatgggatggatggatacgtctcaaagccttttgaggaagaaaatctgtatcaagcagttgcaaagtttttcaaccccaagcctaccacagacaacagcctaatagaaaatggcagaacttgaaaagcaacttaatgtttaatgaaagacacttactttcactactggcattttttcgtagtttgctggtaatttgaatgtgctttaatcagttggtttttgaagatatctgaggatatgcatacaacaggcatatgcagtgatcatttctaaccaccagctgaacatgatttcaatctgagtaaatgtataccactaccctcaacttgtgtacagattctccccacgggatgaggaaaatcatgtaaattcaatatatttttttttcctttcttttgcatctcccgatacttccctatgattagggtttcactattattattttttttttctctgtaaaattttctcgtataggattttggtagtcac

SEQ ID NO: 8966 - DNA, 3453 bp, Glycine max
atgggtcttggtttgaagatgaagagcctgaggcaccatcccatggccttgaagatacatgagcaagcggggagcaaaagaaagtacactttcattcaggcacatagggcctggcttcccaagtttttgatgctgtggatccttctcatggctctaattggctgtttcatctttagtaaaatggatgctgacactaaagtcagaaggaaagaggtgctgggtagcctctgcgatcaaagggctagaatgctgcaagatcaatttagtgttagtgtcaaccatgtccatgcccttgccatccttgtttcaaccttccattactacagaaccccttctgccattgaccaggaaacctttgcagagtatacagccaggacagcatttgaacggccattactcagtggggtagcctatgcacaaagagtagttaactcagagagggaaacatttgagaagcaacatggttgggttataaagacaatggaaagagagccttcactggttagagatgagtatgcaccggtgatatttgtgcaagaaactctctcttacctcgaatctattgatatgatgtccggggaggaggaccgagaaaatattttgagggctagggccactgggaaagctgttctcactagtccttttaggctgttggggtctcatcatcttggtgtggttttaacatttcctgtttataaatctaagctccctccaaagccaacaatggaagagcgaattaaagcaactgcaggatatgttggaggatcctttgacgttgagtccctcgtggagaatttacttggtcaacttgctggtcaccaagcaattttggtgaacgtatatgatatcacaaactctactgaccacttaatcatgtatggcaaccaaaacgaagaaggtgatatgtctcttgtccatgaaagtaagcttgattttggagattcatacaggaaacatacaatgatatgtaggtatcaccagaaggcaccaacaaattggatagcacttaccacagcattcttattctttgtaattcttttattagtgggttatattttatatggtgctggaaatcacattgtcaaagtagaggatgattttcatcaaatggaggaattaaaagtgcgagcagaagcagctcatgttgccaagtcacagtttctagctactgtctctcatgaaattagaacacccatgaatggcattttaggaatgcttggtctgcttctaaagacagaattgagttcaactcaacgtgattatgcccagactgctcaagcatgtgggaaggctctgatagcattaataaatgaggtacttgaccgggctaaaattgaagctggcaagttagagctggaagctgttccatttgacattcgttccatacttgatgatgtcctttctcttttttctgaaaagtctcggaacaaaggtttagagctggcggtgtttgtttctgataaagttccagatattgttatgggagatcctgggagattcagacaaatagtaacaaatcttgttggcaactctgttaaattcactgagcgaggacatgtatttgtgaaagtccatctatctgaaaatagaatgtccacgatgaatggaaaaattgagaaatttctaaacggaggattggacgaacctgtgcatatgtctggtggttataattccaaaactttaagtggatatgaagcagctgatgagcggaacagctgggacaattttaagcatctaattgccgatgaagaatttttctatgatgcttctgttaaaagggtggcaagcgaatcttatgagcaagtcaccttgatggtcagtgtggaggacactggaattggaattcctttctcagcccaagataggattttcatgcctttcgtgcaggcagacagctcaacctctcgacattatggtggtactggcattggcttgagtatcagtaagtgcctggtcgaactaatgggtggtgagataagtttcataagccaaccgcaggttgggagcacattttcatttactgcagattttggaacaattaagaaaaatgcaataactgacatgaagaaacataatttggaagatctgccttccaattttagagggcttaaagccatagtggttgatggaaaacctgttagagcagcagtgactagataccatctgaagagactagggatacaggctaaagttgcaaatagcttcaataaggctgtttctttatgtgggaaaaatggttgtttgacctcgggattatttcagcccgatattatttttgtcgagaaagattcatgggtttgtgtagaggatgggatcttcaatgtgtggcaactggactggaaacagaatcggcatatatttaagatacctcagatgatacttcttgcgaccaacatcggtaatgatgaatttgataaagctaaagctgcaggtttcagcgatactgtgatcatgaagcccctaagagctagcatggtggctgcttgtcttcagcaagttctgggaacggggaagaagaggcaacacgggaaagacatgaatcctaatggttccacttttgtaagaagccttctttgcgggaaaaaaatcttagtggttgatgacaatgtggtaaaccggagggtagctgcaggtgcattaaaaaattttggagctgatgtgacgtgtgcagaaagtggcaaaactgctcttgaaatgctgcagttgcctcacaattttgatgcttgcttcatggatattcaaatgccagaaatggacgggtttgaagcaactaggcaaattcggatgatggagacaaaggcaaatgagcagcagatgaatggtgaatgtggtgaaggaaatggatggaaagacaagaagtaccatatacctatattggccatgacagctgatgtgattcacgcaacatacgatgagtgcgtgaaatgtgggatggacggatatgtctcaaagccttttgaggaagagaatctgtatcaagcagttgcaaagtttttcaaccccaagcctacctcaatacaacaaaatgccagaactggaaaagcaacttaatgttaattgcaaagtttttcactctctcactactgccatttttcctagttggctgctaaatggtaatttcaatgtgcttttttcaatcagttggttttcaagatatctgaggatatgcatgcaatgcaacttgatacacacaccacgcatatgcagtgatcatttctaaccaccagctgaacatcatgagtaaaaaaaatatgtataccactaccccaacttgtgtacagtacagattctcccacgggatgaggaaaatcatgtatattcaatattttttttttatcttttgcatctctcgatacttccctactgtgataagggtttcactatagtttctctattattattatttttttctgtaaaattttctggtatattaagatttggttagttactata

SEQ ID NO: 8967 - DNA, 3090 bp, Medicago truncatula
atgggtcttctcttgaagatgaagatgcagaatcagcaccaccctttggcttctaagttacaagaacaaacggggaacaaaagatacacattcattcaagcacatagagcttggcttctcaaattaatgtttctatggattcttctgatggctctgattagtcgtatcatctacagcaaaatggatgtgggtactaaagtgagaaggaaagaggttttgggtagtctttgtgatcaaagggctagaatgttgcaagaccaattcagtgttagtgtcaaccatgttcatgctcttgccatccttgtttcaactttccattattacagaaacccttctgccattgaccaggaaacttttgcagaatatacggctaggaccgctttcgaaaggccgctacttagtggagtggcctatgcacaaagagttgttaactcggaaagagagcagtttgagaagcagcatggagtggttataaagacaatggaaagagaggcttcaccggttagggatgagtatgcaccggtcatatttgctcaggaaactgtctcttaccttgagtctattgatatgatgtctggagaggaggatcgagagaacataatgagagctagagctactgggaaagctgttctgactagcccttttaggttgttgggttctcatcatctcggtgtggttttaacatttcctgtttacaaatctaagctccctcccaacccaacaacagaagagctcattaaagcgaccgcaggtgttatcgacacaacttctatcattgagttgaagaaaactgtttctgttacaaggcttgtatttggttatattttgttatatgttggaggatcctttgatgtggagtcacttgtggaaaatttacttggtcaacttgctggtcatcaagcaattttggtcaatgtatatgatgtcacgaactcttctgatcccctaatcatgtatggcaaccaatacgaagaaggtgatgtttctcttgtccatgaaagtaagcttgattttggagatccatacaggaaacatcaaatgatatgtaggtatcaccagaaggcaccgccaaattggacagcactttctactgcaatcctattctttgtgattcttcttttaatcggttacattttatatggtgctgggaatcatattgtcaaagtagaggatgatttccacgaaatgcaggagctaaaagttcgagcagaggcagccgatgttgccaagtcacagtttctagctactgtctctcatgaaattagaacacctatgaatggcattttaggaatgcttggtctgcttctacgcacggaattgaactcaactcaacgggactatgctcagactgctcaagcatgtgggaaggctctgatagcattaataaatgaagtgcttgaccgagcaaaaattgaagctggcaaattagagctggaagcggttccatttgaccttcgttccatactcgatgatgtcctctctcttttttcagagaagtctagacacaaaggtttagagctggcagtgtttgtttctgataaagttccagatattgttatgggagatcctgggagattcagacaaattgtaacaaatcttgttggcaactctgttaaattcactgagcgaggccatatatttgttaaagttcatttatctgaaaacagaaagcccgtaacaaatggaaagcatgagacttatcgaaatggagggtctgaagaagttgtgcatgcatctggcggttataatctcaaaacgctaagtggatatgaagctgctgatgaacgcaacaactgggataattttaaccacttaattgctgatgaagagtttttctgcgatgcttcaactaaaaaagtggcctcgaatgaattttatgaacaagtcaccttgatggtctgtgtcgaagacactggaattggaattcctttctcggcccaagataggattttcatgccttttgttcaggcagatagctcgacttctagaaattatggtggtaccggcattggtttgagtatcagtaagtgcctagttgaactaatgggtggtcaaataaactttataagccggccgcaggttggaagcaccttttcatttactgcggattttggaatatttaagaagaatccaataactgaggtgaagaaggttaactatgaagatctaccatccagttttagagggcttaaagccgttgtggttgatgggaaacctgttagagctgctgtgactagataccatttgaagagacttgggatacaagttaaagtcgcaaatgccatcaataaggctgtttccttgtgtgggaaaaatggggcttccagcacagggttattccagcctgatattatttttgttgagaaagattcatgggtttgtggagaggacgggatcttcagtgtgcgccaactggactggaaacagaatggacatatatttaagatgcctcaaatgatccttctagctacaaatattagtaatgacgaatttgataaagctaaatccgcaggttttagtgatacggtgatcatgaagccactgagagctagtatggtgggagcttgccttcagcaagttttgggaacaggcaagaagagacagctgggaaaagagatgcctaatggttcaacttcagttcgaagccttctgttcggaaagaaaattttagtggttgatgacaatgtagtaaaccggagggtggctgcaggtgccttgaaaaactttggagcggatgtgaagtgtgcagatagcggcaaagctgctcttgaaatgcttcaattccctcacaagtttgatgcttgcttcatggatattcaaatgccagaaatggacgggtttgaagcaactcgtcgaattcgggagatggagaggacagcgaatgaggagacgaatagtgaatgtggtgaaaggaaaagtgaattccatttacctatattggccatgacagcagatgtaatccatgctacatatgaagagtgtttgaaatgtgggatggatggttatgtttcaaaaccttttgaggaagagaatctttatcaagcagttgcaaagtttttccagacaaaacctacttcagtagattcatga

SEQ ID NO: 8968 - DNA, 3407 bp, Vitis vinifera
atgggtctgaagatgcagagccaccactcagtggcggtgaggttgaacgagcagatgggtaccaaaagaggctacacatttattcaagccaacagggcttggcttccaaaatttctggtgttctggatcatgttgatggccgttttcagtaacttcgtctacaataaaatggatgctgctaacaaggagagaagggaggaagtgcttgtgagcatgtgtgatcagcgagcgagaatgttgcaagatcaattcagcgttagtgttaaccatgttcacgccctcgccattctcgtctccacctttcattattacaaaaacccatctgccattgaccaagaaacttttgctgagtacacggcgagaacagcttttgagcggcctttactgagtggggtggcctatgcacaaagagtggcttattcagagagggagagatttgagaagcaacatgggtggactataaagacaatgaagagagaggcttcgccgattcgagacgagtatgcacctgtgatattttctcaggaaactgtttcctacattgaatcacttgatatgatgtctggcgaggaggatcgggaaaacattttgagggctagggctactgggaaagccgtcttgacaagccccttcaggctgcttggttctcatcatcttggcgttgtgttgacattccctgtttacaagtccaagcttcctcccaacccaacagtggaacagcgcattgaagcaactgcaggataccttggtggagcctttgatgtggagtccctggtggagaatttacttgggcaacttgctgggaatcaggcaattttggtgaatgtctatgatgtaactaattcttctgatcccttggttatgtatggacgccaatatcaagatgttgacatgtcccttttgcatgagagcaagcttgactttggagatccattcaggaagcaccaaatgatatgtagatatcatcagaaggaacccacatcatggacaagcctcaccaccgcatttctattctttgtaatcggtttattagtaggttatatcttgtatggtgccgcaattcacattgttaaagttgaggacgatttccatgaaatgcaggaattaaaagtccgagcagaagctgctgatgtcgccaaatcccagtttctggctactgtttctcatgaaattaggacacccatgaatggcatcctaggaatgcttgctctgctcctagataccgatttgagttcaacccagagagattatgctcaaactgctcaagcctgtggaaaggcactaataacattaataaatgaagttcttgaccgggcaaaaattgaagctggaaaattagagctcgaagcagtccccttcaaccttcgatccatactagatgatgtcctctctctattttctgagaagtctaggcacaaaggtcttgagctggccgtgtttgtttctgataaagttcctgaaatggttattggggatcctgggagatttcgacagataattacaaatcttgtgggcaactctgttaaatttactgagcgagggcacatatttgttcaagtccatttagctgaacacacaaaggctctaatggatgctaaagctgagacatgtttgaatggaggatcagatgaaggtttagtttcgaatggtggcagtcaatttagaactttaagtggttgtgaagcagctgatgaccagaacagttgggatagatttaagcatttaatttttgatgaagatttgcgatctgatgcttcaaatataatgacagtcaccagtgaagcttctgagaaagtcactttgatggtgtctgtggaggatacaggaattgggatccctttgcgtgctcagggtcgagttttcacaccctttatgcaggcagacagttcaacctctagaaattatggaggaactggtattggtctgagtatcagcaagtgtttggtagagctgatgggtggtcagataaaattcataagtcggcctcagattggaagcacattttcgtttactgctgactttgggaggtgtaagaaaaatgcacttagtgatctgaagaaaagtaattcagatgatctgcctattggttttagaggactaaaagcaattgtagttgatggaagaccggttagagctattgtaaccaagtaccatctgaagagacttggaatcctggttgaagttgctaatagcatcaagaaggcagttgcaataactggaaaaaatggttctctgacatctggtggaaatcagccagatatgattctggttgagaaggattcatggatttctgaggaggatgctgatctgaatcttcggctattggactggaaacagaatagacacacattgaaattacctaagatgatccttcttgcaaccaatattagcagtgcagagtttgataaagcaaaggcagctggctttgcagatactgtgatcatgaaacctttgagggctagcatggttgcagcatgtcttcaacaagtgctagggttggggaagaagaggcagcaagggaaagacatgcttaatggatctgcttttcttcagagcttactctgtggcaaaaaaatattggttgttgatgacaataaggtaaaccgcagagtggctgcaggtgcactcaaaaagtttggggctgatgtggagtgtgctgagagtggcaaagctgcattgcaattgcttcagttaccacacaactttgatgcttgcttcatggatattcagatgccagaaatggatgggtttgaagcaacacgtcgaatacggctgatcgagagtaaggcaaatgaacagatgaatggaggatgcacccctgagggagctgctacaaaaggtgagtggcatgtgccaatattagccatgacagctgatgtgattcacgccacatacgacaagtgcctgaaatgtgggatggatggctatgtctcaaagccttttgaggaagagaatctgtatcaggcggttgcgaagttcttcaaatccaaacccatttcagaatcgtaacacgatcccctccagtaattgctgcaattataaatttgacagttttgtgggctgcacagtaccaacaatttttccacgctctgctggtgtgttttggctaaagggtggttcccttggatttgtgtttgtagaccggcattgaatactggtttgggcagtcatttctaaccaacttcaatttaacttgataaccgtcgaggtgtatactacagaatcctccgaccccacttgtgtatagatgtttagaaggggagggagtcacagtgtaaatcagatattcttgtatgctttccttgaaacttatattttggcgagctagtctcgataccttcatttgtataattttattttataccagaccttttgcttcccatgaaaagccatggaacttttgatca

SEQ ID NO: 8969 - DNA, 3012 bp, Betula pendula
atgggtctgaagatgcagcagagccaccaccactcagtggcggtgaggttgaatgagcaaatgggtaccaaaagagggtgcacattcattcaggccaacagggattggctcccaaagtttctgctgctttggatcctggtgatggcattcttgagcacgatgatctacaatagtatggatgatgataataaagtgaggaggaaggagattctgggaagcatgtgtgatcagagagctaggatgttgcaagatcagtttagtgttagcgttaatcatgtccacgccctcgccatccttgtttctaccttccactactacaagaacccttcagcaattgatcaggaaacttttgctgagtacacagctagaaccgcttttgagcggccattactgagtggggtagcctatgcacagagagtggttaattcagagagggaaagttttgagaggcaacatggttggataataaagacgatggagagggagccttcacctgtgcgagatgtgtacgcacccgtcatattcactcaggaaagcgtctcttacattgaatcacttgacatgatgtcaggagaggaagatcgagagaatattttgagggcgacggctactgggaaagctgttttgacaagtcccttcaggctactgggctctcatcatcttggtgttgtgctgacattccccgtttacaaatccaaactctcttcaagcccagcaatgcaagagctcattgaagcaactgcaggatatgttggtggagcctttgatgttgagtcccttgtggagaatttacttggccaacttgctgggaatcaggcaattttagtgaatgtgtatgatgtcaccaactcctctgatcccctaattatgtatggtcaccaatatcaagacagtgacttgtctctttttcatgaaagcaagcttgattttggggatccttttaggaggcatcaaatgatatgtagatatcatcagaaggcacccatgtcatggacagcactcaccactgcattcttgttctttgtgatcggtttactggtaggttatatcttatatggcgcaggaattcacattgttaaagttgaggatgatttccatgaaatggaagaactgaaagttcgagcagaagctgcagatgttgctaaatcccagtttctagccacagtttctcatgaaattagaacacccatgaatggtatccttggaatgcttgctctgcttctagatacagaattaagttcgacgcagagggattatgctcaaactgctcaaatctgtgggaaggcactgatagcattaattaatgaggtgcttgaccgggcaaaaatagacgctggcaagttagagctggaagcagtcccatttgtcctcagatccatactagatgatgtcctctctttattttctgagaagtctagacacaagggcattgagctggcagtgtttgtttccgataaagttcctgaaattgttatgggggatcctgggaggttcagacagattgttacaaatcttgtaggcaactctgttaaattcacagaacgaggacatatatttgttaaagtccatctagctgaacacacaatggccatggtaaatgcaaaagctgaaacttgcttaaatggaggatcagatagaagtctatttttatctggtggccgtgagtttaaaaccttaagcggttgtgaagttgctgatgagcggaacagctgggatatctttaagcatctagttgctgatgaagaactccgttctgaagcttcacgtaacatgatgaacactaatgaagcttctgaacatgtcactttgatggtatgtgtggaggatacaggaattgggattccgttatgtgcccaggatcgggttttcatgcctttcatgcaggcagatagctcaacgtctagacattatggaggaactggtataggcttgagcattagtaagtgtctggttgagctaatgggtggtcagataaatttcataagccgacctcaggttggcagtacattttcattcactgctgtttttgggaggtgtaagaaaaatgcattcagtgatgtgaaaaaacccatttctgaagatttgccttctggttttagaggattaaaagcattagtagttgatgaaaaaccagttagagctgctgtaaccagataccatttaaagagactaggtatcctggttgaagttgctagtagcttcaagattgcagttgctatgaccgggaaaaagggttctcttacattgcgaaagttccagccagatttagttctagttgagaaggattcatggatgtctgctgaggaaggtggtttgaatggttggctattggactggaaacagaatgggcatatttttcagttgcctaagatgattcttctcgcaaccaatatcgataaggctgaatttgataaagcaaaggccgcaggttttgcagatactgtgatcatgaaacctctgagggcaagtatggttgctgcatgtcttcaacaggtgctggggattggaaagaagaggcagcaggagaaagacatgcttaatggatcttctttccttcagagcctgctttgtggcaagaaaattttagtggttgatgacaatagggttaaccgcagagttgctgaaggtgcactaaagaagtttggagctgatgtagagtgtgctgagagtggcaaagctgcactggcgctgcttcaactaccacataatttcgatgcctgcttcatggacattcagatgccagaaatggatgggtttgaggcaacccgtcaaatacgcgtaatggagagcaaggaaaatgagcaaataaatggtggagccacagatgaaggagctattagaaagagagagtggcatgtgccaatattagccatgacagctgatgttattcatgcgacgtatgatgagtgcctgaaatgtgggatggatggatatgtctcaaagccctttgaggaagagaatctttaccaggcggttgccaagtttttcaaatccaaccccatctctgagtca

SEQ ID NO: 8970 - DNA, 3544 bp, Lotus japonicus
gagatgaaatgaagagctaagcagacaagacaagtttatttgtttgttgctgatgggtcttgggttcaagatgcagcagagccaccaccctgtggctttgaagttacatgagcaagctgggagccagagaaagttcactttcattcagaacttcagaaactggtttctaccccttctgtttgtatggttcattgttatggctgcatttggtgcctgcatctaccataaaatggatgctgaaactaaagtcagaaggaaagaggtgctgggtagcctctgtgatcaaagggctagaatgctacaagaccaattcagtgtcagtgtcaaccatgtccatgcccttgccatccttgtttcaaccttccattactacagaaatacttcagccattgaccaggaaacctttgcagaatacacggccaggacagcatttgaacggccattaatgagtggggtggcctatgcacagagagtggttcactcagagagagaaagatttgagaagcaacatgggtgggttataaagacaatggaaagagtgccttcaggggttagggatgagtatgcagcagtgatatttgcacaggaaactgtctcttaccttgaatctattgatatgatgtctggggaggaggaccgagagaacattttgagggctagagccactgggaaagctgttctgactagccctttcagactgctggattctcatcatcttggcgtggttctaacatttcctgtttataaatctaagctccctccagagccaacgacggaagaggtcattaaagccatagcaggatatattggaggatcctttgatgttgagtcccttgtggagaatttacttggtcaacttgctggtaaccaagcaattttggtgaaggtatatgatataacaaactctagcgaccccctaatcatgtatggcagccaatatgaagagggtgatatgtctcttgtccatgaaagtaagcttgattttggagatccatacaggaaacatcacatgatctgtagatatcaccaacaggcaccaacaaattggatagcatataccacggcattcctattctttgtgattctttgtttagtgggttacattttatatgctgctggaactcacattgtcaaggtagaagatgattacaatgcaatgcaggatttaaaagtcaaagcagaagcagctgatattgccaagtcacagtttctagctaccgtctctcatgaaattagaactcccatgaatggaattttaggaatgcttggtctgcttttacgcacagaattgagttcaacacaaagagactatgctcagactgctcaagcatgtgggaaggcactaatagcattaataaatgaggtgcttgaccgagctaaaattgaagcaggcaaattagagctagaagcagttccatttgaccttcgttccatacttgacgatgtcctttctcttttttctgagaagtcaagacacaaaggcttagagctggcagtgtttgtttctgacaaagttccggatatagttatgggcgatcctgggcgattcagacaaatagtgacaaatcttgttggaaactctgttaagttcactgagcgaggtcatatatttgttaaagtccatttagctgaaaaaagacagtgcacaatgaatggaaaatgtgagacttttctaaatggaggctgtgatgatgttttgcatgtatctggcagttataatttgaaaacccttagtggatatgaagccgctgatgaacggaacagctgggataattttaagcatcatattgctgacgaagaatttttctttgatgcttcggttaaaaagttggcctctagtgaatcttatgagcaagtcaccttgatggtcagcgtggaggacactggaattgggatttctttctctgcccaagatagtattttcatgccttttgtgcaggctgacagctcaacctctcgaaactatgggggtaccgggatcggcttgagtatcagtaagtgcttggttgaactgatgggcggtcagataaacttcataagccgaccccaggtcgggagcacgttttcattcactgcagatttcggaacatttaagaaaaactcaacaactgacatgaagaaacttaactttgaagatctaccttctagttttagaggtcttaaagccattgtggttgatggaaaacctgttagagctgcagtgactagataccatttgaagagactagggatacaagctaaagttgcaattagcatcaataaggctgtttctttatgtgggaaaaatggttctttgacctcggcattatttcagcctgatattatttttgttgagaaggactcttgggtttctggagaggatggtggtatcttcaatgcgtttaagatgcctcaaatgatccttcttgcaaccaatatctgtaacgctgaatttgataaagccaaagctgcaggtttcagtgatacagtgatcatgaagccactgagagctagtatgctggctgcttgtcttcagcaagttttcgggactggcaagacgaggcagtttgggaaagacatgtcgaatggttcttcagtacgaagccttctttgcggaaagaaaatcttagtggttgatgataatttggtgaaccgaagggtcgccgccggcgcgttgaaaaactttggagctgatgtcaaatgtgcagcaagtggcaaagctgctcttgaaatgcttcaatatcctcacgatttcgatgcttgcttcatggatattcaaatgccagaaatggatgggtttgaggccactcgtcgaattcggatgatggaaagagaggcaagtgagcagctgaaaagtgaatctggtgaagaaaatggtaagaaaagtgagttccacatgcctatattggccatgacagctgatgtaatccatgctacatatgataagtgcttaaattgtgggatggatggatacgtctcaaagccttttgaagaagagaatctctatcaagcagttgcaaagttcttcaagtccaagcctgcttcagactcatgacactgcttattctgcagaacaggtcaaccaacttttgattgagaaacatttagtgttagcatgtttggatcaacttctcccagcatcaattctgaaactcagaagctactcatagaagcttctagccagaattgattttggcttcagaagctactaatggttttatgtagagagcaaaagttggtttccaagatatgcgaggatccatgatgatacacacgtctgaagtgatcatttctaaccagttgaagtttcactcgacgtgatttgaatccaagtaaatgcataccacataattatccatccccatcttgtgtacagattctcccaagggataagaaaatttatgtaaattcaatttttttcttttgcatctcaatacttccctgttagaactttttccctatgattatttccacttttcattttcaattatattttttgtaaaattggtctccatcctataaggtttgcttagttttttttaattcagatgagaaggttggtgct

SEQ ID NO: 8971 - DNA, 2256 bp, Glycine max
atggtcgagttagaaatatcaaggagggagtctttgcagactaaggaaaaagtcaatatgctttcttcaagaattggcaagcctttatctaagtttaatggttttcctaaagatatgatagagaaggaccgcatcaacaatgcggacttatcattgacaaaaaccattaggattccaaaaaaggaaaaaataccaccatatacatcttgggtatatgtggtcagaaatgaaagaatggccaaagatcaaacagttcttggaaaataccaaatgtattatgataaaaatagaggtgaaatgatgatatgtagtgatagtgaagaagagatggtaaatcccaaggatgttaaacacgacttcaccgaggctgaagaccaaattctatggaccacacttgcggaatatggatctactgaggagatatttagtattgttaaagagattgttaagacaactgattcacaaattcaggagaggtatgaaatactcaacaaaaaaaatatgaggagtccaagtcagaattttgaagattgtcattgtagaggatgtcaaaatcatcttgggatatgtttggaagaaaacttgaatgttattttagaaccttttgataattttttttgtcgccgatgtttgatctttgattgttctgtgcatggcatttatcaacctttaatatatcatagtgaaaaacaatcaatttggtctgaacttgaaggtgacaagaaaccatgcagcaagcagtgttacattatgttaaaagatgttaatattttgtcaaaaaatacatctcaaaggtattttcgagataaaataattacaccaatggaagaggaccctacattacctcatgacgagcctcaagattcttctaaaaggttgagaaccccaaatgatataatcactgaaattgaccttcgttacatggaactcaatttggatgctaatgatgaagaaaaccacacaacatatggtgcatctttgaaaagtcttaacgaacattcttcagggaaatcaacagttttttataactatagccacgatgagcaaggcaaaggagttatggatggagaaaaagatctcacaaatgagatagaatttaaccaattgtccatttcaagggaagtgcaagcttatgagatgacaaatgagtcaaattggagacctctagagagagatttgtatttgaagggggtagaaatgtttggaaaaaatagttgccttatagcctttaacttacttcatggtttgaagacttgcatagaagtaactaaatacatgtctgcttgtgacgagacaataacccatggatccataccaagttcaaccgtggacaaaaaggaaaagatcaatgcagagttcacagaccaagaaatggcttcaagatcacggtcgcaacgaaaaaagggcaaaccaagaaagtttaattattctcgaaaatctgctggccttccacctagatggagaaaaattgcttatgggcaaaatcaatataataagcaatatactccttgtgggtgtcagggaatgtgtggaaaggaatgtccttgtcttcttcatggaacttgctgtgaaaaatattgtgggtgttcaaagctttgcaacaaccgatttagaggatgtcgttgtgctaagagtcaatgcagaagccgacaatgcccatgttttgcagccaaccgcgaatgtgacccagatgtttgtcgaaattgttgggttagttgtggcgatggttcattaggggagccacctcgatgtggagatggaaaatgtggaaatatgaatcttcttctagggctaaaagagaggattcttttggcaaagtcagatgttataggatggggaactttcgcaaagaacccgattaacaagaatgtgtgcctaggagaatacacgggtgaactgatcactcctaaagaagcagaaaaacgtggaaaattatatgatcgcataaacacttcattccttttcaaccttaatgatcggtgggttattgattcttgtcgcttgggagacaagttaaaatttgcaaaccattcatcaaaacccaactgctatgcaaaggtgatgcttgttggaggagaacatcgagttggcatattttccaaggaaaacattgaagcaggtgaagagattttctatgattattggtatgatctagattgtgctccacaatgggctcttccacctgatgaggtttctaagaaagatgaatcgattgtttctcaaggcagggcaaagaaaaaccaatctcattgttga

SEQ ID NO: 8972 - DNA, 2016 bp, Glycine max
atgtcaataatatttgaaagggggtctttggaaaccgagaaaaatgtcaatatgctttcttcaagaattcacaatcctttatgtaaattaagtggctttcctaaaggtattgtggagaagaatcaaatcaacaatgttgacttatcaccaacaaaaagcattaggattccacacacggataaattaccacaatatacatcttgggtatacgtggctagaaatgagagaatggtcgatgatcaatcggttatcgggaaataccaaatgtaccatgataaaaataaaggtgaaatggtgatatgcagtgacaatgaggaagagatagtagatcccgaggatgtcaaacatgaattcactgaggttgaagacaaatttttgcggatgacgcttgaagaatatgggtgtactgaggaggtattgaatgtcgttaaaaaatttgttaagactactaattcagaaattcaggagaggtatgaaaaactcaaggaaaagaatatggagattctagaccaacattgtgaagattgtcattgtagaggatgtgaaaatcatcttggattatgtttggaaaaaagcttgagtgttactttagaaactttcaataatcttttatgtcgacaatgtctgatctttgattgtcctatgcatggcattaataaacctttagtataccatagtgaaaaccaaccagtttggcttgaacctgaaggtgataagaaaccatgcagtgatcaatgttacctcatgttaaaggatgctaggattttgtcgaaaaattcaactcaatggtcttttcaagataaagtaattacaacaatggaagaggactcaatattgcctcgtgatgatgaagaaaaccacacagtggaagtgcaagctaatgggatgtcaagcgactcatattggagacctctggaaatggatttgtatttgaagggagtaaaaatgtttggaaaaaatagttgccttatagccattaccttacttcctggcttgaagacatgcttggaagtagctaggtacatgtttggtggtggggagttaatgaccaatggattcataccaagttcaatcatggaaaaaaatgaaaagatcaatgcagggtgcacagaccaagaaatgtcatcaagatcacgaccgcaacgaaaaaaaggaaaacctaaaaagttcaattattctcgaaagtctgctggcctcccacctagatggcgaaaaattgcttatgggcaaaacttgtgtaataagcaatatactccttgtgggtgccatggaatatgtggaaaggaatgttcctgtcttgttaatggaacttgctgtgaaaaatattgcgggtgttcaaaacactgcagtaatcgatttagaggatgccgttgcacaaaaagtcaatgcaaaagtcgatcatgtccatgttttgcagccaaccgtgaatgtgacccagatgtttgtcaaaattgttgggttagttgcggtgatgactcattggggaggctacctcgacatgaagatgctaagtgtggaaatatgaatcttcttttagggcaaaaagaaaggattcttttggcaaagtcagatgttataggatggggagcctttgcaaagaacccaattagcaaaaatgtttgcctaggagagtacacgggtgagctaatccctcctaaagaagcagaaaagcgtgggaaactatatgatcgcataaacacttccttcctttttaacctcaatgaccagtgggttattgacgcttttcgcatgggagacaagttaaaatttgcaaaccattcatcaaagcccaactgctatgcaaaggtgatgcttgttggaggagatcatcgagtcggcatatttgccagggaaaacattaaagctggtgatgagattttttatgactatggctatgatctagattctgcaccgctatgggctcttccacccaacgaggcggccaagaaagacaaattagttgtttctctgagtaggacaaagaaaaaagaaaaaaaatcagtttcatttcaataa

SEQ ID NO: 8973 - DNA, 2256 bp, Glycine max; identical to SEQ ID NO: 8971

SEQ ID NO: 8974 - DNA, 1551 bp, Glycine max; identical to SEQ ID NO: 8472

SEQ ID NO: 8975 - DNA, 1639 bp, Glycine max; identical to SEQ ID NO: 8471

SEQ ID NO: 8976 - DNA, 2166 bp, Vigna radiata
atggggaagggagagtttcatggaggggtgttgatgctgttgtttttctgggtttgtggtgtcacagcctctgtcacttacgaccacaaagccattgtgattgatggaaagaggagaattttgatctctggctccattcactacccaagaagcactcctcaaatgtggccagacctcattcagaaggccaaagatggaggccttgatgtcattcagacctatgttttttggaatggtcatgaaccttctccgggaaaatactatttcgaagataggtatgacttggttaggttcgtgaagctagcgcagcaagcaggcctctatgttcatctccgcattggtccctacatatgtgctgaatggaactttgggggatttcctgtctggctcaagtatgttcctggaattgctttcagaacagacaacgaaccgttcaaggctgcaatgcaaaaattcacagcgaagattgttagcttgatgaaagaagagaggttgtttcaatcccagggtggtccaataattttgtcacagattgaaaacgagtatggtcctgtggaatgggaaattggtgctcctggaaaatcttatacgaagtgggctgctcaaatggctgttggtctagacactggtgttccatgggttatgtgcaagcaagaagatgctcctgatcctgttattgacacctgcaatgggttctactgtgaaaacttcaaacccaataagaacaccaaacccaaaatgtggactgagaattggactggctggtacactgattttggtggtgcaagccctattagaccagcagaagacttggcattttcagttgcaagattcatacaaaatggtggttcattcgttaattactatatgtaccatggaggaactaactttggtcggacatctggtggtctcttcattgccactagctatgactatgacgcaccccttgatgaatacggacttcaaaatgaaccaaaatgggggcatttgagagctttgcataaagcaataaaacaaagtgagcccgctttggtatctacagatcctaaggtgacatcgcttggatataaccttgaggcacacgtgttctcaacccctggtgcctgtgcggcatttattgcgaattatgacaccaaatcctctgcaaaagctacgtttggaagtggacaatatgatctaccaccttggtctatcagtattcttcctgactgcaaaactgttgtttacaacaccgcaagggttggtaacggctgggtgaaaaagatgactcctgtaaacagtggatttgcttggcagtcatacaatgaagaacctgcctcatcaagtcaagatgattccattgcagcagaggcactctgggaacaggtcaatgtgacccgggattcttcagattatttgtggtatatgacagatgtctacattaatggtaatgaaggttttctaaagaatggtcgatctcctgttctcactgtaatgtcagcaggccatctgctacatgttttcattaatggtcaactttcaggaactgtgtatgggggattggggaatcctaaattaacatttagtgacaatgtgaacttgagagttggcaataacaagctttctttactaagtgttgccgttggtctcccgaatgttggcgtgcactttgaaacatggaatgcgggggtgttaggcccagtcactctgaagggtctaaatgaaggaacacgagacttgtcccgacagaaatggtcttacaaggtaggactgaaaggtgaagccttgaaccttcacactgaaagtgggagtagctctgttgaatggatacaaggatcattagtggctaaaaaacaacctttgacatggtataaggcaacttttagtgcaccagctggcaatgacccattggctctagatttgggtagcatgggaaagggtgaagtatgggtcaacggtcgcagcattggtcgccattggcctggatatattgcacatggcagttgtaatgcttgcaactatgctggatattataccgatcaaaaatgcaggacaaattgtggaaaaccatctcagagatggtatcatgttcctcgttcatggctgaactcgggtggtaactccttggtcgtgtttgaagaatggggaggtgatcctaatggaattgctttggtaaagagaacctaa

SEQ ID NO: 8977 - DNA, 2705 bp, Glycine max
atggggaagagagagtttcatggggtggtgttgatgtcgttgtgtttgtgggtttgtggtgtcacagcctctgtgacttatgaccacaaggccattgtggttgatggcaagagaagaattttgatctctggctccattcactaccctagaagcacacctcaaatgtggccagaccttattcaaaaggccaaagatggaggccttgatgtcattcagacctatgtgttttggaatggccatgaaccttctcctgggcaatactatttcgaagataggttcgacttggttaaattcgtgaagctcgtgcagcaagcaggcctctatgttcatctccgtattggtccctacatatgtgctgaatggaacttcgggggatttcctgtctggctcaagtatgttccaggcattgctttcagaaccgacaatgagccgttcaaggcggcaatgcaaaaattcactgcaaagattgttagcttgatgaaagaaaataggttgtttcaatcccagggtggtccaataattatgtcacagattgagaacgagtatggaccggttgaatgggaaattggtgctcctggaaaagcttatacgaaatgggctgcacaaatggctgttggtctagacactggtgttccatgggttatgtgcaagcaagaagatgctcctgatcctgttattgacacttgcaatggatactactgtgaaaacttcaagcccaacaagaacaccaaacccaaaatgtggactgagaattggactgggtggtacacagattttggtggtgcagtccctcgtagaccagcagaagacttggcattctcggttgcaagattcatacagaatggtggttcatttgttaactactatatgtaccatggaggaacgaactttggccggacatctggtggcctctttattgccactagctatgactatgatgcgccgcttgatgaatatggacttcaaaatgaaccaaagtatgagcatttgagaaatttgcataaagcaataaaacaatgtgaacctgctttagtggctacagatcccaaagttcaatcgcttggatataaccttgaggcacatgtgttctcgacccctggtgcttgtgctgcattcattgcaaattatgacaccaaatcttatgcaaaagctacatttggaaatgggcaatatgatctaccaccttggtctatcagtattcttcctgactgcaaaactgttgtttacaacacagcaaaggttggtaacagctggctgaaaaagatgactccagtaaacagtgcatttgcttggcagtcatacaatgaagaacctgcctcatccagtcaagctgattccattgcagcatatgcactttgggagcaggtcaacgtgacccgcgattcttcagattatttgtggtatatgacagatgtctacattaatgctaatgaaggattcttaaagaatggacaatctcctgttctcaccgcaatgtcagcaggccatgttctccatgttttcattaatgatcaacttgcaggaactgtgtgggggggattggcaaatcctaaattaacatttagtgacaatgtgaaactgagggttggcaataacaagctttctttacttagtgttgctgtcggtctcccgaatgttggtgtgcactttgaaacatggaatgcgggggtgttaggcccagtcactctgaagggtctaaatgaggggactcgggacttgtccagtcagaaatggtcttacaaggttggactgaaaggtgaatcgttgagccttcacactgaaagtgggagtagctctgttgaatggatacgaggatcattagtggctaaaaaacaacctttgacatggtacaagacaacttttagcgcaccggctggcaatgatccattggctctagatttgggaagcatgggaaagggtgaagtatgggtaaacggtcgcagcattggtcgccattggcctggatatatagcacatggtagttgcaatgcttgtaattatgctggattttatactgatacaaaatgccggacgaattgtggacaaccttctcagagatggtaccatgttcctcgctcatggctgagctcaggtggtaactccttggttgtgtttgaagaatggggaggtgaccctaatggaattgctttggtgaaaagaacatgaaatgtgatgttttatgatgctcccttaaaaggagcagcattgacaagaaatgtatgtctaataacaaatgtctaggaaatgcaaagaagctgtcaagtgagtcctatgcggttaggaccctatgatgcagcaatttaccaaatacgtgtggttcagatcttattaggttcagtattaaaaaatgtttgaagttaaatcattggtgctccatgtcttctggttgttcaagtatacctcaaaagatttccaaggcctaatcatgcatcgcctggccaaaaacaaagaggatgcaaatatactgtacatagtcaagtcaggctattgtgctgaatattgctccatgtattacagggcttgtatcaatgaagattcagcccgtacacattttatttactatgatacaaaggaaagaattgtggacacgcaaaaatgtgtcagagagtatattgctacattctgccaaaagaaaataactgtttttccattaaaattattatgtaagaacagattgaaagtaataaaatatcctttgaaatatt

SEQ ID NO: 8978 - DNA, 2564 bp, Glycine max
atgggttcacgggttctaatcgagaatttaccaagggggaatttttgtaccctgctgttagttttgtgggtttgtgcagtcacagcctctgtgacttatgatcacaaagccattgttgttaatggccagagaagaattttgatctctggttccattcactacccaagaagcacacctgagatgtggccagaccttattcaaaaggccaaagatggaggcttagatgttatccaaacctatgtgttttggaatggacatgagccttctcccggaaagtattatttcgaggataggtacgacttggttaagttcatcaagctggtacagcaagctggtctctatgttcatctccgcattggtccctacatatgtgctgaatggaactttggggggtttcctgtttggctcaagtatgttccgggtattgctttcagaacagacaatgaacctttcaaggctgcaatgcaaaaatttactgagaagattgtcagcattatgaaggaggagaaattgttccagacgcagggaggtccgataattatgtcacagatagaaaacgaatatggaccagtggagtgggaaattggtgcccctgggaaagcttataccaaatggttttctcaaatggctgtgggtttagatactggtgtcccctggattatgtgcaagcaacaagatactccggatcctcttattgacacctgcaatggatactactgcgaaaactttactcccaacaagaaatacaaacccaaaatgtggacagagaactggactggctggtacactgagtttggaggcgcggtccctcgtagacctgcagaagacatggcattctcagttgcaagattcgtacagaatggtggttcatttgttaattactatatgtaccatggaggaactaactttgatcggacatccagtggcctcttcattgccaccagctatgactatgacggtcctattgatgaatacggacttctaaatgaaccaaaatgggggcatcttagagatttgcataaagcaataaagctatgtgagccagctttagtgtctgtagatccaacagtgacatggccaggaaataaccttgaggtacatgtgttcaagacttctggtgcttgtgctgcattccttgcaaactatgacaccaaatcttccgcatcagttaaatttggaaatggacaatatgacctaccaccatggtctatcagcatccttcctgattgcaaaactgcagttttcaacactgcgaggcttggtgctcaaagctctctgatgaagatgactgccgtgaacagtgcatttgattggcagtcatacaatgaagagcctgcatcatccaatgaggatgattctttgacagcatatgcactctgggagcagattaatgtcacccgagattctacagattatttgtggtatatgacagatgtcaacattgatgcaaatgaaggttttataaagaatggacaatctcctgttcttaccgtaatgtcagcaggccatgttttgcatgttttaattaatgatcaactttcaggtaccgtgtacgggggactggactctcataagttaacatttagtgacagtgttaagctgagggttggcaataacaagatttctttactaagtattgccgtgggtctcccgaatgttgggccacactttgagacatggaatgctggggtgttaggtccagtcacacttaagggtctaaatgaggggactagagacttgtctaaacagaaatggtcttacaagattggtctcaagggtgaagccttaaaccttaacactgtcagtggtagttcctccgtggaatgggtacaaggatcattattggctaaacagcaacctttggcatggtacaagacaacttttagcacaccagcaggcaacgatccgttagctctggacatgattagcatgggaaagggtcaggcatggataaacggtcgaagcattggacgccattggcctggatatatagcacgcggtaactgtggggattgttattatgctggaacttacactgataaaaaatgccggacaaattgtggagaaccctcccagagatggtaccatattcctcggtcgtggctgaacccaagtgggaactatctggttgtgtttgaagaatggggaggtgatcctactggaattactttggtgaaaagaacaacagcaagtgtgtgtgctgatatataccaagggcaaccaactcttaagaacagacagatgctagactctggcaaagttgttagacccaaggctcacttgtggtgtccacctgggaaaaacatctctcagattaaatttgctagttatggattgccacagggaacttgtggaaactttagagaaggaagttgtcatgctcacaaatcatatgatgctcctcaaaagaactgcattggcaagcaatcttgcttggtgactgtagctcctgaagtttttgggggagacccgtgtccgggaattgcaaagaagctctcacttgaagcactatgcggataaggatcatgtgatgcaacagtttgccagataatcatggagcagat

SEQ ID NO: 8979 - DNA, 2821 bp, Cicer arietinum
aaaccacacacctcaccttgtaacaagaacattctatctctcaaaagaacaattaaactaacaactgtccacaaacaaaaaactagaagcctttttctccttctccctccactcacttttttctcctataaatttcaaactatcaaacataagtgaagccaacaaaacacacaaacattgttgaactattcaagagtttaacaatgagaaaagaatttaacttgcttgggttgatgttattactatgtttttgggtttgtgctgttacagcctcagtgacttatgatcacaaaaccattgtgattgatgggcagagaagaattttgatctctggttccattcactatccaagaagcacacccgagatgtggccagccttatttcaaaaggccaaagaaggagggcttgatgttattcaaacctatgtattttggaatggacacgagccttctcctggaaaatattacttcgaagataggtttgacttggtaaagtttatcaaactagcacaacaagctggcctttatgttcacttgcgtattggtccctacgtttgtgctgaatggaactttgggggattccctgtttggctcaagtatgttccaggtatttctttcagaacagacaacgaaccattcaaggcggcaatgcaaaaattcactactaagattgtgagcatgatgaaagcagagaatttgtttcaaaatcagggtggtccaataataatgtctcagattgagaatgagtatggaccagtggaatggaatattggtgcacctggaaaggcctacacaaattgggctgctcaaatggctgtaggtctagatactggtgtaccctgggatatgtgcaagcaagaagatgcccctgatcctgttattgacacttgcaatggatattattgtgaaaactttactcccaacaagaactacaaacccaaaatgtggactgagaattggtccggatggtacactgattttggtaatgctatatgttatagaccagtagaagacttggcatattcagttgctagattcatacaaaatcgtggctcctttgttaactactatatgtaccatggaggaacaaattttggccggacatctagtggccttttcattgccacaagctatgactatgatgctcctattgatgaatatggacttacaaatgaacccaaatggagccatttgagagacctacataaagcaataaagcaatgtgagcccgctttggtgtctgtggatcctacaattacatcacttggaaataaacttgaggcacatgtttacagcacaggaactagtgtatgtgctgcatttcttgcaaattatgacacaaaatctgcagcaacggttacatttggtaatggaaaatacgacctaccaccttggtccgtcagcattcttcctgattgcaaaactgatgttttcaacactgcaaaggttggtgcacagagctcccagaaaacaatgatttccacaaacagtacatttgattggcaatcatatattgaagaacctgccttctctagtgaagatgattctatcacagcagaagcactttgggagcagattaatgttactagagattcttcagattatttgtggtacttgacagatgtcaacattagtcctaatgaagattttataaagaatggtcagtatcctattctgaatgtaatgtcagcaggacatgttctacatgtgtttgttaatggtcaactttcaggaactgtatatggggtattggataatcctaagttaacatttagtaacagtgtgaacctaacagttggaaataacaagatttctttacttagtgttgctgttggtctcccgaatgtgggcttgcactttgaaacatggaatgttggggtgttaggcccagtaacattgaagggtctaaatgaagggactcgagacttgtcttggcagaaatggtcttacaaggttggattgaaaggtgaatcattgagccttcataccataactggtggttcctctgttgactggacacaaggatcattattggctaaaaaacaacctttgacatggtataaggcaacctttaatgcaccggctggaaatgatccattgggtctggatatgagtagcatgggaaaaggtgaaatatgggtaaatgatcaaagcattggtcgtcattggcctggatatatagcacatggtagttgtggtgattgtgattatgctggaacatttactaatacaaaatgtaggacaaattgtggaaatcccacacaaacatggtatcatattcctcgctcatggttgaatccaactgggaacgtcttggttgtgttggaagaatggggaggtgacccttctggaatttctttgctcaaaagaatatgatctctgctcatttcattattatgctcaaaagaattgcattgacaaccaataagtatctagccacctatgtctaagtaacttaaagaagctcacagttaagtccctatgcaattgggatcttgccatgaagtgaaaagtgtttcaaattcaacattgatgctccaataatttttgtagttcaagtttcaaccacaagattggatgcaaagatgttatatagagtatgctcatacgatacatatctaagattatatattatggtgaatattgtttcttgtaatactttatagctaagaggattgagcccttaaacattaccatataatgtaatatttgggcatacattatagttctgtttattcataaataaatttgtttgtttttacattgtaatcatgtaaagaacaaattgaaagggataaaagtttttttttataaaaaaaaaa

SEQ ID NO: 8980 - DNA, 2783 bp, Cicer arietinum
aacacacttataccaaaacaacttctctcaataaaggtataaagtaattgacaaaattgtcaacaagcaaaaaacttgaaaccgttaatgtttcaagcaaaagtgaagaaacaaaagacactgttggtttgagagagttttgaggaatggagagtttaacaaggtggagaaagttttatatggttataggattggtgttgtttttgtgtttgtttgttttttctgtcacagcttctgtgacttatgatcataaagctattgtaattaatggacagagaagaattttgatctctggctctattcattatccaagaagcacacctcagatgtggccagatttaattcaaaaggccaaagatggaggtgttgatgttattcagacatatgtgttttggaatggacatgagccttctcctggaaattattactttgaagataggtttgacttggttaagtttgtcaaggtggttcaacaagctggcctttatgttaacttgcgtattggtccctacgtttgcgctgaatggaactttgggggatttcctgtttggctaaagtatgtaccaggtgttgctttcagaacagacaacgagccgttcaaggcagcaatgcaaaaattcactgctaagattgtcagcatgatgaaagcagagaatttatttgaaagccaaggtggtccaataattatgtctcagattgagaatgagtatggacctgtggaatgggaaattggtgctcctggaaaagcttacaccaaatggttttctcaaatggccattggtctagataccggcgtaccgtggattatgtgtaagcaagaagacgctcctgatcctattattgatacctgcaatggatattactgtgaaaacttcactcccaacaagaactacaaacccaaaatgtggactgaaaattggtctggctggtacactgattttgggagcgccgtcccttatagaccggcacaagacgtggcattctcagttgcaagattcatacaaaatcgcggctcatatgttaactactatatgtaccatggtggaactaattttggaaggacatctgctggccttttcattgccacaagctatgactacgatgcacctattgatgaatacggacttctaagtgaaccaaaatgggggcatctaagaaatttacataaagcaataaagcaatgtgagccgattttagtgtctgtggatccgacggtgtcatggccaggaaaaaaccttgaggtacatgtttacaagacgagcactggtgcctgcgctgcattccttgcaaattatgacaccacatctccggcaaaagttacatttggaaatggccaatacgacctaccgccttggtctatcagtattcttcctgactgcaaaactgctgttttcaacactgcaaaggttggtacagtaccaagcttccatagaaagatgactcctgtgagtagcgcattcgattggcagtcatacaacgaagcacccgcctcgtccggtatagatgattccaccacagcaaatgcacttttggagcagatcaaggtgactcgcgattcttcagattatttgtggtatatgacagatgtcaacattagtcctaatgaaggttttataaagaatggtcagtatcctgttcttactgcaatgtcagctggccatgttctgcatgtttttgttaatggtcaattttcgggaactgcttatggaggattggagaatcctaaattaacatttagtaatagtgtaaagctgagggttggaaataacaagatttctttacttagtgttgccgtcggtctctcgaatgttggcttgcactatgaaacatggaatgttggtgtcttaggcccggtaacgttgaagggtctaaacgaggggacaagagacttgtctggacagaaatggtcttacaagattggactgaaaggggaaaccttgaaccttcataccttaattggaagttcctctgttcaatggacaaaaggatcatcgttggtgaaaaaacaacctttgacttggtacaaggcaactttcgacgcccccgctggcaacgatccattggcgctagatatgagtagcatgggaaaaggtgaaatatgggtaaatggtgaaagcattggtcggcattggccggcatatatagcacgtggaagttgtggtggttgtaattatgccggaacgtttaccgataaaaaatgccgaacaagctgtggacaacccacccaaaaatggtatcatattcctcgctcctgggtgaacccaagagggaacttcttagttgtgcttgaagaatggggaggcgatccttctggaatttcattggtgaaaagaacatgaagtgtgctcatttgattctattgaaaagttttttttctttgcagaactgcatttgcaagaaatagtaccaagtaaatgtggttcagaatataaagttattcaagtacattgatgctccatcttttctagtagttcaggtttacaccaaaagattgccaaaacaacttggcaaaaaagaaagatatttacacacatacacaagagaaatttgatgcagaaatgatgtatagtgtatactgtacatagccaaacaattctgctgaataatattgttttatgtattattgagccgatatacataaatcataaatatttgagattgacacacaaaatgtgtgtcagtgtcactagctacattctgccagaaataaataaatttgtttcaacagtggagttatgtattgaacaaattgaaagtaaaaaaaaaaaaaaaaaaaaaaaaaa

SEQ ID NO: 8981 - DNA, 2628 bp, Lupinus angustifolius
caacactcttatacaataagagactctcaaaaagtagcaaaataaaaagacactatatacaaaacagaaaatatttcttcttctatagaaagacaacattgcttatatagaaacatagcattttttgttatgtttggttcaagaattgtgatggagagtttaatgtctaggagaaattttcatatggtgttgctgttattgtttttttgggtttgttatgtcacagcctctgttacttatgatcataaagccattatgattaatgggcagagaagaattttgatctctggttccattcactatccaagaagcacacctcagatgtggccagaccttattcaaaaggccaaagatggagggcttgatgttatagagacttatgtgttctggaatggacatgaaccttctcctggaaaatattattttgaggataggtttgaccttgttgggttcataaagttggttcagcaagctggtctatttgttcatctcaggattggtcctttcatatgtgctgaatggaactttggaggatttcctgtttggctcaaatatgttcctggtattgctttcagaacagacaatgagcctttcaaggaggcaatgcaaaaattcactgagaagattgtaaatataatgaaagcagagaagttgtttcaatcccagggaggtccaataattctgtctcagatagagaatgagtatggaccagtggaatgggaaattggtgctcctggaaaagcttataccaaatgggctgctcaaatggctgtaggtctagatactggtgtcccatgggttatgtgcaagcaagaagatgcacctgatcctattattgatacctgcaatggattttactgtgaaaacttcactccaaacaagaactacaaacccaaattgtggacagaaaattggactggctggtacactgcttttggtggtgcaaccccttatagaccagcagaagatatagcattttcagttgccagattcattcagaatcgcggctcactctttaactactatatgtatcatggaggaactaactttggccggacatcgaatggcctcttcgttgccacaagttatgactatgatgctcccattgatgaatatggacttctaaatgaaccaaaatgggggcatctgagagaattacatagagcaataaaacaatgcgagtcggctttagtgtcggtggatcccacagtgtcatggcctggaaaaaaccttgaggtacatttgtacaagacagagtctgcctgtgctgcatttcttgcaaattataacaccgactattcaacgcaagttaaattcggaaatggacaatatgatctaccaccttggtctatcagtattcttcctgactgcaaaactgaagttttcaacactgcaaaggttaattccccgagattacataggaaaatgactccagtaaacagtgcatttgcttggcagtcatacaatgaagaacctgcatcatcaagcgaaaatgatcccgtcacaggatatgcactatgggagcaggttggcgtgacccgcgattcttccgattatttgtggtacctgacagatgtcaacattggtcctaatgatataaaggatgggaaatggcctgttctgacagcaatgtcagcaggtcatgttctgaatgttttcatcaatggtcaatatgcaggaactgcatatgggagtctagatgatcctagattaacatttagtcaaagtgtgaatctgagagttggcaataacaagatttctttacttagtgtttccgttggtctcgcgaatgttggtactcactttgagacatggaatactggagtgcttggtccagtcacactgacaggtctaagtagcggaacatgggatctttcgaagcaaaaatggtcttacaagattggtctgaaaggtgaaagcttgagccttcatactgaagctgggagtaactctgttgaatgggtacaaggatctttagtggctaaaaaacaacctttggcatggtataagacaacttttagcgcaccagccggcaacgatccgttggctctggatttaggtagcatgggtaagggtgaagtatgggtaaatggtcaaagcattggacgccattggcctggaaataaagctcgtggtaattgcggcaattgtaattacgctggaacttataccgatacaaaatgcttagcaaactgtggacaaccctcccaaagatggtatcatgttcctcggtcatggctgagatcgggtggtaactacttggttgtgctagaagaatggggaggtgatcctaatggaattgctttggtggaaagaacataaagtgtattcatgtgataccaaatgtacatgttatgtacatagtgaaactattatgctgaatattgttccatatactacattacagggtttgtgtcacaatgaacattgagtccttaaacattggtatagaagggaaagagttgaatacccaaaatgggtcaaaatactacattgtcctagaaatagatttctttcattttctatatcaactattatgtaagaacaaattgaaagtaatactaataaatagtgatgcatttggattaaaaaaaaaaaaaaaaaaaaaaaaaaaaaaaaaaaaaaaaa

SEQ ID NO: 8982 - DNA, 2181 bp, Medicago truncatula
atgttaatggagagttttacaaggaggagaaattgttacatattgtttttgtgtttttttgtttgttatgtcacagcttctgtgacttatgatcataaagctattgtgattaatggaaagagaagaattttgatctctggttctatccattatcctagaagcacacctcagatgtggccagatttaatacaaaaggctaaagatggaggtgttgatgtgattgaaacctatgtattttggaatggacatgaaccttctcaaggaaaatattactttgaagatagatttgacttggttaagttcatcaaagtggttcaacaagctggactttatgttcatttgcgtattggtccctatgtttgtgctgaatggaattttgggggatttcctgtttggctaaagtatgtaccaggtgttgctttcagaacagacaatgagccgttcaaggcggctatgcaaaaattcactaccaagattgtcagtattatgaagtcagagaatttgtttcaaagccaaggtggtccaattattttgtctcagattgagaatgagtatggaccagtggaatgggaaattggtgcacctggaaaatcttacaccaaatggttttctcaaatggctgtaggactaaacactggtgttccatgggttatgtgtaagcaagaagatgctcctgatccaattattgatacctgtaatggatattactgtgaaaacttctctcccaacaagaactacaaaccaaaaatgtggacagaaaattggactggctggtacactgattttggtactgctgtcccttatagaccagcagaagacttggcattctcggttgccagattcgtacagaatcgcggctcatatgttaactactatatgtaccatggaggaactaattttggaagaacatcttctggccttttcattgccacgagttacgattatgatgctcctatcgatgaatatggacttataagtgaaccaaaatgggggcatctaagagatttacataaagcaataaagcaatgcgagtcagctttagtgtctgttgatccgacagtgtcatggcctggaaaaaaccttgaggtacacctttacaagacaagctttggtgcctgtgctgcattccttgcaaactacgacactggatcgtgggcaaaagttgcatttggaaatggccactacgacctacccccttggtctatcagtattcttcctgactgcaaaactgaggttttcaacactgcaaaggttcgtgcaccaagggtccatagatcgatgacacctgcgaacagtgcgtttaattggcagtcttacaatgaacaacctgccttctccggtgaaagtggttcctggacagcaaacggacttttggagcagctcagtcagacttgggataagtcagattatttgtggtacatgacagatgtcaacatcagtcctaatgaaggttttataaagaatggccaaaatcccgttcttaccgccatgtcagctggccatgttctgcatgtttttattaacggtcaattttggggaactgcgtatggatcattggacaatcctaaattgacatttagcaacagcgtgaagttgagggttggcaataacaagatttctctacttagtgttgccgtcggtctttcgaatgttggcgtgcactatgaaaaatggaatgttggtgtgttaggcccagtaactttgaagggtctaaacgaggggacacgagatttgtctaaacaaaaatggtcttacaagattggactgaaaggtgaatccttaaaccttcataccacaagtggaagttcttctgttaaatggacacaaggatcatttttatctaaaaaacaacctttgacatggtacaagacaactttcaacgcgccggctggaaacgatccattggctctagatatgagtagtatgggaaagggtgaaatatgggttaatggtcagagcattggtcgccattggccggcatatatagctcgtggtaattgtggcagttgtaattatgccggaactttcacagataaaaaatgcagaacaaattgtggacaacccacacaaaaatggtatcatattcctcgatcatggctgaacccaagcgggaacgtcttggttgtgttggaagaatggggaggcgaccctaccggaatttcactggtgaaaagaacatga

SEQ ID NO: 8983 - DNA, 1493 bp, Vicia faba
ggtactccgattttgtacaactgggctagggttcgttcctatccttcccagaaacggtgcctccttcaaattcaaacacaacaaggtgttcgtttcattcttctataaaacgctgcgtttcgcaaccggtaaacggcgcttataatctcgtcgtttactcgaatcataaccgtttctggttcgagggtttgagatggacgatacggtgcttgacgatatcatacggaagcttgtatcggcgaagaacgggaggacgacgaagcaggtgcatcttacggaggcggatatccggcagctttgtacgacggcgaaggagatttttctcagtcagcctaatcttcttgagcttgaagctcctatcaaaatctgtggagacgtccatggccagttttcagaccttttaagactgtttgaatatgggggatacccacctgaagccaattatttatttcttggagattatgttgatcgtggtaagcagagcatagagacaatatgcttactccttgcttacaaaatcaaatacaaggagaacttctttcttctcaggggtaaccacgaatgtgcctccatcaatcgcatatatggtttctatgatgagtgcaaaaggaggttcaatgttcgcctctggaagacatttactgattgctttaactgtttaccggtcgctgctctagttgatgagaagatcctctgtatgcatggtggtctctctcccgaacttaaaaacttagatcagatacggaatattgctcgccctattgatgtgccagatcacggccttctctgtgaccttctgtgggctgatcccgataaagatctcgagggatggggagaaaatgatcgaggtgtgtcatttacatttggggctgataaggttgctgagtttctcgagcaccatgatcttgatctgatttgtagagctcaccaggttgtagaagatggatatgagttttttgccaaacgtaagctggtgactatattctctgcaccaaattactgtggtgagtttgataacgccggtgctatgatgagtgtggatgacacattgacatgctctttccagatacttaaatcttccgataagaaggggaaaggtggttttggcaataactcatcaagacccgggactccacctcataagggtgggaagacttaattaacagtctcgagctatgtaactacgaagtcagtgagctggatgatggctttcattctcaacataggttaaaggcttatctttctgctgcctgtcatgattgatgattcaaaagatataattgcattttgcctgctttctttggcaacgataactaaagacagtagtatggcagggacatggcacattttattgtgcaactctgattgacccccttctctttgtttcttctttttatagcttttttttctttcttttattcttcttaatattattgtacaatgattttcaaactccataaggggtaatcttcaataaaaaaaaaaaaaaaaaa

SEQ ID NO: 8984 - DNA, 1507 bp, Medicago truncatula
gcagtcgtttacaagaaggagggaaacggcggctatagcgaaactcgctagtcgttttacgttctctctattcctttccgtttcgcgtttctctttctctctctaaacgtaaccgttttctttctctctctctctctctttttctcttggagatggatggtacggtgcttgatgatatcataaagaagcttgtatcagcgaagaacggaagaacaacgaagcaagttcatcttaccgaggctgatattcgtcagctttgtacttctgctaaggagatctttctcagtcagcctaatcttcttgaacttgaagctcctatcaaaatttgtggagatgtccatggccagttttcagaccttttaaggctgttcgaatacgggggatacccacctgaggcaaattacttatttcttggagattatgttgatcgtggtaagcagagcatagagacaatatgcttgctccttgcatataaaatcaaatacaaggagaacttctttcttctcaggggcaaccatgaatgcgcctccatcaatcgtatttatggtttctacgatgagtgcaagaggaggtacaatgttcgtctctggaagacgtttactgattgctttaattgtttaccggttgctgctctagtagatgagaagatcctttgcatgcatgggggactttctcctgaacttaaaaacttggatcagatacggaatattgctcgccctattgatgtgccagatcatggccttctctgtgaccttctgtgggctgatcctgataaagatcttgagggatggggagaaaatgatcgaggtgtttcattcacatttggggctgacaaggttgtcgagtttcttgagcatcatgatcttgatctgatatgtagagctcaccaggttgtagaagatggatatgagttttttgccaaacgtaagctggtgactgtattctctgcaccaaattactgtggtgagtttgataatgccggtgctatgatgagtgtggatgactcattgacatgctctttccagatactgaagtcttccgataagaagggcaaagttggatttggcaataactcatcaagacctggaactccacctcataagggtgggaagaattaattaacatactcgagctatgtaactataaggtcagtgagctggatgatggctttcattctccacataggttaaaggtttatatttctgctacctggcatggttgatgattcacaagatgtttacattttccctgccttcctttgcaacgataactgaagacagtatggcagggacatggcactttttattgtgcgacttcaattgaccccctatccttgtttctttctttcttattttttttagtttcttttcttcttcttcttcttattattattgatgtacaatggaaattcaaactccataaagggtgatcttgttatggtattgcgaaaattttaatataagattgcttcgactttaaaaaaaaaaaaaaaaaaaaaaaaaaaaaa

SEQ ID NO: 8985 - DNA, 1656 bp, Glycine max
gaatgaaaaatggtgtataatttgtccttgtcagcaactagggtagggttcttactaatggccattccctccgccaaacccaaagagtagaagaaacctacaaaaggaatcctctataaacaactccgtttgtcactcgtgtcttgcgagcgggaaacggcggctttagcaatcactccctcgtcgttttcccccgttttctctcccttttccccgttttgcgttttggattcatttctctctatcttctgctgatttatcttaaataaccgctctctctctctctctctctgagactgagaatccgatccttcgtttctgaaattctcccgagatggacgagaacgtgctcgacgatattatccggaggctcctcgcggcgaagaacggtagaacgacgaagcaggtgctgcttaccgaggcggaaattcgtcaactctgtgtttcctccaaagagatctttctcagccaacctaatcttctcgaactcgaggctcctattaagatttgtggagatgttcatggccaatactcagatcttttaaggctgttcgaatatgggggatacccgcctgaagcaaattatttatttctcggagattatgttgatcgtggtaagcagagcatagagacaatatgcttactcctcgcatacaagatcaaatacaaggagaatttctttcttctcaggggcaaccatgagtgtgcatccatcaatcgtatatatggtttctatgatgagtgtaagaggaggtttaatattcgcctctggaagacatttactgattgttttaattgcctacctgttgctgctctggtagatgagaagatcctttgcatgcatggcggactatcgcctgatcttaagcacttggatcagattcggagtattgctcgtcctattgatgtgccagatcatggccttctctgtgaccttctatgggctgatcccgataaagatctagatgggtggggagaaaatgaccgaggtgtgtcatttacatttggggctgataaggttgctgagtttcttgaacatcatgatctcgatctgatttgccgagctcaccaggttgtagaggatggatacgagttttttgccaagcgtcagctagtgactatattctccgcaccaaactactgtggtgaatttgataatgctggtgctatgatgagtgtggatgacaccttgacatgctctttccaaatacttaaatcttctgaaaagaaagggaaatgtggatttggcaacaacacatcaagaccaggaactccaccacataagggtgggaagaattaacattcccgagctatacaaggtcagtgagctgaatggaggcattcattatttgtattaggtcaaaggcttatcgttctgctgcctggcattcacaacatataaagcatgacgccttccctccttggcaacgaaactaaagactggcaaggaacaaggcacttcgttgtgcgacttcgattgaccctttccctttctttctccctttctcctttctgatagttttttttttttttttttaatgtacaatgcaaattcaaacttccatatggaggaatcctgaatatcttattttgtcgccagaattttaatttagattaaattcaaaatttcgatcctttcgtttttctacttgctta

SEQ ID NO: 8986 - DNA, 1688 bp, Glycine max
aaaaaagaaaaaaaaaagtttccatatacacaaagagagtgacgagaaagaaaaatggtgtggaatttgtccctgtcagcaactagggtagggttccctccgccaaacccaaagaaagagtagaagaaacctacaaaactcatctctataaacaactccgtttgtcactccggcggctttagcaatcactccctccgttttgcgttttggattcatttatctgctgctttatcttaaaggccaagcgataaataacctctctctctctctctctctgtgagattgagaatccgatccttcgtttccgaaattctcgcgagatggacgagaacctgctcgacgatattatccggaggctcgtcgcggcgaagaacggtagaacgacgaagcaggtgcagcttacggaggcagaaattcgacaactctgtgtttcctccaaagagatctttctcagtcaacctaatcttctcgaactcgaggctcctattaagatttgtggagatgttcatggccaatactcagatcttttaaggttgttcgaatatgggggatacccacctgaagcaaattatttatttctcggagattatgttgatcgtggtaagcagagcatagagacaatatgtttactcctcgcctacaagatcaaatacaaggagaatttctttcttctcaggggcaaccatgagtgtgcatccatcaatcgtatatatggtttctatgatgagtgtaagaggaggtttaatgttcgcctctggaagacatttactgattgctttaattgccttcctgtcgctgctctgatagatgagaagatcctttgcatgcatggtggactatcgcctgatcttaaacacttggatcagattcgaagtattgctcgtcctattgatgtgccagatcatggccttctatgtgaccttctatgggctgatcctgataaagatcttgatgggtggggagaaaatgaccgaggtgtatcatttacatttggggctgacaccgttgttgaatttcttgaacatcatgatctcgatctgatttgcagagctcaccaggttgtagaggatggatatgagttttttgccaagcgtcagctggtgacgatattctccgcaccaaattactgcggtgaatttgataatgctggtgctatgatgagtgtggatgacaccttgacatgctctttccaaatacttaaatcttctgaaaagaaagggaaaggtggatttggcatcaacacatcaagaccaggaactccaccccataagggtgggaagaattaacattcccgagctatacaaggtcaatgagctgaatggaggcattcattattcgtattaggggtcaaaggcttatcgttctgctgcctggcatgtgattcacaacacgccttccttccttggcaacgaaactaaagacagtgtggcaaggaacaaggcacttcattgcgcgacttcgattgacccctttccctttttttctccctttctcctttctgatagtttttttttttttttaatgtacaatgcaaattcaaacttcatattgaggaatcctgaatatcttattttgtcgcgagaattttaatttagattaaattcaaaatttcgaccctttcgtttttctccttgcttaaaaatttacatttgatattttagtcattacttaaaagaagtttgtcaatt

SEQ ID NO: 8987 - DNA, 1634 bp, Glycine max
aaaaaagaaaaaaaaaagtttccatatacacaaagagagtgacgagaaagaaaaatggtgtggaatttgtccctgtcagcaactagggtagggttccctccgccaaacccaaagaaagagtagaagaaacctacaaaactcatctctataaacaactccgtttgtcactccggcggctttagcaatcactccctccgttttgcgttttggattcatttatctgctgctttatcttaaaggccaagcgataaataacctctctctctctctctctctctgtgagattgagaatccgatccttcgtttccgaaattctcgcgagatggacgagaacctgctcgacgatattatccggaggctcgtcgcggcgaagaacggtagaacgacgaagcaggtgcagcttacggaggcagaaattcgacaactctgtgtttcctccaaagagatctttctcagtcaacctaatcttctcgaactcgaggctcctattaagatttgtggagatgttcatggccaatactcagatcttttaaggttgttcgaatatgggggatacccacctgaagcaaattatttatttctcggagattatgttgatcgtggtaagcagagcatagagacaatatgtttactcctcgcctacaagatcaaatacaaggagaatttctttcttctcaggggcaaccatgagtgtgcatccatcaatcgtatatatggtttctatgatgagtgtaagaggaggtttaatgttcgcctctggaagacatttactgattgctttaattgccttcctgtcgctgctctgatagatgagaagatcctttgcatgcatggtggactatcgcctgatcttaaacacttggatcagattcgaagtattgctcgtcctattgatgtgccagatcatggccttctatgtgaccttctatgggctgatcctgataaagatcttgatgggtggggagaaaatgaccgaggtgtatcatttacatttggggctgacaccgttgttgaatttcttgaacatcatgatctcgatctgatttgcagagctcaccaggttgtagaggatggatatgagttttttgccaagcgtcagctggtgacgatattctccgcaccaaattactgcggtgaatttgataatgctggtgctatgatgagtgtggatgacgccttgacatgctctttccaaatacttaaatcttctgaaaagaaagggaaaggtggatttggcatcaacacatcaagaccaggaactccaccccataagggtgggaagaattaacattcccgagctatacaaggtcaatgagctgaatggaggcattcattattcgtattaggggtcaaaggcttatcgttttgctgcctggcatgtgattcacaacacgccttccttccttggcaacgaaactaaagacagcgtggcaaggaacaaggcacttcattgcgcgacttcgattgacccctttccctttttttctccctttctcctttttgatagttttttttttttttttaatgtacaatgcaaattcaaacttcatattgaggaatcctgaatatcttattttgtcgcgagaattttaatttagattaaattcaaaatttcgaccaaaaaaaaaaaaaaa

SEQ ID NO: 8988 - DNA, 1683 bp, Vitis vinifera
atatacgatggggtccgcccatcctctccatatcttttagccctgtccgtcaaacaaagcgggaaatggccgccacgcactccacacacaaacgcgctcattgacccaagctacagagagaagaggagagtcccaatcccggagagataccgaccactcggtgtcgaaatcttaaccgattagtcgtcgcgggtgggtttgatgagcgaggagagagaagcggatgattcgatgtctcggttgctttaataatgcgaaggaatcggatttctttgtgttgttgagttttttcttttttgcgtttggagagagagaaagagttttctagaagctagggtttggggggtttgtgtgtcggagatggacggagaattgttggacgacatcataaggcggcttgttgatgcgaagaacgggcggacgccgaggcaggtgcagttgacggaagcggaaatccggatgctttgcgtgacgtcgaaggagatcttcctaagccagccgaatcttcttgagcttgaagcgccgataaagatttgtggagatgttcatggtcagttttctgatcttctaagattgtttgagtacggtgggtacccaccagaagcaaactatttattcctaggagactatgttgatcgtggtaaacagagcatagagacgatatgccttctccttgcatacaagatcaagtacaaggaaaacttcttcctcctcaggggcaaccatgaatgtgcttccatcaaccgaatttatgggttctatgatgaatgtaagaggaggtttaacgttcgcctctggaagacatttactgactgcttcaactgccttcctgtagccgctcttatcgatgagaagatcatttgcatgcatggaggtttatctcctgaattaaaaaacttggatcagatcagaaatattgctcgccctgttgatgtaccagatcaggggcttctctgtgatctcctgtgggcagatcctgataaagatattgaaggttggggagagaatgacaggggtgtgtcttacacatttggggctgacaaggttactgaattccttcagaaacatgaccttgatctcatttgccgagctcatcaggttgtggaagatgggtatgagttttttgcaaagaggcagctagtgaccatattctcggcaccaaattactgtggcgagttcgacaatgctggtgccatgatgattgtggatgatacattaacatgttcctttcagatccttaaatcaactgataagaagggaaaactaggctttggaaacatgttgagaccaggaacgcctcctcacaagggtaagggttgacttatctgcactgaagcgaatcttgcgaccagaaggagtgtgatcaatggggccatctctctatttgccacctcacttctgaactgttttctgctgaaatcattttgctccgtttgacatagttttctagtcacaaaactcggttttagttctgccttatttggcatggaaggcataaagcctcacaaagcaatatccagacctcggagagctgatgcccattgtcaatgcaactctcaggttttttttttttttttttctttattatgtaaaatgcaaattctgaaattgttgtgttgaatggtaattggcgtgggtactctttatgtttgttttatggcaacatcatttgcatttgcccgc

SEQ ID NO: 8989 - DNA, 1596 bp, Arabidopsis thaliana
acgagccgcacgtgtgctttccttttttctccttccccgttctctagccgattctctctgtctagggctcctccgtcttcttcttctcataccttcacataccacaaaacctctcttctctctctattgattctctacgaagaggaaagtgattttgaaccatcttgatcggaaacggcgtttcgaaactggaggtcgaagacgaaaaaaactcttatctcatcgctccggtgtaccgaattcgagaggtttttgttaggtttcgtagtgattgattgattttgatggaagatagtgtggtggatgatgttataaagaggttactaggagcgaaaaacgggaagacgacgaagcaggttcagttgacggaggctgagattaaacatctttgttctaccgctaagcagatctttctcactcaacctaatcttcttgaactcgaggctcctattaagatttgtggagatactcatggtcagttctcagatcttttgagattgttcgagtatggtggctacccaccagctgcaaactatttgtttcttggggattatgtagatcgtggaaagcagagtgtagagaccatatgccttcttcttgcctacaagatcaaatacaaagagaatttctttcttctacgtgggaaccatgagtgtgcttctataaaccgtatatacggattctatgacgagtgcaagaagagatatagcgttcgagtgtggaagatatttactgactgctttaattgtctacctgttgctgctcttattgatgaaaagatcctctgtatgcatggtgggctatcgcctgagttgaagcacttggatgagatcaggaacattcctcgtcctgctgacattcctgatcatggactactgtgtgatctgttgtggtctgatcctgacaaagacattgaaggatggggagagaatgacaggggtgtctcgtacacttttggggctgataaagtcgaggagtttcttcaaacgcatgaccttgacttaatttgtagagctcatcaggttgtggaagacgggtatgaattctttgcaaatagacagctagtaacgatattctcggccccaaactactgcggagagtttgataacgcaggagcaatgatgagtgtggatgattccttgacgtgctcatttcagatccttaaagcatctgagaagaaaggaaacttcgggtttggcaaaaatgcaggaaggcgaggaaccccgcctcgcaagggtggtggaaaaggctgaagacaaatcccataaactctgttttgtgtattccatgtttcttggttcaagacacttgcttgatcagctgaacttatcaaactgtcttcttcttcttcttcctctgctctggatcactttggcaaggggtacttctgtcttttcccttgactactctggatcacttggtgtctttgacctctgtgaatctgagatattattctctgtgagatacactttatgtcgttttttgttaaaacatttaaatgaaaatcataatgttcctcgtcacttggaaaaaaacggcacggtgtttcgtttggaaacttaacaatgaatgataggttaatgattcacaaaactg

SEQ ID NO: 8990 - DNA, 1677 bp, Glycine max; identical to SEQ ID NO: 8473

SEQ ID NO: 8991 - DNA, 1745 bp, Glycine max; identical to SEQ ID NO: 8474

SEQ ID NO: 8992 - DNA, 1761 bp, Glycine max; identical to SEQ ID NO: 8475

SEQ ID NO: 8993 - DNA, 1383 bp, Medicago truncatula; identical to SEQ ID NO: 8476

SEQ ID NO: 8994 - DNA, 1412 bp, Glycine max; identical to SEQ ID NO: 8467

SEQ ID NO: 8995 - DNA, 1278 bp, Glycine max; identical to SEQ ID NO: 8468

SEQ ID NO: 8996 - DNA, 4268 bp, Glycine max
atggattctcgattagaaggaaaatttccatccaaagctgcattctgtataactcagctttctatgaaatgtcttgcatctgagcccaaacatcggccatcaatgaaggacgttttggagaatttggagcgaattcaagctgccaatgagaaacctgtggagcctaaattccgttctactcatgccgccaaccgtcaagatttgtacggggctaagcattctgaagaatactgcgcaatgtatgatatatgcggtcaaagcagtgatggcaaggctctcaattgcccatatggttccccttctgtcaagcctgatgacctactgtctgccaaaattcaaagtttgtgccccaccataactggaaatgtttgttgcactgcggatcagtttgacacactaagagtccaggttcaacaggctgtaccaattctagtgggctgtccagcatgcttgaggaattttctaaatcttttttgtgaactttcttgctctcctaatcagagtttattcatcaacgtgacttctatttctgaggttaatggtaatatgactgtggatggcattgattattacataactgaaacttttggagaaggtctatatgaatcatgtaaggatgtaaagtttgggacaatgaatacaagggccatagattttgttggggctggagctagcaattttaaagagtggtttgcatttcttggtcagaaagttcctcctggttttcctggttctccgtattctatactttttaagacaaccattcttgactcttctcctatgaaacttatgaatgcgtctgtatattcatgtaatgacacttcgctgggctgctcttgtggtgattgtccttcatcacctgtttgctcgggttcagaaccttctccacccagaaaagatccctgctccattagaattggatctctaaaggtcagatgtgtagatttttcaatggccattttgtacattgtattggttttcgtgttgtttgggtgggcattgctgcaaaggacaagaggaaggaggagacttggatctggtgtggaaccattattggatgatatggttgatgaagggagtagttttgctaacctccaaaaggatggaactcatcctgcagaggtgcaacagatagatcctcaagggcagaatgtggtgcaattttcttttgttcaagggtgcctgtccagcttttacaggacatatggaaggtgggccactagaaaacccacaattgttctttgttcctcattgacaattgttgttttgctttgtttgggtctgcttcgttttgaggtggagacccggcctgagaagttatgggttggtcctgggagtaaggcagctgaagagaaagagttttttgatagccaccttgctccattctacagaattgaacagctcataatagcgacaatccctgaatctaagcatggcaaaccgccaagtattataacagaagaaaatattgaattgcttttcgaaatacaggaaaaggttgatggaattcgtgcaaattattctggtttgttagtatcactgagtgacatttgcttgaagcctttaggcgacgactgtgcctctcaaagcattttgcagtattttcaaatggaccctgacaattatgacaactacggaggtgttgaacatgctgagtattgttttcagcattacacttctactgaaacatgctttagtgcattcaaggctccccttgagccaactactgccttgggagggttttctggaaataattattctgaggcttctgcatttgttatcacgtaccctgtcaataatgcaattacaaaagtcggagatgagaatgggaaggcaatagcttgggaaaaagcattcatccagttggctaaggaggaattgctgccaatggtgcaatctagcaatcttaccttgtcattttcaactgaaagttcaattgaggaagaactaaagagagaaagcactgcagatgtcataacaatacttgtgagctatattgtaatgtttgcttatatatcggtgaccttgggagatagaccacctcatccgtcttctttgttcctctcgtccaaggtattgcttggtcttttgggggttttgctagttatgctttctgtccttggatcagttggatttttcagtgctattggagtaaaatcgacactaatcataatggaagtcataccttttctggttttagctgttggtgttgataacatgtgtataatcgtagatgctgtgaaacggcaaccctcaggtttaccagtagaggaacaaataagcaatgcaatgggtgaagttggaccttcaataacactggccagcttatcagaaattctagcatttgctgtaggatcatttgtttctatgccagcatgtcgtgttttctccatgattgcagctttggcggttctactggacttccttctacaaattactgcttttgtagctttggttacattagactttatgagggccaaggataataggattgactgctttccgtgcatgaagttgaatccgccctctgcggagcgaaatgaaggcgttaggcgggaaagagatggattactgacacgatatatgaaggaggttcatgcaccatttcttggactatgtggagttaaaatcttggtcattgccgtatttgctgcatttaccttagcaagcattgcattatgcacaaggattgaacctggtcttgagcaacagattgctcttccacgggattcctaccttcagggttatttcagtaacatatccgagtaccttagagttggaccacccttatattttgttgtaaaggattacaactacagtttggaatccaaacacacaaaccagctatgctccattagccactgtgattcaaattctcttttaaatgagatatctagagcatcattagtgccaacatcaagctacatagccaaaccagctgcctcatggcttgatgattttcttgtatggatatcacctgaagcttttagttgctgtcgaaaattcacaaatgactcttattgtccacctgatgatcagccgccttgctgtttaccagatgaagggccatgtgggttgggtggagtgtgtaaagactgtacaacatgtttccgccactcggatttggttaatgatcgtccatctacggcacagttcagagagaagcttccctggtttcttgatgcactgccatcagctgattgtgccaagggtggtcatggagcttacaccaacagtgtagatctgaatggttatgagggtggtgtcatccaagcttctgagttccgtacttatcacacaccagttaatagacaaggtgactatgttaatgcaatacgagctgcaagggacttttcggcaagaatttcttcatctttaaagatggatatttttccgtactcagtgttttatatcttctttgaacaatacctggatatatggaagttagccctgatcaacatttccatagcactaggtgctatttttgttgtctgtctgatcatcacatccagtgtgtggagttcagtaatcatattacttgttctgatcatgataattttggatctcatgggcgtaatggcaattttgggtattcaactgaatgcggtgtctgttgtaaaccttattatgtcaataggaattgctgtggagttctgtgtgcatatagtacatgcttttacggtaagcttgggggataggagccaacgagcaaagacagcattgtgtaccatgggggcttccgtattcagtggaatcacacttacaaaattagtcggagtcctcgtcctttgcttctcaacatcacaaatttttgtggtgtattacttccaaatgtatctggccttggttctcattggcttcttacacggtcttgtgtttctacctgtggttttgagcttgtttggtcctccattaagatatacagtcattaaggagcagctagaagacatgccttctgcttcatcagaacagcctctaattagatgaaagttagattttaactacgtgattacatacttaatgaacaagaaaaattgttttgattatagaggattaatagtatcttttcttttgacttttagatcgagaaagttcattgcttatgtatctgaacatggtcacggagaaactcagtcgatttttgtaatttctgatgtttggtaggtttgatcatcagttatgttggtgtgtatataattccgataacatttgcttatatttgaagcaaatatacgtttataaatatttatatacttttgtttcttttt

SEQ ID NO: 8997 - DNA, 4200 bp, Glycine max
gaggaatgaagtagcatagcacagcaatagcattaatcatcatctgttctgcgttgctatggatatcatcttctccgttacttttctattacaggtgttcctactctcttcttcgcctgctgcctcacaacgtgaaacctatagggctaagcattctgaagaatactgcgcaatgtatgatatttgcggtcaacgcagtgatggcaaggctctcaattgcccatatggttccccttctgtcaagcctgatgacctactgtctgccaaaattcaaagtttgtgccccaccataactggaaatgtttgttgtacggcggatcagtttgacacactaagagtccaggttcaacaggcaataccaattctagtgggctgtccagcatgcttgaggaattttctgaatcttttttgtgaactttcttgctctcctaatcagagtttattcatcaacgtgacgtctatttctgaggttgatggtaatacgactgtggatggcattgattatcacttaactgaaacttttggacaaggtctatatgaatcatgtaaggatgtaaagtttgggacaatgaatacaagggccatagattttgttggggctggagctagcaattttaaagagtgggctgaatttcttggtcagaaagttcctcctggttttcctggttctccgtattctatactttttaagacagccattcttgactcttctcctatgaaacttatgaatgcatctgtatattcatgtaatgacacttcgctgggctgctcttgtggtgattgtccttcatcacctgtttgctcgggttcagaaccttctccacccagaaaagatccctgctccattggaattggatctctaaaggtcagatgtgtagatttttcaatagctatcttgtacattgtattggtttttgtgttgtttgggtgggcattgctgcaaaggacaagaggaaggaggagacttggatccagtgcggaacccttattggatgatatggttggtgaagggagtagttttgctaacctcccaaaggatggaactcatcctgcagaggtgcaatggatagatcctcaagggcagaatgtggtgcaattttcttttgttcaaggatgcctgtccagcttttacaggacatatggaaggtgggccgctagaaaacccacaattgttctttgttcctcattggcaattgttgttttgctttgtttgggtctgcttcgttttgaggtggagacccggcctgagaagttatgggttggtcccgggagtaaggcagctgaagagaaagagttttttgatagccaccttgctccattctacagaatagaacagctcataatagcgacaatccctgaatctaagcatggcaagccaccaagtatcataactgaagaaaatattgaattgcttttcgaaatacaggaaaaggttgatggaattcgtgcaaattattctggttttttagtatctctgagtgacatttgcttgaagcctttaggcgatgactgtgccactcaaagcattttgcagtattttcaaatggaccctgacaattatgacaactatggaggtgttgaacatgctgagtattgttttcagcattacacttccactgaaacatgctttagtgcatttaaggctccccttgaaccaactactgccttaggagggttttctggaaacaattattctgaggcttctgcatttgttatcacgtaccctgtcaataatgcaattacaaaagttgggggtgagaatgggaaggcaatagcttgggaaaaagcattcatccagttagctaaggacgaattgctgccaatggtgcaatctagcaatcttaccttgtcattttcaactgaaagttcaattgaggaagaactaaagagagaaagcactgcagatgtcataacaatactcgtgagctatattgtaatgtttgcttatatatcggtgaccttgggagatacaccacctcatccatcttttttcttcctctcgtccaaggtattgcttggtcttttgggggttttgcttgttatgctttctgtccttggatcagttggatttttcagtgctattggagtaaaatcgacactaatcataatggaggtcataccttttctggttttagctgttggtgttgataacatgtgtataatcgtagatgctgtgaaacggcaaccctcaggtttaccagtagaggaacaaataagcaatgcaatgggtgaagttggaccttcgataacactagccagcttatcagagattctagcatttgctgtaggatcatttgtttctatgccagcatgccgtgttttctccatgattgcagctttggcggttctactggacttccttctacagattactgcttttgtagctttggttacattagactttatgagggccaaggataataggattgactgctttccatgtgtgaagttgaatccgccctctgcggagcagaatgaaggtattaggctagaaagagatggattactgacacgatatatgaaggaggttcatgcaccatttcttggactatggggagttaaaatcttggtcattgccgtatttgctgcatttaccttagcaagcattgcattatgcacaagaattgaagctggtcttgagcagcagattgctcttccacgggattcctaccttcagggttatttcagtaacatatctgagtaccttagagttggaccacccttatattttgttgtaaaggattacaactacagtttggaatccaaacacacaaaccagctatgctccattagccactgtgattcaaattctcttttaaatgagatatctagagcatcattagtgccaacatcaagctacatagccaaaccagctgcctcatggcttgatgattttcttgtatggatatcacctgaagcttttagttgctgtcgaaaattcacaaatgactcttattgtccacctgatgatcagccaccttgctgtttaccagatgaagggccatgtgggttgggtggagtgtgcaaagactgtacaacatgtttccgccactcggatttggttaatgatcgtccatctacagcacagttcagagagaagcttccctggtttcttgatgcactgccatcagctgattgtgcaaagggtggccatggagcttacaccaacagtgtagatctgaatggttatgaggggggtgtcatccaagcttctgagttccgtacttatcacacaccacttaatagacaaggtgactatgttaatgcaatacgagctgcaagggacttttcggcaataatttcttcgtctttaaagatggatatttttccgtactcagtgttttatatcttctttgaacaatacctggatatatggaagttagccctgatcaacattaccgtagcactaggtgctatttttgttgtctgtctgatcatcacatccagcgtgtggagttcagcaatcttattacttgttctgatcatgataattttggacctcatgggtgtaatggcaattttgggtattcaactcaatgcggtgtctgttgtaaaccttattatgtcaataggaattgctgtggagttctgtgtgcatatagtacatgcattcatggtaagcttgggggataggagccaacgagcaaagacagcattgtgtaccatgggggcttctgtattcagtggaatcacacttacaaaattagtcggagtcctcgtcctttgcttctcaacatcagaaatttttgtggtgtattacttccagatgtatctggccttggttatcattggcttcttacacggtcttgtgtttctacctgtggtattgagcttgtttggtcctccgttaagatatagtcattaaggagcagctagaagacatgccttctgcttcatcagaacagcctctaattagatgaaagttagattttaattacgctgatcacatacttaatgaacaagaaaaaatgttttgattatagaggattaatagtatcttttgacttttagattgagaaagttcattgcttatatatctgaacatggtcacggagaaactctgccagtttttagtcatttctgatgtttggaaggtttgatcatcagagttactgtgtatataatgccgagaacatttcctgatatttgaagcaaatatacctttataattattaatatacttctgtttttttttattaa

SEQ ID NO: 8998 - DNA, 4331 bp, Vitis vinifera
atggcgaactgcacctcaattactcgcaaacccttcatcacatcatttctcgcgtttctccgagaaaatactgaagaagacgatgattttctcggcgagaaacatggtgttctcgtttcgtcttctcgccgccctttcgctgttacaggcaagaactcgtttctgtttctcgcaattttgttttccgggatagttggacgtgtgatcatctgtggaattgaattcgtattaatttttgcatctttactcggagcagagaagactgattcacagttccttttgtttcccaatgccacgtctggggaaaggcattccccagaatactgtgcaatgtacgacatctgtggggagcgcagtgatggtaaagttttgaattgtccatatgggacccctgctgtgaagcctgatgagtttctttctgcaaaaatccaaagcttatgtcccatgataagtggaaatgtttgctgtacggaggctcagtttgatactctgcgggcacaagttcaacaagcaatcccttttcttgtgggctgcccagcatgcttgaggaacttcttaaatcttttctgtgagctttcttgctccccgaatcaaagtctgttcatcaatgtgacttccatcgccaaggtcaggcatactgattcgactgtggatggcattgatttttatgtaagtgatgcttttggggaagggctatataactcctgcaaggatgtaaagtttgggactatgaatacaagggcaatacaatttattggtgcaggtgctcgaaattttaaagaatggtttgcatttattggccagcaagctgaccttggaatgcctggttcaccttatgctattaattttaagtcaagacctgaatcatctggaatggagcttatgaatgtgtctatttattcatgtggtgacacttcactaggatgctcttgtggtgattgcccttcatctccagtgtgttctgactatgaacctccttctccacaacaaaaggatgcctgctcgattagccttgggtctgtgaaggtcaaatgcattgaattttcattggcaatcctatatattgtgttggtttctgcatttttcgggtggggtttgtttcatcggacaagagaaaggaggaggatacctgcatcaaacatgaaaccgttgttgaactttgaggatgagaagctcactactctgaaggtgcatgagatggttcctcaagagacaaatgtacaactttctgctgttcaaggatacatgtcgagtttctacaggcaatatggaacatgggttgccaaaaatcccagccttgtgctgtgtatgtcgttggcagttgttcttatactttgtttaggtctaatccgtttcaaggtggagacacggcctgagaagctgtgggtaggtcctgggagtcgggcagcagaagagaaaaatttctttgacagccacctagcccctttttacagaattgaacagctcatattggccaccatgccagatatcaagagtggcaagtcttccagtattgtatcagatgataatatccagttactatttgaaatacaaaagaaggttgatggacttcgtgcaaattattctggctcagtggtgtctctaactgatatttgtttgaagcctatgggacaggattgtgctactcaaagtgttctgcagtattttaaaatggaccctgaaaattattatggctatggaggagttcaacatgttgagtactgctttcagcattacactactgcagacacttgcatgagtgcttttaaggctccacttgatccaagcactgccctggggggattttctgggaacaattatactgaggcttctgcatttattgtgacctacccagtaaataatgcaattggtggagcaggcaatgaaaatgggaaagctgtggcctgggagaaggcttttgttcagttagtgaaggatgagctgctgtcaatggtgcagtctagaaatctcactctttcattttcatctgaaagctcaattgaggaagaattgaaaagagaaagtacagcagatgttataacaatatcaataagctatcttgtaatgtttgcgtacatatcaataaccttgggagatgtgtctcgtttatcttctttctatgtttcatccaaggtattgcttggtctttcaggagttattgttgtcatgctatctgtccttggatctgtaggatttttcagtgccatcggagtaaaatctacgttaatcataatggaagtcattcctttccttgttttggctgttggagtcgataacatgtgtatactggtacatgctgtgaagcgacaatccttagatttgcctctagaaggacgaataagtaatgcacttgttgaagttggtccgtccataacactagctagtttgtctgaagttttggcgtttgcagttggaagtttcattcctatgccggcatgccgtgttttctcgatgtttgcagctttggctgttctactggacttccttctgcaagttactgcttttgttgccttgatagtgtttgactttatgagagctgaggataacaggatcgactgcttcccatgtataaaaattccatcatcttctgtggaatctgatgaaggcatcaatcagagaaagccaggaggattgctggcttggtatatgcaggaagttcatgctcccattcttggtatttggggagttaaaatattcgtcattgctgctttttttgctttcacattagcaagcattgcattgtgtacaagaattgaacctggtttagagcaacaaattgtccttcctcgggattcatatcttcagggatatttcaataatgtttcagagtatctcagaattggacctccattatactttgttgttaaagactataattacagctcggattccagacacacaaatcagttgtgctccatcaaccagtgtgactcaaactctcttttgaacgagatatcaagagcatctttggtgccagaatcaagctacatcgctaagccagctgcctcctggcttgatgactttttagtatggatgtcaccagaagcctttggttgctgtagaaagtttgtaaatggtagttattgcccaccagatgatcagcctccttgctgttctcctgatgaaggttattgtgacctaggaggggtgtgcaaagactgtacaacgtgcttccgtcactcagatttgaatagtggccggccatctacagaacaattcagggagaagcttccatggttccttaatgcattgccctctgctgattgtgcaaagggtggccatggagcttatactagcagtgttgatctgaatggttatgaaagcagtgttatacaagcatcagagttccgtacatatcacacaccactaaacaaacaggttgactacgttaattcaatgagagctgcaagagaattcagctcaagggtttctgatgccttgaagatccaaatctttccatattcagtgttctacatgttctttgagcaatatttggatatctggaggacagctttaatcaacattgctatagcacttggtgctgtatttattgtttgtctagttatcacttccagtgtatggagttcagcaattattttacttgttttggcaatgattattgtggatctcatgggtgtgatggcatgtctggatatccaactgaatgcagtctctgttgtaaaccttataatgtcaattgggattgctgttgagttctgtgtccatatttcacatgccttttcggtaagccaaggtgatcggaaccaacgagcaaagctggctctgggtaccatgggagcctctgtcttcagtggaattacgcttacaaagttagtcggggttattgtcctctgcttctcaaaatcagaaatttttgtggtttattacttccaaatgtatctggcattggttcttattggtttcttgcatgggcttgtatttttaccggtgatactaagcatgattggtccaccatcaatgcatgtacccataaaacagcaagaagatgagccctcttcgtcagcattattgggctaattagttcagcagcaaagcctctcttttggggctaaaattctggtctttgttctcatacttattgtacattattacagtatagttgcatagacagtgagtcatgaacatttgtcacttgaatcagtctcagttggagtctttccagtatttaagtaaagtaagatagaggggtggagtcatatcacttagggtttgatacgagtctgggacaggacaatcacagtgatccatatttgtatcagagatttatttttatgtatgttttaaaagagactacagaatacactactgta

SEQ ID NO: 8999 - DNA, 1745 bp, Glycine max; identical to SEQ ID NO: 8474

SEQ ID NO: 9000 - DNA, 1677 bp, Glycine max; identical to SEQ ID NO: 8473

SEQ ID NO: 9001 - DNA, 2067 bp, Glycine max; identical to SEQ ID NO: 8504

SEQ ID NO: 9002 - DNA, 2004 bp, Glycine max; identical to SEQ ID NO: 8502

SEQ ID NO: 9003 - DNA, 2062 bp, Glycine max; identical to SEQ ID NO: 8503

SEQ ID NO: 9004 - DNA, 1546 bp, Glycine max; identical to SEQ ID NO: 8507

SEQ ID NO: 9005 - DNA, 1643 bp, Glycine max; identical to SEQ ID NO: 8508

SEQ ID NO: 9006 - DNA, 2986 bp, Medicago truncatula
atggattcaaagtcactatgcttcataacccatcaagatattttcaatgtggttcgatctggtgatcttgaaggactcaaagaagtgctgaaatatgttaacaaaggtgaatcctcaaatgggccatcaccaatttctgaattcttgtccatgcagaatgatgctggggaaacgttattgtatatagctgcagaaaatggtgttaaggatttgttcagcttcttgttaaggttatgtgatttggagatactcaaaatcaggtctaaatctgatatgaatgcatttcacgttgcagctaagcgtggccatttgggtatagttatttttttcattttgtttatagttatttattttcattctttttcatcaattgggtatactttattgatggatcaaacctagacatggtttttttgttaatccactgagctacaccatcagaatagtttctgattttttgttgttttatatacatgtaacatgccatgttttagagtaatttgttcttttttccttcaataaactatcaatttgaaatgcacctagttgcgtggttgcggttatgctgcgagcctttatattgcggaaaaatgtggctgattcggtccaaattgatgttgcgatatcgtttcacagacctaatgattatttatattgcggttagggactacgatttttcaaaatcatgtgattagttattctacttgaatcatgaattatggataggttttctttaatgttgatttttttccttctctttttatgaccctgccatgaatgaaataggtatggtgataaaacacatcttttacaaaatttaggatggtagccgcagtttgataataattcacaaggtctcacataacaggtcctacaaaagtgaaatatcaaggctaagggatagttacaatgttgtcaatcctagtttgcgaaaaatcggaatttgttcaaattttaagatgctacaatgttatagcactaatatagcagctatatgacaacaatttgtactgattgtatatcacaaagtaagagcagtctgttaaaattctgttatgctatagcgccactgttttcgctatttgacaacactggatagttatcatattgcaaatttgtattcttatttcccttcaatattttctgatatcaaggatttagattatgaaatgttaaaatgtcaatctttttttccagaaattgtgagggagattttgagtacttggcctgaggcttgtaagttatgcgactcttcgaacactagtccactttatttagctgctgttcaagaccatttggatgtggtgaatgctattttggatgttgatgtcagttcaatgatgatagtaaggaaaaatggcaaaactgcgttgcacaatgcggctaggtatggcattctccgcatcgtaaaagcacttattgctagggactcagcaattgtttgcatcaaagataaaaagggtcaaacagcacttcatatggctgtaaaaggacagtgtacttcagtagtggaggagatattacaagctgacccgatggtattaaacgaaaaagataagaagggtaatacagctcttcacatggctactcggaaagctcgttcgcaggtcaattaaaccatatttgatttctgttttttaccacatggttgtgttagattctggttcagatgtgaataaatacagatgataattctatggtatttggtagattattgcataataataaaggaatgatctattattattgatataagaaagtaactgcagaaaagtaaccaacctctaggaattagagagcctagtctctcccaaaccaacccacatacaaaatacccaatgccttcccctttcctctgcatctttatttataatactaactcactgtagcagttacatagaagttctacagatagcagttactatgtaacaattactaattaatatattaaataaacaactaatattctataacttatgctcttaggagtcctatatctatcaggttgctttgcttcagttttgttataaactagtttatccataatttagacctatgtataattatgtggtgttcgtagttttcttgacacatggttatcctatctatttcagatagtgagctttttgttaagctatgcatctatgaatgtcaatgcaatcaataatcagcaagaaacagccttggatttggcagataaacttccgtacggagattcatctctggaaatcaaggaagccctttcagactgtggtgccaagaatgcaaggaatataggcaaagtgaatgaagccatggaacttaaaagagtcgtgagtgatataaagcacgaggtgcaatcacaactcgtacagaatgaaaaaactcgcaaacgggtttctggtatagctaaagaattgaggaaaattcatagggaagcaatccaaaacaccataaattctgtcacagtagttgctgtcctttttgcatcaatagcattcatggctttgttcagtttgccaggtcaatatagaaagcaacaaccggaggcagggaaggcgaatatagctcacgaagttgctttcagtgttttctgtcttttgaatgcaacgtctcttttcatttctcttgcggttgtcgttgttcaaatcactttggtagcttgggacacaagggctcaaagacagattgtgtcggtgattaacaagctaatgtggacggcttgtgcgtgcacttgtggagcttttctcgcaatagcttttgtggttgttggaaaggaaagatggatggctattactgtaactgttttgggaacaccgattctagttgggactctagcatacttgtgctactttgtgttccggcgacattttggattccaaagtgaatcccaaagagtactatctaagagaccaagtggaagcaaatcactctcgtggtcttactctgcacatatatcagatgaggaggaatataattctgatgttgagaagatctatgctctttg

SEQ ID NO: 9007 - DNA, 1578 bp, Glycine max
atggactcaaactcaaaggctgtgtgcttcataacccaccaagccattttcaacgcggttcgatgtggggaccttgaagggctgaaggagcagctgaagaacaagggtgaagagggggtttctgaggtgatgtctatgcagaacgatgcaggggaaaccatgttctacatagctgctgagattggtcttcgtgaggtgttcagcttcttgtttggtttatgtgacatggaggtgctgaagatcagggccaaatcggatttgaacccctttcacgttgcagccaaaggtggccatttggatattgtaagggaaattttgagtacttggcctgaggtttgcacgttatgcgactcctctaacactagtcccctatattttgctgctattggagatcatttggatgtagtgaatgcaatattggatgttgatgtgagttcaatgatgatagtaaggaaaaatggcaaaactgcattgcacaatgctgctaggtatggcatccttcgcattgtaaaagcactgattgcccgggatcccggaatagtctgcatcaaagatagaaagggtcaaactgcactgcatatggctgtgaaaggacaaagtacttcagtggtggatgagatattacaagctgatcttaccatattgaatgaacgagataagaagggtaacacagctcttcacatggctaccaggaaatgccgtcctcaggtagtaagcattttgttaacctacacagctctgaatgtcaatgccatcaataatcagaaggaaacagccttggatttggcagataaactacgatatggagattcagctttggaaatcaaggaggcccttgcagaatgtggtgccaagcatgccaggcatatcgggaaagtgaatgaagccatggaactaaaaagagccgtgagtgatataaagcatgaggtgcagtcacagctcatacagaatgaaaagactcgcaaacgagtttctggtattgctaaggaattgaagaaaattcatagagaggcagttcaaaacaccatcaattctgtcacagtagtagctgtcctttttggctcaatagcattcatggccttattcagtctacccggtcaatatcgaaagaagcaaccagaggcagggaaggcaaatatagccgatgatgctgccttcagtgctttctgccttttgaacgctacagctcttttcctttcacttgcagttgttgttgctcaaatcactttggtggcttgggatacaaggtctcaaaggcaggttgtgtcagtgattaacaagctaatgtgggctgcatgtgcctgcacttgtggtgcttttcttgctatatcttttgtggttgttggagatgaaacatggctggctattagtgtcacagttttgggggcaccaattctacttggtactctagcatacttgtgctactttgtttttaggcgacgctttggactccgcagtgattcccagggattagtcaagagaccaagtggaagcaagtcattctcatggtcctactcagttaatatatcagatgtggatgattatgattctgatcatgtgaagatatatgctctataa

SEQ ID NO: 9008 - DNA, 1578 bp, Glycine max
atggactcaaactcaaaggctatgtgcttcgtaacccaccaagccatcttcaacgcggttcgatgtggggaccttgaagggctcaagcagcagctgaaaaacaagggtgctgagggggtttctgaggtcatgtctatgcagaacgatgcaggggaaaccattttgtacatagctgctgagattggtcttcgtgaggtgttcagcttcttgcttggtttatgtgacatggaggtgctgaagatcagggccaaatcggatttgaaccccttgcacgttgcagccaaaggtggccatttcgatattgtaagggaaattttgagtacttggcctgaggtttgtaagttatgcaactcctctaacactagtcccttatatttcgctgctgtccaagatcatttggatgtagtgaacgcaatattggatgttgatgtgagttcaatgatgatagtaaggaaaaatggcaaaactgcattgcacaatgctgcaaggtatggcatccttcgcattgtaaaagcactgattgcccgggatcccggaatagtctgcatcaaagatagaaagggtcaaactgcactgcatatggctgtgaaaggacaaagtacttcagtggtggaggagatattacaagctgaccttacgatattgaatgaacgagataagaagggtaacacagctcttcacatggctaccaggaaatgccgtccacagatagtgagccttttgttaacctacacagctctgaatgtcaatgccatcaataatcagaaggaaacagccttggatttggcagataaactgcgatatggagattcagctttggaaatcaaggaggcccttacagaatgtggtgccaagcatgccaggcatattgggaaagtggatgaaaccatggaactaaaaagagctgtgagtgatataaggcatgaggtgcagtcacagctcatacagaatgaaaaaactcgcaaaagagtttccggtattgctaaggaattgaagaaaattcatagagaggcagttcaaaacaccatcaattctgtcacagtggtagctgtcctatttgggtcaatagctttcatggccttattcagtctacctggtcaataccgaaagaagcaaccagacgctggggaagcaaatatagccaatgatgccgccttcagtgctttctgccttttgaatgctacagctcttttcctttcacttgcagttgttgttgctcaaatcactttggtggcttgggatacaaggtctcaaaggcaggttgtgtcagtgattaacaagctaatgtgggctgcttgtgcctgcacttgtggtacttttcttgctatatcattcgtggttgttggagatgaaacatggctggctattagtgtcacacttttgggggcaccaattctacttggtactctagcatacttgtgctactttgtttttaggcgacgctttggacactgcagtgattcccagagattagtcaagagaccaagtggaagcaaatcattctcatggtcttactcagttaacatatcagatgtggatgattatgattctgatcctatgaagatatatgctctataa

SEQ ID NO: 9009 - DNA, 2097 bp, Glycine max
ttccttccactaacctccctctctctccaatccatcgctatctctatctcttttttgatacaaagaaaaataaaaagtttcatactttaggacacccttttctgcaactgatgatggaaggaagctgaaacagtgaaaaacaacaaccaacccctgtctttgttttttgtttgttgaattgaaacttgagagagagaaagtgaatgaatgatggaggcaaagggtgtgcggttcttagcgtaccaatcaatattttcgagcgttggatctggggactttgatggggtgaagaaactggtggagaaagtgaagaatgaagaatggtcatcgctctctgatgtgatgtctcttcagaacgatgctggagagactgcgctatacatcgctgcagagaacaatctgcaagagattttcagcttcttgctcagcatgtgtgacttcgaggtcgtcaagattcgctccaagaaggctgatatgaacgcctttcacgttgctgccaagcgtggcaatctagatattgtgagggagcttttgaatacttggcctgaggtctgcaagttatgcgactcctcaaacaccagtcctctatattctgctgcagttcaagaccacttggatgtggtggatgctatcttggatgtcgatgtcagttgcatgttcatagttaggaaaaacggcaaaacttcactgcacaatgctgctaggtatggtgtccttcgtattgtaaaaacacttattgctcgggatccaggaatagtatgcatcaaagataaaaaaggtcaaactgcccttcatatggctgtcaaaggacagtgtacttcagtggtggaggagatattactagctgatccttctatattgaatgagcgagataagaagggtaatacagctcttcacatggcaacaagaaaatgccgttcacagatagtgagccttttgctaagctattctgctatggatgttaatgccatcaacaaacagcaggaaacagccatggatttggcagataaactgccatatggagattcagctttggaaataaaggaagcccttgcagaatatggtgctaagcatgccaggtatgttggcaaagaagatgaagcaatggaactcaaaagaactgttagtgatataaagcatgaggtgcagtcgcaacttatacaaaatgaaacaacgcgccgacgggtttctggtattgccaaggagttgaagaaacttcatagggaagcagttcaaaacaccattaattcggtcacagtggttgctgtcctttttgcttcaatagcattcttggccatcttcaatttgccgggtcaatatataacggaagaaggacaagagattgggaaagctaatatagccgatcatgttagtttccaggtcttctgccttctgaactctacatctctattcatttctcttgcagttgttgtagttcaaattactttggtagcctgggacacaagggctcaaaagcagattgtgtcagtggttaacaagttgatgtgggctgcatgtgcttgcacttgtggtgcttttctagcaatagcttttgaggttgttggaaagaaaacatggatggctatcaccataacccttttgggggtacctattctagttggcactctagcgagcatgtgctacttcgtttttcgacaacattttggcattttccgcagtgattcccagaggcgcatcaagagaacaagtggaagcaaatctttctcatggtcttactctgcaaatatatcagatttggatgaatacaattctgacattgagaagatctatgccctgtgagtcaagaatcatgttaccacacaacagaagagcaatgtttcaaccttttaactgaaactgttataccactgctaagtgataatgttagctcaccgggatttcatcattcatcttgagttttcagtttttggtttcaggctgtactactaggcaattcggttggatttgcatttgctagtatgtgattatagttcataaccaacacttgtagatttatgtatatgtaattaaaataatatgaaagggaagtccactacttaagtctgatattggaatgagcattttcattacaatacg

SEQ ID NO: 9010 - DNA, 2176 bp, Medicago truncatula
gtgatggagtcgaagggtctgcgtttcatgacccaccaatcaatattcaccacggttggatctggagaccttgatgggttgaagaaactgttagagaaacttaataaggaagaagatggtgatataagtaatgggtcatcatcatcatctatgtcggtttctgatgttatgtctcttcaaaatgatcatggtgaaacaccactttacatagctgcacacaataatctgaaggaagttttcacctttttgattaaattatgtgactttgaggttctcaagattcgttctaagtctgatatgaacgcttttcatgttgcagctaagcgtggccatcttgatattgtgagggagattttgagtgcctggcctgcggtctgtaagttgtgcgactcgacaaacaccagtcccctatatgctgctgctgttcaagatcacttggatgtggtaaatgctattttggatgttgatgtcagctccatgtttatagttagaaaaaatgggaaaactgcactacataatgctgttaggtatggcgtcgaccgtattgtgaaagcacttattgtccgtgatccaggaatagtttgcatcaaagataaaaaaggtcaaactgcgctacatatggctgtcaaaggacagagtacgtcagtggtggaggagatattacaagctgatcctactatattgaacgaacgagataagaagggtaataccgctcttcacatggctacgcggaaaggccggtcacagatagtgagctatttgctaagctatgcagctgtggatgttaatgccatcaataagcaacaagaaacagccttggatttggcagataaactgccatatggatcgtcagctttagaaatccaagaagcactttcagaatatggtgctaaatatgcaagacatgttggtaaagtagatgaagccatggaacttaaacgaacagtgagtgatataaagcatgaggtgcagtcacagctcatacaaaacgaaaaaactcgccgacgagtttccggtatagctaaggaattgaaaaaactccatagagaagccgttcaaaacaccattaactctgtcacagtggttgctgttctttttgcctcaatagcattcttggctatattcaatttgccgggtcaatatattatgaaaggatcacatataggagaatctaacattgcggatcatgttggattccaaattttctgtctcttgaattcgacgtctcttttcatttctcttgcagttgttgttgttcaaatcactttggtagcttgggacacaagggctcaaaagcagatcgtgtctgttgttaacaagctaatgtgggctgcttgtgcttgcacgtgcggtgcttttttggcgatagcttttgaggttgttggaaagaaaaaatggatggctattaccataactggtttagggataccaattctagttgggactctggcaagcatgtgctactttgtttttcgacaacattttggcattttccaaagtgattcccagagacgcatcaagagagcaagtggaagcaaatccttctcatggtcttactctgcaaatatatcagatatagacgaatacacttcagacattgagaagatctatgctttgtaagctggtgattgagtgctaccacgcaatataacactgaatatgtatagtataatccaaatcagttttaacaattatcgatactttataaagttataatcattttgatttggtaaaaatgctgatgaggatcaaaatatcaatgattatagttttataatatatcagtggttgttaaaagtcagtccattatcgacaagaactttcctgatagcaccatattgtatagatgtagaggatctaatttcctgtttccagcttttaactgaaacctgaggagttacggatggcacttcagtgcctttgatgtttccttacctggatttatctctctagttatcagcttgaagttttaggttgtgcctggcaacctctttaggtttgcattttctattgtctgtgattatataattaataatcagcacttgtagatgtatgtatatatgtgataaaaggaaaaggcatttatgtaaagtatttcaagcaacacgtacaagagaagtgcttcctccctaagcctgctatgatagaaaattagaggatgaaaagttgaaaggag

SEQ ID NO: 9011 - DNA, 2135 bp, Glycine max
gaggagtgcaacagagaagaatcacattcgcattctcaatcacatccattcattcactcatccatatcccttctttccactaacttctctctctagttgatacaaataaaaaacaaagtttcatactttacgacacccttttctgcaactgatgatggaaggaagctgaaacagtgaaaaacagcaacaacgaccaccctgtctttgttttttgtttgttgagttgaaactttagagaaagtgaatagtgatatggaggcaaagggtgtgcggttcttagcgtatcaatcaatattttcgagcgttggatctggggacttcgatggggtgaagaaactggtggaggaagtgaagaaggaagaagggtcatcgctctctgatgtgatgtctcttcagaacgatgctggagagactgcgctatacatcgctgcagagaataatctgcaagagatgttcagcttcttgctcagcatctgtcactttgaggtcgtcaagattcgctccaaggctgatatgaacgcctttcatgttgctgccaagcgtggcaatctagatattgtgagggagcttttgaatatttggcctgaggtctgcaagttatgtgactcctcaaacaccagtcctctatattctgctgcagttcaagatcacttggatgtggtggatgctatcttggatgtcgatgtcagttccatgttcatagttaggaaaaacggcaaaacttcactgcacaatgctgctaggtatggtgtccatcgtattgtaaaaacacttattgctcgggatccaggaatagtatgcatcaaagataaaaaaggtcaaactgcactgcatatggcggttaaaggacagtgtacttcagttgtggaggagatattactagctgatccttctattttgaatgagcgagataagaagggtaatacagctcttcacatggctacaaggaaatgccgttcacagatagtgggccttttgctaagctattctgctgtggatgttaatgccatcaacaagcagcaggaaacagccttggatttggcagataaactgccatatggagattcagctttggaaataaaggaagcccttgcagaatatggtgctaagcatgccaggtatgttggcaaagaagatgacgcaatggaacttaaaagaactgttagtgatataaagcatgaggtgcagtcacaacttatacaaaatgaaacgacacgacgacgggtttctggtattgccaaggagttgaagaaacttcatagagaagcagttcaaaacaccattaattctgtcacattggttgctgtactttttgcctcaatagcattcttagccatcttcaatttgccgggtcaatatataacggacgaaggaaaagagattgggaaagctaaaatagccgatcatgttagtttccaagtcttctgccttctgaattctacatctcttttcatttctcttgccgttgttgtagttcaaattactttggtagcctgggacacaagggctcaaaagcagattgtgtcggtggttaacaagttgatgtgggctgcatgtgcttgcacttgtggtgcttttctagcaatagcttttgaggttgttggaaagaaaacatggatggctatcaccatcacccttttgggggtacctgttctagttggcactctagcaagcatgtgctactttgtttttcgacaacatttcggcattttccgcagtgattcccagagacgcatcaagagagcaagtggaagcaaatctttctcatggtcttactctgcaaatatatcagatttggatgaatacaattctgacattgagaagatctatgccctgtgagtcaagaatcaagagaaatgtttcaaccttttaactgaaactgttatactactgccaagtgataatgttagctcaccgggatttcatcattcatcttgagtttgcagtttttggtttcaggctgtatgtgattataattaataatcaaaacttgtagatttatgtatatgtaataaaaataatatgaaagggaagtccactacttaagtttgatattggaatgagcattttcattacaatacgaaattaaattttcatctgcaccgtgcaagaaaatagagcttcctatcttaaaa

SEQ ID NO: 9012 - DNA, 1997 bp, Populus trichocarpa
ggaatgacagcttcacactcgttgcttcatcgctgcttgtattttcccctctctgttgaataaacaaacccatatgttatgtatatcaattgagttaatattgatattgttgttgttatgatgatgatggagccatcaaagtcatcactacgcttcatagcccaccaggcattcttctcagccgtccgatcgggcgaccttgattctttgagacagatagtgggggatcagccatccgatgtttccgatctaatgtccttgcagactgatgcaggagagactgctttgtatatagccgctgataataatttggaagagatttttagttatttgataaagcggtgtgatcttgaaactgttaagatcaggtcgaagtctgacttggatgctttccatcttgctgctaagaagggtcacttgggcattgtgaaggaacttttggccatgtggcctgagctttgcaagttatgcgactcctccaatactagccccctttattcagctgctgttaaaaatcacttggatgtggtgaatgccatattggatgctgatgtcagttcaatgaggatagtgcgtaaaaatgggaaaactgctttgcacacggctgcgaggtatggtcttcttgatatagtgaaagttcttatagcccgtgattctggaattgtctgcatcaaagataagaaaggccaaactgcacttcacatggctgtaaagggtcagagtacttctgtcgttgaggagatattacttgctgatcactcaatactaaatgagcgtgacaagaagggtaacacggcagtgcatatagccacaaggaaatctcgtccccagataatattccttttgctgagctatacatctattaatgtcaacatcatcaataatgagcgtgaaactgcgatggatttggctgataaactccaatatggagaatctgctttggaaatcaaggaagctctcatagaggctggtgccaagcatgctaggcatgttggtcaaatggatgaagcaatggaacttaagaggacagttagtgatatcaagcatgaggtgcattcacaacttatacaaaatgaaaaaaccaaccgaagagtttctggcattgcaaaggaactaaggaaactccatagagaagctgtccagaatacaaccaactctgtcactgttgttgctgttctttttgcctcgattgctttcttggctatcttcaacttgcctgggcaatatatacaggatggagctgaaacagggaaagctaatatagctgacagtgttggtttccaagttttctgcctcttaaatgcaacatctctctttatatctttagctgttgtcgtggttcagatcactttggtggcctgggacacccaggctcagaaacaggtagtctctgtagttaacaagctgatgtgggctgcatgtgcttgcacttgtggtgcatttctatctatagcatttgtggttgtgggaaagaaaagttcgtggatggctataaccataaccttaacaggagcaccgattcttgtcgggacactcgcaagcatgtgctactttgttttccgacagcattttggatttttccgggactcccagaggcgcataaaaagggcaagtggaagcaagtcgttttcctggtcagtgcactcaacaaatatatcagatcctgatgagtacaactctgatctggagaagatctatgctttataaattgtgtattgaaaaatacgcatgtaaaaagggatgctttaactacatgttgtctctttggtgtcgtctgcactagtgttttttatccctcttttcccagccaatatgcagagtaacagtacttgatggttggttataggatttggattttaagggttcgcaaggaagttttgactggtcttccccagttttgtaatatgaaagtagatttttgtaaattcaggtgaattatgatagtccattgcagttgccttcagttagcagcttcttaaagaaaaaaaaaaaaaaaa

SEQ ID NO: 9013 - DNA, 1979 bp, Medicago truncatula
acgtatgtttgaattacatgtgccatacaactaacccttgacttccctttctctctaaattattctctatataataaccatttttcttcatagttttcctataattcaaacatttatgttcccttcaacacttctactatagagttcaaaaagctctatataggtagataacaccttaaagcaaaacaccaactgaaaaatacaccaaaccactttcttttctcctcttttccattctttttgcgtggtttgaagggcacacactaactatatctcaaatagaaactgagaaggtagttggtttcactaatagaacatcatgcatatagaagccccagaaaattatggccccgaagacaaaaacttcgacgacgatggacgagccaagagaactgggacatggttaactgctagtgcacatattataacggctgtgattggttctggagttctatcactagcatgggcaatagcacaaatgggttgggtagctggtcctgcagttctctttgcattttctttcattacctatttcacttccactcttcttgctgattgttaccgttcacctgatcctgttcatggcaagagaaactacacttacactgaagttgtcagagctaacctaggaggcagaaaatttcagctatgtggattggctcagtatataaatcttgtaggtgtgaccatcggctacacaataactgcatcaattagtatggtggctgtacaaagatcaaactgctttcacaagcatggacatcaagacaagtgctatgtctcaaataaccctttcatgatcatttttgcttgcattcaaattgttctttgccagatacccaatttccatgagctctcttggctctcaattgttgcagcagttatgtcttttgcttactcttccattggccttggcctttccgtagccaaagttgcaggtgggggaaatcatgtgacaacatccttaactggtgtgcaaattggggtagatgttactgcaacagaaaaggtgtggaggatgttccaagctattggtgacattgcatttgcctatgcattttctaatgtgctcattgagatccaggatactttgaaatcaagccctccagaaaacagagttatgaagagagcaagtttaattggaattttgacaacaacattattttatgtgctatgtggaaccttaggttatgctgcatttggaaatgatgcaccaggaaattttctcacaggatttggcttctatgagcccttttggctaatagactttgccaatgtttgcattgcagttcacttaattggtgcataccaggtctttgtccaacccatatttggctttgttgagggccaaagcaaacaaaaatggccagacagcaaatttgtgaatggagaacatgccatgaatattccactatatggaagctataatgtgaattactttagagtaatatggaggagttgttatgtgattatcactgctatcattgccatgttattcccattcttcaatgatttcttgggactaattggttcactatctttctatccattaacagtttacttccctatagagatgtacattaagaaaaccaacatgccaaaatattcattcacatggacttggcttaagatattaagttggctatgtttggtcatttctattatctcagctgctggatcaattcaaggacttgcaacatcactcaagacatataaacccttcagaggagaacaatgatactttgttaattttctagtggaatgctatttttttttctttgccaatgttttttcttgtcttaaataagttacttactagaagtccaatccaagtatattgtaccattatgatcaagtgcttattgatagtggaaaaattcaacacctacaaggagtacaatattaatgtagtgaacaataatcccaaaaatggttgtaaattaaactataacctttcttattcagtagaggcttcattt

SEQ ID NO: 9014 - DNA, 1775 bp, Glycine max
ttttttttctctagttcattatcttagtccaccaaaatcttataagtagtgccaagccaaaccaaccacacctacaacgcacctttctttctcttttccctttttcttaggcacaccacacacccactcaaataatagaaactgagatgaatcctgatcagtttcagaagaacagcatgttcgtagaaacccctgaagatggtggcaaaaacttcgacgatgatggacgagtcaaaagaactggtacatggataactgcgagtgcccatatcataacggcagtgataggttctggagtgttgtcacttgcatgggcaattgcacaaatgggttgggtggcaggccctgcggttctctttgccttctctttcatcacatacttcacctccactcttcttgccgactgttatcgttcacctgaccctgttcatggcaagcgaaactacacctattcagatgttgtcagatccgtgttaggaggtaggaaatttcagctgtgtggattagctcagtacataaatcttgtcggtgtaactatcggttacacgataacggcttcaattagtatggtggcggtgaagaggtccaactgttttcacaaacatggtcatcatgataagtgctacacgtcaaacaaccctttcatgatcctctttgcctgcattcaaatcgtgcttagtcaaataccaaatttccataagctttggtggctctccattgttgcagcagttatgtcttttgcttattcttccattggccttgggctctccgtagctaaagtggcaggtggtggagaacctgtacggacaaccttaacgggggtgcaagttggggtggacgttacgggatccgagaaggtctggaggacgtttcaagctattggtgatattgccttcgcttacgcttattctaacgtgctcattgagatacaggataccctgaaatcgagccctccagaaaacaaggtcatgaaaagagcaagtttgattggcatcttgactacaaccttgttctatgtgctatgtggctgcctaggttatgcagcatttggaaacgacgcaccaggaaatttcctcacagggttcggtttctacgagcccttttggctaatagactttgctaacatctgcatagccgtacacttggttggagcatatcaggtcttctgtcagcccatatttgggttcgtagagaactggggtaaggaaaggtggcccaatagccattttgtaaatggagaacacgctttaaagtttccactatttggaaccttccctgtgaactttttcagggtggtatggagaacaacatatgtcatcatcactgctttgatagctatgatgtttccattcttcaatgacttcctaggcctgattggttcactgtcattttggccattaacggtttacttccccatagagatgtacattaagcagtcaaagatgcaaaagttttccttcacttggacatggctcaagatattgagctgggcttgcttgatcgtttctattatctcagctgctggctccatccaaggcctcgctcaagatctcaagaaatatcagcccttcaaagcccagcaataattaaatttgttccaaagtgttctaaattgctttcttccctaagtcactttgttttaataagtttcagcatgttcatggataatgtattgttatcaagtgcttatgaaagaaagaatatagcacacagctgcattgtataaaatgtcaagaacaattctaagatttatgaaagtgtgcactatcatttaa

SEQ ID NO: 9015 - DNA, 1799 bp, Glycine max
cttttcttttttctatagttcattatcttagttcaccaaactcttataagtagagccaagccaaaccaaccacaccaagtacaagcagagagttacaacacatatttctttttcttttccctttttcctaggcacagcacacgccctctcaaatagaaactgagagatgaattctgatcagtttcagaagaacagcatgttcgtagaaacccctgaagatggtggcaaaaacttcgacgatgatggacgagtcagaagaacgggtacatggataactgcgagtgcccatatcataacggcagtgatagggtcaggagtgttgtcacttgcatgggcaattgcacaaatgggttgggtggctggccctgccgttctctttgccttctctttcatcacttacttcacttccactcttcttgccgactgttatcgttcacctgatcctgttcatggcaagcgaaactacacctattccgatgttgtcagatccgtcttaggagggaggaaatttcagctgtgtggattagctcagtacataaatcttgtcggtgtaactatcggttacacgataacggcttcaattagtatggtggcggtgaagaggtcgaattgttttcacaaacatggtcatcatgttaagtgctatacgtcaaacaaccctttcatgatcctctttgcctgcattcaaatcgtgcttagccagataccaaatttccataagctctggtggctctccattgttgcagcagttatgtcttttgcttattcttccattggcctcgggctctcagtagctaaagtggcaggtggtggagagcctgtacggacaaccttaacgggggtgcaagttggggtagacgttacaggatccgagaaggtctggaggacgtttcaagctattggtgacattgccttcgcttatgcttattctaacgtgctcatcgagatacaggataccctgaaatcgagccctccagagaacaaggtcatgaaaagagcaagtttgattggcatcttgactacaaccttgttctatgtgctatgtggctgcctaggttatgcagcatttggaaacgatgcaccaggaaatttcctcacagggttcggcttctacgagcccttttggctcatagactttgctaacatctgcatagccgtgcacttggttggagcatatcaggtcttctgtcagcccatatttgggttcgtagagaactggggtaaggaaaggtggccaaatagccaatttgtaaatggagaacacgctttgaactttccactatgtggaaccttccctgtgaacttcttcagggtggtgtggagaacaacatatgtcatcatcactgctttgatagctatgatgtttccattcttcaatgacttcctaggcctgattggttcactgtccttttggccattaaccgtttacttccccatagaaatgtacattaagcagtcaaagatgcaaaggttttccttcacgtggacatggctcaagatactgagctgggcttgcttgatcgtttctattatctcagctgctggttccatccaaggcctcgctcaagatctcaagaaatatcagcccttcaaagcccagcaataataataatttgttccaaagttctaaattgctttcttttctaagtaactttttttagtaagtttcagcatgttcatggataatttattgttatcaagtgcttatgaaagaaagaatataacacccagctgcattgtataactgtcaagaataattctaagatgtatgaaagtgtgcactgtcatttaacactgtc

SEQ ID NO: 9016 - DNA, 1643 bp, Medicago truncatula
atgagccgtgatcagtttcagaaaaatagcatgtatatagaaacccctgaagcttttactgacggtagcaaaaactttgatgacgatggacgagccaaaagaacgggtacatgggtgactgcaagtgcacatatcataacagcagtgataggatcaggagtgttatcacttgcatgggcaatagctcaaatgggttggattgctggcccagcagttctacttgctttctcttttataacttatttcacttccactcttcttgctgattcttatcgttcacctgaccctgttcatggcaaaagaaattacacctattccgaagttgttagatctgtcttaggaggaaggaaattccagctgtgtggattagctcaatatataaatcttatcggtgtaacaattggatacacaataactgcttcaattagtatggtagcggtgaagaggtcgaattgttatcacaaacaagggcatgatgcaaagtgttatatatcaaataatcctttcatgataatatttgcttgcattcaaattgtccttagccaaataccaaactttcataagctatcgtggctctccattgttgcagccgttatgtcttttgcttattcatccattggcctcggtctctctatagctaaagtggcaggtaggggacctgctgtacggacatcattaacaggggtgcaagttggggtggacgttacagggactgaaaaggtgtggaggatgtttcaagctattggtgacattgccttcgcttatgcttattctaatgtcctcattgagatacaggataccttaaaatcgagccctccggagaaccaagtcatgaaacgagcaagtttgattggcatcttgactacaacaatgttttatatgctatgtggctgcttaggttatgcagcatttggaaatgatgcaccagggaatttcctcacagggttcggcttctacgagccgttttggctaatcgacttagccaacatcttcatcgccgtgcacttaattggagcatatcaggttttctgccaaccaatctttggattcgtagagagtaagagtaaggaaaaatggtccaacagtcagtttgtaaatggagagcatgccgtaaatattcccctatgtggaaccttacatgtgaacttcttcagggtagtttggagaacagcatatgttgttatcactgctttgatagctatgatatttccattcttcaatgacttcttgggactgattggttcactttccttttggccattaacggtttactttcccatagagatgtacattaagcagtccaagatgcaaagattttctttcacgtggacatggatgaagatattgagttgggcatgcctcattgtttctatcatctcagctgctggttccatccaaggccttgctcatgatctcaaaaaataccagccattcaaagctcagcaataatacttaattccaaattctgtattgttttcttttctcagtatcttttctttgttttagtaagtcatcatcagcaaacccacgcatatgtaatgttatcaaggtttttatgcaaagatagagcataacacaccaaacatcagtgtatatataataatatgtcatgaataatgcactgctattttgttatctatggt

SEQ ID NO: 9017 - DNA, 1726 bp, Glycine max
ggaagtacaagcagagagttacaacacatatttctttttcttttccctttttcctaggcacagcacacgccctctcaaatagaaactgagagatgaattctgatcagtttcagaagaacagcatgttcgtagaaacccctgaagatggtggcaaaaacttcgacgatgatggacgagtcagaagaacgggtacatggataactgcgagtgcccatatcataacggcagtgatagggtcaggagtgttgtcacttgcatgggcaattgcacaaatgggttgggtggctggccctgccgttctctttgccttctctttcatcacttacttcacttccactcttcttgccgactgttatcgttcacctgatcctgttcatggcaagcgaaactacacctattccgatgttgtcagatccgtcttaggagggaggaaatttcagctgtgtggattagctcagtacataaatcttgtcggtgtaactatcggttacacgataacggcttcaattagtatggtggcggtgaagaggtcgaattgttttcacaaacatggtcatcatgttaagtgctatacgtcaaacaaccctttcatgatcctctttgcctgcattcaaatcgtgcttagccagataccaaatttccataagctctggtggctctccattgttgcagcagttatgtcttttgcttattcttccattggcctcgggctctcagtagctaaagtggcaggtggtggagagcctgtacggacaaccttaacgggggtgcaagttggggtagacgttacaggatccgagaaggtctggaggacgtttcaagctattggtgacattgccttcgcttatgcttattctaacgtgctcatcgagatacaggataccctgaaatcgagccctccagagaacaaggtcatgaaaagagcaagtttgattggcatcttgactacaaccttgttctatgtgctatgtggctgcctaggttatgcagcatttggaaacgatgcaccaggaaatttccttacagggttcggcttctacgagcccttttggctcatagactttgctaacatctgcatagccgtgcacttggttggagcatatcaggtcttctgtcagcccatatttgggttcgtagagaactggggtagggaaaggtggccaaatagccaatttgtaaatggagaacacgctttgaactttccactatgtggaaccttccctgtgaacttcttcagggtggtgtggagaacaacatatgtcatcatcactgctttgatagctatgatgtttccattcttcaatgacttcctaggcctgattggttcactgtccttttggccattaaccgtttacttccccatagaaatgtacattaagcagtcaaagatgcaaaggttttccttcacgtggacgtggctcaagatactgagctgggcttgcttgatcgtttctattatctcagctgctggttccatccaaggcctcgctcaagatctcaagaaatatcagcccttcaaagcccagcaataataataatttgttccaaagttctaaattgctttcttttctaagtaactttttttagtaagtttcagcatgttcatggataatttattgttatcaagtgcttatgaaagaaagaatataacacccagctgcattgtataactgtcaagaataattctaagatgtatgaaagtgtgcactgtcaaaaaaaaaaaaaa

SEQ ID NO: 9018 - DNA, 1781 bp, Glycine max
atgcctcttggtcctttctctaatccaaatatctctccgttaatgctctcaccacaaacttcaatagactagccaaaagctaacaccaactataggccaaatcaccaataaatattatttcccgttcttttggcgtgttggccacccactgaacacatttgcactcacacatagaagcagagagaggccattggttggtttcagagatgggaagcatgcacatagaaaccccagaaacttttgctgatggtagcaaaaacttcgatgatgatggacgagctaaaagaactgggacttggattactgcaagtgctcatatcataacggctgtgattggttctggagtgctatctcttgcatgggcaattgcacagatgggttgggtagctggtcctgcagtgctctttgtcttctctttgataacatacttcacctccactcttctcgctgactgttaccgttcacctgaccctgtacatggcaagcgaaactacacatattctgaggttgtcaaagccaacctaggaggaagaaaatttcagctgtgtggattggctcagtatataaatcttgttggtgtaacaatcggctacactataactgcatcacttagtatgggggcggtgaagaagtcgaactgtttacacaaacatggccatcaagacgagtgcaaagttaaggacaacgcttttatgattgcttttgcctgcatccaaattcttctaagccaaataccaaacttccataagctctcttggctctctatcgtagcagctgttatgtcttttgcttattcttccattgggcttggcctttccatagccaaaatcataggtgggggacacgtgcgaacaaccttaacaggggtggaagtttcgggaacggaaaaggtttggaaaatgtttcaagctatcggtgacattgcctttgcttatgctttttctaatgtcctaattgagatccaggacacactgaaatcaagcccacctgagaacaaagtcatgaagagagcaagtttgattggcattatgactacaacattgttttatgtactatgtgggtgcttaggctatgctgcatttggaaatgatgcaccatctaatttcctcacaggattcggcttctatgagcccttttggctaatagactttgccaatgtctgcatagcagtgcacttagttggggcataccaggtctttgtccaacctatatttgggtttgtggaaaagtggagcaaagaaaattggacagaaagccaatttataaatggcgagcatactttgaacattcctctatgtggaagctacaatgtgaacttctttagggtagtgtggaggactgcatatgtgattatcactgccgttgtagctatgttactcccattcttcaatgactttttggcccttattggtgcactctctttctggccattgacggtttacttccctatagagatgtacattaagaagtcaaatatgcaaagattttccttcacctggacttggctcaagatattgagttgggtttgcttgatcatttctattatctcacttgtgggttccatccaaggcctttcggttagtatcaagaaatacaagcccttccaagcagaacaatagaactttcatacttagtattccaacttgagccaagagtttctattgagggcgacaaaatttgtattactatgttttgaaatagttgttatattttcaattctcgaaatcgagacaacttgttatactaaagtaatataataaaatgtttagtttgctatgtta

SEQ ID NO: 9019 - DNA, 1697 bp, Brassica napus
atataaaaaactacctttgcctcttcttcctatttcaacataatagcagaaaggcaatctatctatggagaaaaagagcatgttcattgaacaaagcttcaccgatcacaagagtggcgatatgaacaaaaactttgacgatgatggacgccagaaaagaacagggacttggatgacggggagcgcccatataataacagcggtgataggatcaggagtgttgtcactggcgtgggcaattgcacagctcggatgggtggcaggacccgccgtacttatggctttttccttcataacatactttacatcaaccatgcttgccgactgttatcgttccccggatcctgtcactggaaaacgaaactatacctacatggaagttgtccgctcttacttaggaggaagaaaagtgatgttatgtggattggctcaatacgggaatctgattggaataacaatcggctacacaatcacagcgtcgattagcatggtggcagtgaagaggtcgaattgtttccacaagaatggacataatgtgaaatgttccacttcaaacactcccttcatgatcatattcgcatgcatccaaattgtacttagccaaatcccaaatttccacaatctctcttggctctccattctagcggccgtaatgtccttttcttacgcctccattggtatcggtctctccatcgccaaagtggccggtggcggtgtgcacgcaaggacggccctgacaggagttacggtcggagttgatgttactggttctgagaaagtatggagaacattccaagcggttggagatatcgcatttgcttatgcctactcaaccgtacttattgagatacaggacaccttaaaagcaagtccaccatcagaaaacaaagccatgaaaagagcaagccttgtgggtgtatccacaacgaccttcttttacatgttatgcgggtgtgtgggttatgctgcctttggcaataatgcgcctggaaatttcctaaccggttttggtttttatgagcccttctggctaatcgactttgccaatgtctgcatcgctgtgcatcttgttggggcctatcaggtcttttgccagccaatcttccaatttgtagagagccagagtgcaaaacgttggccagataacaagtttattacaggagagtacaaaatgaacgtcccttgcggtggtgattttggtatcagcttgtttagattggtttggaggacttcatatgttgtagttacggctgttgtagcaatgatcttccctttcttcaacgatttcttgggtcttattggagcagcttccttttggcctttgactgtttactttcccattgagatgcatattgctcagaaaaatatgaagaaattttctttcacttggacatggctgaaaatcttgagctgggcttgtttcctcgtctccctcgttgctgctgctggatctgtgcaaggactcatacaaagtcttaaggatttcaagcctttccaggctcccgagtagaactgtgttttgtctaatttcttcaagaacacaactcccttgcactctcttttctccaataatagtgtatgttcgtttgtaatatatttgtgttcttgttccattacgaaatgttgaacctatatttgcttgtctgaaacaaatctatcatcaataagtccctctttcttttcaaaaaaaaaaaaaa

SEQ ID NO: 9020 - DNA, 1449 bp, Populus tremula x Populus alba
atggatagagaaatgcaaaatagcagcctgcacatagcgcgtggcccggaaggatctgaaagcggtggaatgagcaagaatcttgacgatgatggtcgaccaaaaagaactggaacatggataactgcaagtgcccatatcatcactgctgtgatcggatctggagttctatctctggcatgggctatagcacagctaggatgggtggttgggccgcttgttctcatggtgttctctttcatcacttttttcacgtccactcttcttgccgattcctacaggtctcccgaccccatcaccggcaacagaaactatacttacatggatgctgtgagagcccacttaggaggcaggaaagttcagctctgtggattggcacagtacgtgaatctgataggaattacagttggttacaccatcactgcatctattagcatggtggctgttaggaggtcaaattgtttccacaaacatgggcatgctgtgaagtgccagacgtcaaataatccatacatgataatctttgcgtgcatccaaatcatgcttagccagataccaaacttccacaagctctcatggctgtcgattcttgcagcagtgatgtcttttgcttattcttccattggccttggactatccttagcaaaagtaatcggcggcgcgcatgcaaggacaagcttaacaggagtaacagttggggtggacgtgtcagcagaacagaaagtctggaggaccttccaagccctcggggacattgcctttgcgtatgcttactctactgtgctcatcgagatacaggacacactgaaatcaagtcccccagagaacaaagctatgaagagagcaagctttgttggcatcctgacaacaaccacgttctacattctctgtggttgtcttggttatgcagcttttggaaatgatgcaccgggcaatttccttactggttttggattctacgagcctttctggctaattgacctcgcaaatgcatgcatagctatccaccttattggtgcctaccaggtattctgccagccaatcttcagttttgtggagagcagatgccacagaagatggcctgatagcaagttcatgacaagagagcacgccattaacattccattttatggtgtgtattacctcaacttattcaggctagtgtggagaactttatacgttatagtgacagcagttctggccatgatccttccgttcttcaacgacttcttggctcttcttggggcgatctctttctggccgttgacagtttattttcccatagagatgtatatggcgaggtcaaaaatgcctaaattctctttcaggtggacctccctgaagatgttgagttgggcctgcctggcagtatcgcttgtttctgctgccggatcagttgaaggcctgatccaagctctcaagacatataagcccttcaaagcccagcaa

SEQ ID NO: 9021 - DNA, 1412 bp, Glycine max; identical to SEQ ID NO: 8467

SEQ ID NO: 9022 - DNA, 1278 bp, Glycine max; identical to SEQ ID NO: 8468

SEQ ID NO: 9023 - DNA, 1412 bp, Glycine max; identical to SEQ ID NO: 8467

SEQ ID NO: 9024 - DNA, 1677 bp, Glycine max; identical to SEQ ID NO: 8473

SEQ ID NO: 9025 - DNA, 860 bp, Helianthus annuus; identical to SEQ ID NO: 8477

SEQ ID NO: 9026 - DNA, 974 bp, Vitis vinifera; identical to SEQ ID NO: 8478

SEQ ID NO: 9027 - DNA, 2132 bp, Vitis vinifera; identical to SEQ ID NO: 8479

SEQ ID NO: 9028 - DNA, 990 bp, Arabidopsis thaliana; identical to SEQ ID NO: 8480

SEQ ID NO: 9029 - DNA, 1160 bp, Glycine max; identical to SEQ ID NO: 8481

SEQ ID NO: 9030 - DNA, 1008 bp, Dimocarpus longan; identical to SEQ ID NO: 8482

SEQ ID NO: 9031 - DNA, 1029 bp, Vitis vinifera; identical to SEQ ID NO: 8483

SEQ ID NO: 9032 - DNA, 1077 bp, Glycine max; identical to SEQ ID NO: 8487

SEQ ID NO: 9033 - DNA, 1122 bp, Glycine max; identical to SEQ ID NO: 8488

SEQ ID NO: 9034 - DNA, 3492 bp, Glycine max
aatttccctaaaacagacctttctttctcttgtttagattttttttgtggtgtcaccaggcctctctgtcttcttgtttctcgtaaaaggggaaaaagggggaaattttctttaagtaaagaaccctaatctttctctttccatctcaaatcgattcgattggaggttttcagggcatcgatggagtgaaacagaagagagtgtgtggcgcgattccgtgttagatcagaaagaagagagactcagagacggcaccaccaaatccaatggcgggagcagataaagaattggaagaacaacttctcgaagccggtaacaagcttgtagatcctccttcgtcagtggaggagctcctcgcactcctagaacaagtagagagttgcctgtcaagggttgaacagtccccgactgactctatgcaaaatgcactctctccatcattgaaagcattgattgcagaaaaacttttaaggcactcagatgatgatgtcaaaattgcagttgcatcttgcatcagtgaaataactagaatcactgcacctgaagctccttatgatgatgatcaaatgaaggaggtatttcaattaatagtatcatcatttgaaaatctacatgataagttaagccaaacatatccaaagaggatctcaattcttgaaactgttgcgaaagtgagatcatgtgtggtaatgctggaccttgaatgtgatgtgctgattttggagatgtttcagcatttcttgaaagccataagggaacatcatccagaaaatgttttttcgtccatggaaacaattatgacccttgttctagaggaaagcgaagatatatccttagacctgctgtctccactccttgccagcattaagaaagacaacaaggaagtttttccaatagcccagaaattgggggagagggtccttgaaagctgtgcaaccaagcttaaaccctacttggttcaatcagtgaaatcattgggtatatctgtggatgattatagtgcagtacttgcttcaatatgccaagatacatctgatgacttggagaaaaatgatacatgtgttactagtgagcatgtggttaaaaaagattcaagggaagttacatcctctcagcaagaaaatcccgatgatgtgaataaatctccaaagtcagtcatgagcaatggtgttgcatgtgttggagaagataatgctttagctgattccgagtccattaaaaaaaaagaggatgctgattgttctaatcactctgatggtttgaatacttttggtcatggggtgcataatgatttggacattgaaaaagttgacaatagtaaacaaaaaacagaaaaagctaccaagaaacaacgaaagaaatcaagctcttcaactaaatcggcaaaaccttccaagggtcaagttgctactaatgagaaggaaactgagaaaatgctcgactgtgaaagcaactgcaagatagttcacagttcccctcacgaggaccattctgttgaagctgcaggaccttcagagaatgacaaagagattgatgctaatattatgtcgccaaaggcatgcaatgatgattctgaaattgttgcttctccaccaagtgagagcctctgtgatgaaaatcattccaagaaacttggacaatcaaaaaagaaagatgaccctgtaaaagaagggactgcagaggatgtttcaaaggtgtcagctagtgattcagaagccaagcctaccaggcgctcagtgaaaaaggcacttggtcagaagtctgatgtgaaaaaaactagtgtggtagattcagttaaaaaaggaagtggggctgcaaatgatgcagatgcgaaaaaacactctgccaagaaatctgatgaaaacaaaaagggtagtggtggatcctcttcaaggcagatggagtacaagaaaaagggaggtcgggggaaagctaactctgaagcagatgttgcaaaatcatcggatgtggataaggaaatggtttcttctccgacatctggtacaaaatcaactaaagatggaaagtcagaggagactcccaagacaaatgtgaaaaggaaacgcactccaggaaaagaaaatgactctgatgtgaaggaatatggtgaaaaccttgttggtctacgggtcaaagtttggtggcctaaggatcatgagttttacataggtgttattgattcttttgattctgccaaaaagaagcacaaggtcttgtatgatgatggtgatgaagaaacattaaatctcgtgaaggaaaaatggaaggtcattgaagctgactcagatgcagatgaggaagaacgaagtgatcgtgcagatcttgatgtttccactgatatgtcactgaagaagaaagggaaagcaagtgctggtgaatcaaccaagcaaggaaagatggatgcttcttccaaaagcggtggagcagcagcatccaatggatcaaagggtgcatccacgaagtctagccagaaggccaaagatggcaacaaatccaaaggttccaaggctaatagcaaatctgaggataaagttagtagaaaatctaaggacggcactcctaaaagtggtagcagtaaatctattgttgctgctaaaaaaatgagtaataaattaaaaaatacggatacttccaagacaagtgaatcaaaggatgatgacagcagcaaaccaaaaccctctgccaagtctaagcacgaaaccctaaaaagtggaaaatccaagcaagaaacaccaaaggctgccatttccaaaggaaaacctgttaaaagtggtggaaagactgatgttaatggtactggcaaagtgaaatctggtttattgaagagaaaacattttgagaatgagaactcagatgtttcagcaggagagatagaagattccaagggcaagactgcaagttcatcaaaggcacaaggaagtgagctgaagagtagaaagcgtcggaaaacctagaagtgggtatttgttccccctgtttattccttaactgggtgcttgtcttctgcttatcagtttactcttcttcagagcatttaattttttcttcctgtggccggagtgatcaaatgactttaagctgtgtatcaggtagctgttcaccgttttgtggtaattatcccgttggtactagcattgttatctttagttattggttaggccagtttagttgtagtatgggttagtatctttagttattctaagactagatgtatgttatttaaaggcaacaatggaaatcatttggctagcaaccttcatttaaagaatgcttactacttacccaattaacgtttttgcattgctcagtgttgagctgtggttgatttgttgagacaatacgttcaccataattgatgtggtggaagctattgtagttggcctgttgagaaacactaagtggatagtaatctttatatggttttattaggtttcgatttttgcatgtttgagtgctatatagaaaatgattgattgttttgactcattatcg

SEQ ID NO: 9035 - DNA, 3144 bp, Glycine max
aaaaaaaccctaatcttcccgttgcttctcaaatcgattcaattggggcgttttcagggcatcaatggagtgaaacaggagagagagagtccgtgttagatcagaaagaagagacagagacggcgccaccaatggcgggagcagataaagaattggaagagcaacttcttgaagccggtaacaagcttgtagatcctccttcgtcggtggaggacctcctcgcactcctagaacaagttgagagttgcctatcaagggttgaacagtccccgaccgactctatgcaaaatgcactctctccatcattgaaagcattgattgcagacaaacttttaaggcactcagatgatgatgtcaaaattgcagttgcatcttgcatcagtgaaataacaagaatcactgcacctgaagctccttatgatgatgatcaaatgaaggaggtatttcaattaatagtgtcatcatttgaaaatctacatgataagttaagccgatcatattcaaagatgatctcaattcttgacactgttgctaaagtcagatcatgtgtggtaatgctggaccttgaatgtgatgcgctgattttggagatgtttcagcatttcttgaaagctataagggaacatcatccagaaaatgttttttcatccatggaaacaattatgacccttgttcttgaggaaagtgaagatatatccttagacctgctgtctccactcctgggaagcattaagaaagacaatgaggaagtttttccaatagcccagaaattgggggagagggtccttgaaagctgtgcaaccaagctgaaaccctacttggttcaagcagtgaaatccttgggtatatctgtggatgattatagtgcagtacttgcttcaatatgccaagatgtatctgatgacctggagaaaaatgatacatgtgttactagtgagcatgtggattcaagggaagttacatcctctcagcaagaaaatcctgatgatgtgaataaatctccaaagtcagtcatgagcaatgttgttgcatgtgttgaagataatgctttagctcattccgagtccattaaaaaacaagaggatgctgattgttctaatcactctgaaggtttgaatacttctggtaatgaggtgaataatgatttggacattgaaaaagttgacaatagtaaacaaaaaacagaaaaagctaccaagaaaccacgaaagaaatcaagctcttcaattaaattgacaaaaccttccaagggtcaagttgctgctaatgagaaggaaactgagaaaatgctcgactgtgaaagcaacagcaagatagttcacagttcccctcccgaggaccattctgttgaagctgcaggaccttcagagaatgacaaagggattgatgctaagatttcgtcgccaatggcatgcaatgatgattccgaagttgttgcttctccaccaagtgagagcctctgtgatgaaaatcattctaagaaacttggacgaacaaaaaagaaagatggccctgtaaaagaagggactgcagaggatgtttcaaaggtgacagctagtgattcagaagccaaacctgccaggcggtcagtgaaaaaggcacttggtcagaaggctgatgtgaaaaaaactagtgtcgtagtttcagtaaaaaaaggaagttgggctgcaaatgatgcagatgcaaaaaagcactcagccaagaaatttgatgaaaacaaaaagggtagtggtggatcctcttcaaggcagatggaggacaagaaaaagggaggtcgggggaaagctaactctgaagcagatgttgcaaaatcatctgctattgatgtggacaaggaaatggtttcttctccaacgtctggtacaaaatcaactaaagatggaaagtcagaggagactcccaagacaaatctgaaaagggaacgcactccaggaaaagaaaatgagtctggtgtgaaggaatatggtgaaaaccttgtcggtttacgggtcaaagtttggtggcctaaggatcgtgagttttacataggtgttattgattcttttgattctgccagaaagaagcacaaggttttgtatgatgatggtgatgaagaaacattaaatcttgtgaaggaaaaatggaaggtcattgaagctgactcagatgcagatgaggaagaacgaagtgattgtgcagatcttgatgtttccactgatatgccactgaagaagaaagggaaaacaagtgctggtgaatcaaccaagcaaggaaagatggatgtttcttccaaaagcagtggagcagcagcatccaatagatcaaagggtgcatccacaaagtctagccagaagtccaaggatggcaacaaatccaaagattccaaggctaatagcaaatctgaggatggagttaatagaaaatctaaggacagcactcctaaaaatggtagcagtaaatctattgttgctgctaaaaaaatgagtaataaatccaaaaatactgatacttccaagacaagtgaatcaaaggatgatggcagtatcaaacaaaaaccttctgccaagtttaagcatgaaactccaaaaagtggaaaatccaagcaagaaaccccaaaggctgccatttccaaaggaaaacctgtcaaaagtggtggaaagactgatgttaatggtaccagcaaagcaagatctggtttattgaagagaaaagattccgagaatgagaactctgatgtttcagctggagagagagaagatgccaagggcaagagtgcaaattcatcaaaggcaaaaggaagtgagctgaagagtggaaagaagcgtcggaaaacctagaagtgggtatttgtcccccctgtttattccttaactgggtgcttctcttctgctcatcagtttactcttcttcagagcatttaattttttcttcctatggctaatgaatttaagctgtgtatgaggtagctgttcatcgttttgtggtaattatccagttggtaatagcattgttatctttagttattggttaggccagtttagttgtagtatcggttagtatctttagttattctagactagatgtatgttatttaaaggcaacactggatattatttggctagcaaccttcatttaaagaatgcttgctacttacaacttacccaa

SEQ ID NO: 9036 - DNA, 3219 bp, Glycine max
aaaaaaaccctaatcttcccgttgcttctcaaatcgattcaattggggcgttttcagggcatcaatggagtgaaacaggagagagagagtccgtgttagatcagaaagaagagacagagacggcgccaccaatggcgggagcagataaagaattggaagagcaacttcttgaagccggtaacaagcttgtagatcctccttcgtcggtggaggacctcctcgcactcctagaacaagttgagagttgcctatcaagggttgaacagtccccgaccgactctatgcaaaatgcactctctccatcattgaaagcattgattgcagacaaacttttaaggcactcagatgatgatgtcaaaattgcagttgcatcttgcatcagtgaaataacaagaatcactgcacctgaagctccttatgatgatgatcaaatgaaggaggtatttcaattaatagtgtcatcatttgaaaatctacatgataagttaagccgatcatattcaaagatgatctcaattcttgacactgttgctaaagtcagatcatgtgtggtaatgctggaccttgaatgtgatgcgctgattttggagatgtttcagcatttcttgaaagctataagggaacatcatccagaaaatgttttttcatccatggaaacaattatgacccttgttcttgaggaaagtgaagatatatccttagacctgctgtctccactcctgggaagcattaagaaagacaatgaggttgtagaagtttttccaatagcccagaaattgggggagagggtccttgaaagctgtgcaaccaagctgaaaccctacttggttcaagcagtgaaatccttgggtatatctgtggatgattatagtgcagtacttgcttcaatatgccaagatgtatctgatgacctggagaaaaatgatacatgtgttactagtgagcatgtggaagataagagtgagtcagcgaaacaatcactggaggagtcaacacattttgatcaggtggttaaaaaggattcaagggaagttacatcctctcagcaagaaaatcctgatgatgtgaataaatctccaaagtcagtcatgagcaatgttgttgcatgtgttgaagataatgctttagctcattccgagtccattaaaaaacaagaggatgctgattgttctaatcactctgaaggtttgaatacttctggtaatgaggtgaataatgatttggacattgaaaaagttgacaatagtaaacaaaaaacagaaaaagctaccaagaaaccacgaaagaaatcaagctcttcaattaaattgacaaaaccttccaagggtcaagttgctgctaatgagaaggaaactgagaaaatgctcgactgtgaaagcaacagcaagatagttcacagttcccctcccgaggaccattctgttgaagctgcaggaccttcagagaatgacaaagggattgatgctaagatttcgtcgccaatggcatgcaatgatgattccgaagttgttgcttctccaccaagtgagagcctctgtgatgaaaatcattctaagaaacttggacgaacaaaaaagaaagatggccctgtaaaagaagggactgcagaggatgtttcaaaggtgacagctagtgattcagaagccaaacctgccaggcggtcagtgaaaaaggcacttggtcagaaggctgatgtgaaaaaaactagtgtcgtagtttcagtaaaaaaaggaagttgggctgcaaatgatgcagatgcaaaaaagcactcagccaagaaatttgatgaaaacaaaaagggtagtggtggatcctcttcaaggcagatggaggacaagaaaaagggaggtcgggggaaagctaactctgaagcagatgttgcaaaatcatctgctattgatgtggacaaggaaatggtttcttctccaacgtctggtacaaaatcaactaaagatggaaagtcagaggagactcccaagacaaatctgaaaagggaacgcactccaggaaaagaaaatgagtctggtgtgaaggaatatggtgaaaaccttgtcggtttacgggtcaaagtttggtggcctaaggatcgtgagttttacataggtgttattgattcttttgattctgccagaaagaagcacaaggttttgtatgatgatggtgatgaagaaacattaaatcttgtgaaggaaaaatggaaggtcattgaagctgactcagatgcagatgaggaagaacgaagtgattgtgcagatcttgatgtttccactgatatgccactgaagaagaaagggaaaacaagtgctggtgaatcaaccaagcaaggaaagatggatgtttcttccaaaagcagtggagcagcagcatccaatagatcaaagggtgcatccacaaagtctagccagaagtccaaggatggcaacaaatccaaagattccaaggctaatagcaaatctgaggatggagttaatagaaaatctaaggacagcactcctaaaaatggtagcagtaaatctattgttgctgctaaaaaaatgagtaataaatccaaaaatactgatacttccaagacaagtgaatcaaaggatgatggcagtatcaaacaaaaaccttctgccaagtttaagcatgaaactccaaaaagtggaaaatccaagcaagaaaccccaaaggctgccatttccaaaggaaaacctgtcaaaagtggtggaaagactgatgttaatggtaccagcaaagcaagatctggtttattgaagagaaaagattccgagaatgagaactctgatgtttcagctggagagagagaagatgccaagggcaagagtgcaaattcatcaaaggcaaaaggaagtgagctgaagagtggaaagaagcgtcggaaaacctagaagtgggtatttgtcccccctgtttattccttaactgggtgcttctcttctgctcatcagtttactcttcttcagagcatttaattttttcttcctatggctaatgaatttaagctgtgtatgaggtagctgttcatcgttttgtggtaattatccagttggtaatagcattgttatctttagttattggttaggccagtttagttgtagtatcggttagtatctttagttattctagactagatgtatgttatttaaaggcaacactggatattatttggctagcaaccttcatttaaagaatgcttgctacttacaacttacccaa

SEQ ID NO: 9037 - DNA, 3264 bp, Glycine max
caggaaaagaaaaggaaaaaaaaaaccctaatctctggaatagcgttggattggagcgttttgagggcatcaaatcaatagagtgaagcagatcaagaggaagaggagggcacaaccaatgacaatggggtccaccgataaagaattggaagagcagcttctcgacgccggtaacaagctcctcctagatcctccctcctcagcggaggagctcctcccactcctcgaccaagtagagtgttgcctatcgagggttgagcagtcccctattgactctatgcaaaatgcactctctccatcattgaaagcattgattgcggacaaacttttaagccactcagatgatgatgtcaaagttgcagttgcctcttgcatcagtgaaataacaagaatcactgcacctgaagctccttatgatgatgctcaaatgaaggatgtctttcaattaattgtatcttcatttgaaaatctacatgataagttaagccaatcatatgcaaagaggacctcaattcttgaaactgttgcgaaagttagatcatgtgtggtaatgctggaccttgaatgtgataccctgattttggagatgtttcagcatttctttaaaaatataagggaacatcatccagaaaatgttttttcatccatggaaacaattatgacccttgttctagaggaaagtgaagatatatccttagacctgctgtctccactcctgaccagcattaagaaagacaataaggaagtttttccaatagcccagaaattgggggagagggtcattgaaagctgtgcaaccaagcttaaaccctacttggttcaagcagtgaaatccttgggtatatctgtggatgattatagttcagtacttgcttcaatatgccaagatacatctgatgacttggagaaaaatgatacatgtgttactagtgagcatgtggaagataagagtgattcagcaaaacaatcactagaggagtcaacacatgtggttaacaaggattcaagtgaagttacaccctctcaaccagaaaatactgatgtaaagatatctccaaagttggtcatgagcaatggtgttgtagaagataatgttttagctgactccaagtccattaaaaaacaagaggatgctgattgttctagtcactctgaaggtttgaatttatctggtcatgaggtgcataatgatctggacactgaaaaagttgacactagtaaacaaaagccagagcaagctaccaagaggcagcgaaagaaatcaagctcttcaactaaatcagcaaaaccttccaaaggtcaagttgctgctaacgagaaggaaactgagaaaatgcttgactttgaaagcaacagcaagaaagttcccagttcctctcacgaggaccattcagctgaagcagcaggacctccagagaatgacaatggcattgatgctaagatttcatcaccaaaggcatgcaatgatgaatctgaagttgttgcttctccaccaagtgagagcttctctgatgaaaatcattcgaagaaaattgggcgaacaaaaaagaaagatggggatgctgagggtgtttcaaaggtgtctgaaggagctagtgattcagaagccaaacctgtcaggcgatccgtgaaaagggcacttggtcagaagtctgatgcgaaaaaaactaatgtggtggattcagtaaaaaaaggaagtgggacagcaaatgatgcagatgctaaaaagcacccagccaagaaattagatgaaaacaaaaaggatcgtgatggatcatcttcaagacaaatggaggacaagaaaaagggcaggtgggggaaggctaactctgaagcaaatgtagtaaagtcatctgctatggatgtggacaaggaaatggtttcttctctgaggtctggtacaaagtcaactaaaaatgaaaattcagaggagactcccaagacaaatgtgaaaaggaaacgcagttcaggaaaagaaaatgaatctaatgcgaaggaatatggtcaaaaccttgttggtttacgggtcaaagtttggtggcctgatgatcgtgagttttacagaggtgttgttgattcctttgattctgccaaaaagaagcacaaggtcttgtacgatgatggtgatgaagaaacattaaatcttgtgaaggagaaatggaaggtcattggagctgatgactcagatgcagatgaggaagaacgaagtgatcgtgcaagtcttgatgcttccactgatatgccaccaaagaagaaagggaaaacaagtgctgttgagtcaaccaagcaaggaaagatggatgcttcttccagaagcggtggagcatcagcatccaatagatcaaagggtgcatccacgaagtctggcctgaagtccaaagatggcaacaaatccaaagattccaagactattagcaaacctgaggatgcagttagtagaaaatctaaggccagcattcctaagagtggtagcagtaaatctattgttactgctaaaaaaattggtaataaatccaaaaatactgataattcaattgaatcaaaggatgatgacactagcacgcccaaaccctctgcgaagtctaagcaagaaactccaaaaagtggaaagtctaagcaagaaactccaaaaagtggaaagtttaagcaagaaactccaaaaagtggaaagtccaagcaagaaaccctgaagactgccctttcgaaagtaaaacctctcaaaagtggtggaaagactgatgttaatggtaagaacaaggtgaaatctggttcatcaaagagaaaatattctgagaatgagtactcagatgtttgagcaggagaggtagaagatgccaaggacaagacttcatgttcatcaaagtcacaaggaagtgggtatttattctcgctgtttatttcttgactgggtgcctgtcttgtgcttacagcatttaattttttcttcctttggccagagtgatcaaatgaatttaggccgtgtatcaaggagctgtgtcgtttgtggtaatcatcttcttgttgctagcattattttctccagttattagttaggctagtttagttgtagtatgggttagtatctctagttacttttccatcttttctagtagactagatgaatgctattttaaggtaacacctgaaaatattttgctagcattcttaatttaacgaatgctttggcactccctgatgctgacaggttgactaatgactacttactagttactatccacccaattaacgtttttagattgctta

SEQ ID NO: 9038 - DNA, 1745 bp, Glycine max; identical to SEQ ID NO: 8474

SEQ ID NO: 9039 - DNA, 1546 bp, Glycine max; identical to SEQ ID NO: 8507

SEQ ID NO: 9040 - DNA, 2336 bp, Glycine max
acactttaattgctagattacctgaactcaacgatcagtagcagcacaaagacacgtgatgatgtgtgaattgtgatgacactaactaacatggcgcacaataacatcaactccaccaccatggatggcgtgcctcaccgagtcaacagcccgcgttacaccggttcgatgactcgtcgagctcactcattcaaacgcaacaacaacagcaataatgaaattgagctccaaataaactcacccagatcacccttggtttctgctgaaggctctgttttgaaaaggaatcagcatcatcataaggagaaaaagaacaagtttggccattgggtgttcttgctcttttgtggggtatgcttgtttctgggtcttctcaagatttgtgcttctgcctggtggttcggatctaaagtacacagtacacacgaatccattattcaggaactatctgactccatcactagtcgaaatctaatggatcaaagctcccatggttatgcatatagggagggagcaaatgaggttgaacgaactctaaagatggtaactacaggggtaattgatagccaggctggcatggctgaagaatcaggtgtctggtctagacccaactatgacaatttcacccaatgtatagacctgccaagaaatcataaaaagctagatgaaaagaccaatggctacattctagtaaatgctaatggtggcctgaatcaaatgagatttgggatatgtgatatggttgctgttgctaagattatgaaggcaacacttgttcttccttctctcgatcacacctcttactggggtgatgcaagtggcttcaaggatttatttgactggaaacattttattgagacattgaaggatgatatccacgtagttgagacattaccacctgcctatgctgaaattgaacctttctcgaaaactccaatatcttggtctaaggccagttactacaagaatgaggttcttcccctgctaaagcagcataaagtgatctatttcacccataccaattccagacttgctaataatggaattccaagctccatacaaaagctaagatgtcgtgtaaattatagagcattgaaatattcagctccgattgaagaattcggaagcaaattaatatctagaatgcgacagaatgaaaatccttatctcgcgcttcatttgaggtatgagaaggatatgcttgcatttactggctgcagtcacaatttgacagcagaagaagatgaagagctacgacagatgcggtatgaagttggtcactggaaggagaaggagattaatgggactgagaggagattgactggaggttgtccattaactcctagggaaacttccctattgcttagagcactaggttttccatcacaaaccaggatttatctggtagctggagaagcatatggtagaggaagtatgaaatatcttgaggatgctttccccaacattttctctcattcctctctgtcttctgaagaagagttgaatcctttcaagaatcaccagaacatgttagctggcatagactatattgttgcacttcagagtgatgtatttctctatacttatgatggaaatatggcaaaggcagtacaaggccataggcacttcgaaaacttcaagaagactatcaatccagacaaggtaaattttgttaaactcgttgataagttggatgaaggaaaaatttcttggaagaagttcagctccaaggtaaaaaggctgcatgaagatcgaatcggtgctccgtatcccagggagcggggagaatttcctaagctagaggaaagtttttatgcaaatcctctgccaggatgtatatgtgaaagaaaattagatacttcacagtaggttgtctgtcatatggttgatgccatgatgagggttgcatgtattggccattgtggctatgctgtctcagtacttctgtcttgagaaggtggaaatttgattgtacaaaagcttggttatttgataagttctatgtattggcctggatgatggacatgtttacatggggccaagaaaaagggttaagaactgagccactcagctgcattacaaattaaaggatcaagcacaggcaggtcaagtatacagtataccattcacaacacatgataatcattaaacaccataccttgaggggcaaacctcatccttaatcacactactaatgaagagtttttttttctttttcatttatagattttaaattatttaatatcttttcatgccaagaaaagatggtgagaccgaataaggggtattgttatagttcattattcaataatacaaaatattatggcttttgtgca

SEQ ID NO: 9041 - DNA, 2343 bp, Glycine max
atggcgatattctctgaatcgaatcaccatcacaacacttccgatggggtctcccagcgagtcaacagtccgcgtttctccggtccaatgactcgccgcgcccactccttcaaacgtaacaacagcagcaacaatagcaacaacaccgccaccaccacctcccacggcggcggcggaggcagtggcggcgtcgagattgagcttcaaatcaactcgcccagatcggaggaagcgtcggagggtgtgccggtggggaagcacagccaccatcacgtgacccagagagtgcacgtgagagggttgctgaagaagccccttgcgtccatcgttgaggatttggggttgagagaaaggaagaaaattgggcactggatgttcttagtgttctgtggggtgtgcttgttcatgggtgttctcaagatatgtgccactggttggcttggatctgctattgaaataactcaatccaataaggaactatctgactccattcctagtctaactctaatggacaaaagctcccttggttatgcatatagggggggagcaagtgatgttgaacgaacattaaaaacagtagcaacaggagtagacggcagccatactgccatgactgaagattcagggatctggtccaaacccaacagtgacaatttcaccaaatgcatagatcttccaagtaatcataaaaagctagatgcaaagaccaatggctacatttttgtaaatgcaaatggtggcctgaatcagatgagatttgggatatgtgatatggttgctgttgctaagattgtgaaggctacacttgttcttccttctcttgatcacacctcctactgggctgatgacagtggcttcaaggatttgtttgattggaagcattttattaatatgctgaaggatgatgtccacatagttgagaaattacctcccgcctatgctggaattgagcctttcccaaaaactccaatatcttggtcaaaggttcattattataagactgaggttcttcccctcctaaagcagcacaaagtgatgtatttcactcataccgattccaggcttgataacaatgacattccacgttccatacagaaactaagatgccgtgtaaattacagagcattgaaatattcagctccaattgaagaacttggaaacacactggtatctagaatgcaacagaatggaaatccttatcttgcccttcatctgagatatgagaaggatatgcttgcatttacaggctgcagtcacaatttgactgcagaagaagatgaagaaatgagacagatgcgatatgaagtcagtcactggaaggaaaaggagattaatgggaccgagaggagattgcttggaggttgtccattaactccaagggaaacgtccctattacttagagcactgggttttccatcacacaccaggatttttctggtagctggagaagcatatggaagaggaagtatgaaatatcttgaggatgatttccccaacattttctctcattcctctctgtcctctgaagaagagttgaatcctttcaagaatcatcagaacatgttggctggtttagactatgttgttgcccttaagagtgatgtatttctctacacttatgatggaaatatggcaaaggccgtacaaggtcataggcgctttgaagacttcaagaaaaccatcaatccagacaagatgaattttgttaaacttgttgatcagttggatgaaggaaaaatttcatggaaaaagttcagctccaaggtaaaaaagcttcacacagatcgaattggtgctccatatccaagggagcctggagaatttccaaaactggaggaaagtttttatgcaaatcctctgccaggatgtatttgtgaaacaagatagtagtagagacttccctgaaggttgtctgtcttttgatggaatggccgagctgtaatcaaaaggcgatgtggctatgccgtgatatttttttaacccttctgtcttgaggagatagcaatgtgctgggctatccggtaaggtgctattaattgcctggctgttgggataagattacaaatggccaaggtgggggcaagaatctgagattcctagctacattattaaaattaaggatcaagcacggacaggcctgagtataccactgtcaatacaatagaaattaaacaccttacatttttaagcaaacctcatctctaacctcacttttgaatgatttctttctttctttcttgattaaattttattcattacttgtaccaatagcaaggggtgggactgaataagttgtattcttattgtacaataagatgaaaataaaaatctagtttttattga

SEQ ID NO: 9042 - DNA, 2354 bp, Glycine max
aactctaatggcgatattctcggaatcaaatcaccatcacaacacttccgatggggtctcccagcgagtcaacagcccgcgtttctcgggtccaatgactcgccgcgcccactccttcaaacgtaacaacaacaacatcgccgccaacaccgccgccaccacctcccacggcggcgccggcggaagtggcgccggcgaagttgagcttcaaatcaactcgcccagatcggaggaagcgtcggagggagttccggtggggaagcacagccaccatcacgtgactcagagagtgcacgtgagggggttgctgaagaagcccctagcatccatcgttgaggatttggggttgagggaaaggaagaaaattgggcactggatgttcttagtgttctgtggggtgtgcttgttcatgggtgttctcaagatatgtgccaccggttggcttggatctgctattgaaagaactcaatccaacaaggaactatctgactccattgctagtctaaatctaatggacaaaagctcccttggttatgcatatagggggggagcaagtgatgttgaacgaacattaaaaacagtagcaacaggagatgggagccatactgccatgactgaagattcagggatctggtccaaacccaacagtgacaatttcaccaaatgcatagatcttccaagtaatcacaaaaaactagatgcaaagaccaatggctacattctcgtaaatgcaaatggtggcctgaatcagatgagatttgggatatgtgatatggttgctgttgctaaaattatgaaggctacacttgttcttccttctcttgatcacacctcctactgggctgatgacagtggcttcaaggatttgtttgattggaagcattttattaatatgctgaagaatgatgtccacatagttgagaaattacctcctgcctatgctggaattgagcctttcccaaaaactccaatatcttggtcaaaggttccttattataagactgaggttcttcccctcctaaagcagcacaaagtgatgtatttcactcataccgattccaggcttgataacaatgacattccacgttccatacagaaactaagatgccgtgcaaattacagagcattgaaatattcagctccagttgaagaacttggaaacacactggtatctagaatgcaacagaatggaaatccttatcttgcccttcatttgagatatgagaaggatatgcttgcatttacaggctgcagtcacaatttgactgcagaagaagatgaagaactgagacagatgcgatatgaagtgggtcactggaaggaaaaggagattaatgggaccgagaggagattgcttggaggttgtccgttaactccaagggagacttccctattacttagagcactggattttccatcacacaccaggatttatctagtagctggagaagcatatggaagaggaagtatgaaatatcttgaggacgatttccccaacattttctctcattcctctctgtcctctgaagaagagttgaattcattcaagaatcatcagaacatgttggctggtatagactatgttgttgcccttaagagtgatgtatttctttacacttatgatggaaatatggcaaaggccgtacaaggtcataggcgctttgaaaacttcatgaagaccatcaatccagacaagatgaattttgttaaacttgttgatcagttggacgaaggaaaaatttcatggaaaaagttcagctccaaggtaaaaaagcttcacacagaccggattggtgctccatatccaagggagactggagaatttccaaaactggaggaaagtttttatgcaaatcctctaccaggatgtatttgtgaaacaagatagtagtagagactcccctgaagattgtctgtcttatgatggcactgcaaatgctatcaaaagacattgtggctgtgctgcgatatttttttaatccttctgccttgaggagatagcaatgtgctgggctatctggtaaggtgctattgattgtctgactgttgggataaggtgacaaatgaccaaggtgggggcaagaaactgagattcctagctacaatattaaaatttaaggatcaagcacgggcaggccagaatataccactgtcaatacaatagaaattaaacaccatgcgtttttaagcaaacctcatctctctaaccacacttttgaatgattttttttctttctttattgattatattttatccaatacctgtattaatagcaaggggatggaactgaataagttgtattcttgttgtacaataagatgaaaaaatagaaatctagtttttattgatctga

SEQ ID NO: 9043 - DNA, 2583 bp, Vitis vinifera
tacaaagagggagagggagagaagaggttggctggtcggctggttgggcaatggcaatctcattgaatcgccacattcccccataaaaatctgggatcacaatcggatctcatcgtagtactctctccttttcatgggttttcaccacaacgcttctgatggagtctctcagcgagtcaatagcccacgcttctcaggtccaatgactcgccgagctcattcgtttaaacgcggcaacagcagcgggaacgctcataacaacggtagcagcaaggggggtggtgggttcgatccccactacgagattgatgtgcatctcaactcacctagatcggaaatatgtggtagccctgtttccggtgatgggtttgatgtagttttggaaaggaagcagacccatcatgtgaaccagagagttcatgggggtgttctgaagaatcagcccaagaagcatgttggatctgctgttcttgatttggggttgagggagaggaagaagttggggcattggatgttctttgtgttttgtggggtgtgcttgtttttgggtgttctgaagatttgtgccactgggtggtttggatctgccattgataggattgggtctcatcaggatttttctgaccccctcaacactcatctaaatgaaatggataaaagctctcatgattacgtatatagggagggaggaagtgatgttgaaagaactctgatgatggtagcatcaggtgtggtgaataggcagaaaagcatggctgaaaattcagatatctggtccaaacccaacagtgagaatttcacccaatgcgttaaccagccaagaattcacaaaaagctggatgcgaagacaaatggttacattatcattaatgctaatggtggattgaatcagatgagatttgggatatgtgatatggttgccattgcaaaggtcatgaaggcaacactggttcttccttcacttgatcacacatcctattgggctgatgacagtgactttaaggatctgtttgattggcaacacttcataaaggcactgaaagatgatgtccacatagttgagacattaccacctgattatgctggaattgaacctttcacaaagacaccaatatcatggtctaaggtcagttactacaaaacagagatcctcccactcttgaagcagtacaaggttatatattttactcatactgattccagacttgccaacaatggtattccaagttccatacagaaactgagatgtcgtgtaaattacaaagccttgaaatattcatccctaatagaagaacttggaaacaccttggtttcaagaatgcgagagggtggaaacccttatattgctctgcatttgaggtatgagaaggatatgctttcattcacaggctgcagtcataatttgacagcagcagaagatgaggaactacgtacaatgcgatatgaggtcagtcattggaaagagaaagagatcaatggtaccgagagaaggttgcttggtggctgtcccttgacccccagggagacttcccttttgctcaaagggctgggtttcccatctagcaccaggatttatttggtagctggtgaggcctatggtaaaggaagtatgcaatatctaatgaatgacttccccaacatcttctcccattcaacactttccactgaagaagagttgagccctttcaaggatcatcagaacagactggctggactggactatgttgttgcccttcaaagcgacgtgtttgtctatacctatgatggaaatatggcaaaggctgttcaaggtcacaggcgatttgagaacttcaagaagactattagccctgaaaagatgaattttgtaaaacttgttgatgaccttgatgaaggaaaaatcacttggaagaaattcagttccaaagtgaagaagcttcacaaagaccgagctggagcaccatacctacgagagcctggagagtttccaaagctggaggaaagtttctatgcgaacccacttccaggatgtatatgcgaaacaacaccgcaaaagtagagaccaaccctagaaagttttgtgctacttcatcccaatgtgagggtttagctgcatggatggtagttcctagggtttgttgccatctctcagggcacattcttgttgagtggcaatcttgaggtgcagtgaggcaggagaacatcaggttgttggtttcaaagtccccaagaggagtgaaactgatacaatggagttgccaaaaatgcagcttaacttaagggttgatggaagatagatggggtttgatctgctatatagaaaggatacaacagaagttaaagaaacataccactgagtttcttcactatgaaaaacaggaaaaagatactgagttttctccctacttaactacactgtaaagagccagcaatgtagaatatgatggggaaggttcatgttttgcaattaggcagagttgagctactagctgatttgaatttcttctgataatatagaggagtatgattccaaagaataacaagctgcttgaaattgctttaatcatgaatagatgtcatcgggacatggttaatctgtttcca

SEQ ID NO: 9044 - DNA, 2424 bp, Arabidopsis thaliana
gaagataaacgcaaaaaccaattcttcgtcttcttcacaaaaaagatagcaacaatcgaagaagaagagcttgaaatgggccaccaccacgacggtggcgatggcgtacctcaacatcacgtcaacagtcctcgattttccggtccaatgactcgtcgtgctcaatcattcaaacgcggcggttccgctggtagtagtagcaataataataatactcacgtcggtgttagtggcggtgatggcaacaacaacaacaacacttcctcgaccttgagagttcatcacgagatcgatctaccgcttaattcacctagatcagagattgtttctggctcttccggttcagatccgagtggtggatttgattctgctctcaatagaaaacatcagacttatggtcagttgcgagagagagttgtgaaaggcttgttgaggaagccgatgggatctgttgtctcggattttagtttgagagagaggaagaaacttggtcattggatgttttttgcgttttgtggtgtttgtttgtttttgggtgttttcaagatttgtgctactggttggcttggatctgccattgatggtgctgcttccgatcaggatttatctatcccccgagtaaatctacttgatcatagctcccatgattatatctataaagatggagggaatgatgttgatcctactttggttatggttgcttcagacgtggtgggtgatcaaaacagtgtagttgaattttcaggtgtctgggcaaaacctgagagtggaaatttctcgcggtgcattgacagttcaaggagtcgcaaaaagttgggtgctaatacgaatggctatcttctcataaatgctaatggaggactaaaccaaatgagatttgggatatgtgatatggttgcagtggctaaaattatgaaggcaactttggttcttccctcacttgatcacagctcatattgggcagatgacagtggctttaaggatctatttgattggcaacacttcattgaggagttgaaggatgatattcacatagttgagatgctgccatcagaattagccggaatcgagcctttcgttaagacacccatttcgtggtctaaggttggttactacaagaaagaggtccttccgttgttgaaacagcatatcgtaatgtacttaactcacactgattctcggcttgctaacaacgacctgcctgattctgtacaaaagcttcgttgccgagtaaattatagggcgctgaaatattcagctccaatagaggaactgggaaacgttctagtttctagaatgaggcaggacagaggtccataccttgctcttcatttaaggtatgagaaggatatgctggctttcacaggctgcagtcatagtttgacagctgaagaagacgaagaattacgacagatgcggtatgaggttagtcactggaaggaaaaagaaataaatggaacagagagaagattgcaaggtggttgtccgttgactccaagggaaacctcgcttttactgagggctttggaattcccatccagctcccggatatacctcgtagctggtgaagcatatggaaatggaagcatggatcctctcaacacagacttccccaacattttctcacattcaattcttgccaccaaagaagagctgagtccttttaacaaccaccagaatatgttggctggtttagattatatcgttgcacttcagagtgaggtatttctctacacatatgatgggaacatggcaaaagcagttcaaggtcacaggcgattcgaagacttcaagaaaacaataaatccagacaagatgaactttgtgaaacttgttgatgcattagatgagggaagaatttcatggaaaaagttcagttccaaagtgaaaaagctacataaagaccgaaacggagctccatataatagagagtcgggagagttcccgaagctggaagagagtttctacgcaaatcctcttcccgggtgtatttgtgagaatacagaagaagagggtctgatgcgacgtacataaacatggagagatgtctctagtaatatttttttagtagcctgagatttacagttagcaaaaaagaagaagggaattgtgattttttggtgtcctgaagctcgagagggtgatgattaccaaagctcaagactgagaaactggtttcagagacagattagaaaactacggagacagtatcttactagaatcgtttacaaggaagaaactccgctcaattgttaccgataaagctcggattcagctatgccatggagatttgttgaagtggatacaccgaataggattcacattgtttgtaacactctacaattgtcactatttttttataactctaaacaactttttgttgttcttttacacgcattaataacatagaatatatattgctgc

SEQ ID NO: 9045 - DNA, 2020 bp, Glycine max
tcaattcaaaaattccattttccatgggcacttctccgagccgcgagggcctcgaagtcaccgactcagattccgactacgaacacgaagaagaagaaacagagcactacgaacacgccaaaacccactccaccgagctcgatgacttggatgcgaaactcaaagccttaaaactcaaataccaaacgccctcttcctcctcctcaaaatcacttccccaaaacgctgttaagctctacctccacatcggcgccaccactcccaacgctaagtggatcctctccgacaaacgcacctcctacgcctttctcaaagactcagacgacgaaaacgacgccgtttggttcctcactgtaggttccaaggtccgcgctagggtttcctccgaaatgcaattgaagatgttcggcgaccagcgccgcgttgatttcgtagccgacggcgtctgggccctcaaattcccctccgacgacacctaccgccgattcgtcactgaatttcaaaactgcgtcttcgagaacgtgtatggaatcgaatgcacggaagaaaacaaggtcaaaatcttcggtaaagagttcatcggctgggtgaagccggaagccgccgacgattccgtctgggaggacgccttcgccgcagatccgtcgccttcgcggcggagagacgacctaatggaggaattcgaagaggccgcgaacggtggggtccaaaccctaaccctaggcgcgttggataatagtttcatggtgaacgacgccggcgtccacgtgtaccgcaacttcaaccgcgggatccacggcaagggcgtcgccgtgaagttcgccggcggtgacgccacgccgaacaaggctttgttgatgcgtgcggaaacgaacatgatgctgatgagtcccttaaaagacggaaagccccacgcttcgaagcttcaccagctcgacattgaaacggggaagattgttacggagtggaagtttggaaaagacggagttgacttaacaatgagggatatcaccaatgacaccaaagggtcgcagttggacccttcggagtcaacgtttttggggctggatgataaccggttgtgtcaatgggacatgagggatagaaagggaattgttcagaacattgccacggcgagttcttcgcctgttttgcattggagccagggacatcagttttccgcagggtctaactttcagtcctttgcgaccaccggtgatgggtccattgtcgtggggtctcttgatgggaagataaggttgtactcgaagacctcgatgaggatggcgaagacggcgtttcccggtctctgttcgccgattactagtgttgatgttacctatgatggcaagtgggtgcttggtaccacggatacttacttggtgctcatttgcaccttgtttacggataaagatgggatgacgaagaccgggtttagtgggagaatggggaacaggatacctgctccgaggctcttgaagctgactcctctggattcgcatttggctggtgcgaacaataagtttcacagtggccatttttcgtgggtcactgagaatggtaaacaagaacgccacctcgttgcgactgtgggcaagtttagtgtgatatgggattttcagcgggtgaagaacagtgcacatgaatgttacaggaatcaagaagggctgaagagctgttactgttataagatagtgttgaaggatgagtcaattgtagaatcacggtttatgcacgacaaatttgcggttagtgattctccagaagctccgttggtggtggctactcctatgaaagtcagctccatcagcctgtctggaaagcgacatggttaaacctttgtttacattttttctttaaaggtttcaaatttatttctagtgttaggagtgtctttgaagtttgaacaatgtatttgcttgtattcaagtctgaggtgctgttatttttctgtacagtgagttttaggttgccctggatgtattttctttctctttatgattacaagtttgggtttgca

SEQ ID NO: 9046 - DNA, 2213 bp, Glycine max
gcctgactaaccggtagggaccatataaaacggttaatctcaacaccccaccaaattgaatttgaaaaccaaaatcgaaatcaaaatcatttggctcctttgattcattcatcaaatcaaaaaatccattttccatgggcacttctcagagccgcgaaggcctcgaagtcaccgactcagactccgactacgaaaacgaagaagaaacagagcactacgaagacgcgaaaaccacccactccaccgagctcgatgacgtggacgcgaaactcaaagccttaaaactcaaataccaaacgccgtcttcctccgccaaaccgcttccccaaaacgccgttaagctctatctccacatcggcggcaacactcccaacgccaaatggatcctctccgacaaacacacctcctacgctttccacaaagacaccgacgaaaacgaaaacgacgatgtttggctcctcactgtaggttccaaggtccgcgctagggtttcctccgaaatgcaattgaagatgttcggcgaccagcgccgcgtcgatttcgtcgccgacggcgtctgggccctcaagttcccctccgatgacacctaccgccgattcgtcacggaatttcagagctgcatgttcgagaacgtgtacggaatcgagtgcacggaagaaaacaaggtcaaaatctacggtaaagagttcatcggctgggtgaagccggaagccgccgacgattccgtctgggaggacgccgtctccggagaaccgtctccttcgccgtcgccgtcgcggcggagaaacgatttaatggaggaattcgaagaggccgcgaatggcggggtccaaaccctaaccctaggcgctttggataatagttttatggtgaacgacaccggcgtccacgtgtaccgcaacttcgaccgcgggatccacggcaagggcgtcgccgtgaaattcgccggagatggttcgacaccgaacaaggctttgttgatgcgcgcagaaacgaacatgatgctgatgagtcccttaaacgacggaaagccccacgcttcgaagcttcaccagctcgacattgaaacggggaagattgttacggagtggaagtttggaaaagacggtgctgacttaacgatgagggatatcaccaatgacaccaaagggtcgcagttggacccttcggagtcaacgtttttggggctggatgataaccggttgtgccagtgggacatgagggataggaagggaattgttcagaacattgccacggcgagttcttctcccgttttgcattggagccaggggcatcagttttccagagggactaactttcagtgctttgcgaccaccggtgatgggtccattgttgtggggtctcttgatgggaagataaggttgtactcgaagacgtcgatgaggatggctaagacagcatttcctgggcttggttcgccgattactagtgttgatgttacttatgatggcaagtgggtgcttggcactacggatacctacttggtgctcatttgtaccttgtttacggataaagatgggaggacgaagaccggatttagtggtagaatggggaacaggatacctgctccgaggctcttgaagttgactcctcttgattcgcatttggctggcgcgaacaataagtttcacggtggccatttctcgtgggtcactgagaatggtaaacaagaacgccaccttgttgcaactgtgggcaagtttagtgtgatatgggattttcagcaggtgaagaacagtgctcatgaatgttacaggaatcaagaagggctgaagagctgttactgttacaagataatattgaaggatgagtccattgtagaatcgcgatttatgcacgacaaatttgctgttagtgactctccagaagctccgttggtggtggcaactcctatgaaagtcagctcaatcagcatgtctggaaagcgacatggttaaacctctgtttacattttttctttaaaggtttcaaatttctagtgttaggagtgtctttgaagtttgaacaatatacttgcttgtatccaagtttgagatgctgttatttttctgtaaagcacgttttaggttgccctgtatgtattttcttcttttttgtgattagtttgggtttgctgactgaattgtccttttttattacaaataataaaataattgcttatgaagaagaggcaattccaccgttatagtttt

SEQ ID NO: 9047 - DNA, 2338 bp, Medicago truncatula
aaattcacgcacaaagcaaatcaaagagcatagcagagagagagcgtgtgaggcgagtaaagtaataaccgacattaacgctataaaaccgttaactgattcttcatttccatttcaaatcccaatatactataatcaatcaatcacacccaattcaatttcaattttcaaatcttcaatttaatttctaattttgattcatgggtacttctcagtcccgcgaaggccgtgaattctccgattccgactccgattacgacgaacaagaaccagaacaagaagaagatcaagatcaataccaagacgctcaatcttcatcccaatcacattccacaaacctcgacgatgtcgacgctaaactcagtgccttaaaactcaaatactcttcaccttcaaaatcgcaatcagagacaaaaacaccacttcccaaaaacgctgtcaagctttaccttcacatcggcggcaacactcccaacgctaaatggattctctccgacaaacgaacctcctacgccttcgtcaaaaactacgaagacgaggaagaagacgaacaaaacgatgttgctcaaggtcaatggattctcaaagtcggttcaaaaatccgcgctagggtttccaccgaacttcaattaaagatgtttggtgatcaacgccgtgtagatttcgtctccaacggtgtctgggctcttaaattccccaccgatgaatcctaccggaaattcgtcactgagtttcaaaactgcacgtttgagaatgtttacggtttatcaccgacggaagagaataaggttaaggtttacgggaaggagtttatcggttgggtgaagccggaagccgcggatgattccgtttgggaagatgcagtttccgatgatggctccgggaagagtccggagccttatcgatctagaggtgatttgatggaggagtttgaagaggctgcaaatggtggtatccaaaccctaaccctaggggctcttgataacagttttttactcaatgatgctggttttcaagtgtaccggaattttgaccggggaattcggaagggggttgctgtgaaatatggagggaatctccagcaagagacgcctaataaggcgttgttgatgagggcagagactaatatgatgttgatgagtcctatgaatagtggaatgccacatgcttcgaagctgaaccagcttgatatagaaacagggaagattgttacagagtggaagtttgagaaagatggggctgatattacaatgagggatatcacaaatgatactaaagggtcacaattggatccttcggagtcaacatttttagggttggatgataataggctatgtcaatgggatatgcgtgatagaaaaggaattgttcagaatatagcaacagcgaattctccggttttgcattggaaccaggggcatcaattttcaagagggacaaattttcaatgctttgcaactacaggagatggttcaattgtggtggggtctcttgatgggaagataaggttgtattcgaataaatcgatgaggatggcgaagacggcttttccagggcttggttcacctattacaagcgttgatgttacttttgatggaaagtgggtgttgggtacaactgatacttatttggtcttgatttgtacattgttcactgataaagatgggaagacaaagactggttttggtggtcgtatgggaaacaggataggtgctcctagattgttgaagctcactcctctggattcacatttggctggaactaccaacaagtttcatggtggccatttctcatgggtcacagagaatggtaaacaagaacgccaccttgttgcaactgtgggcaagttcagtgtgatatgggattttcagcaggtaaagaacagtgctcatgaatgttacaggaatcaacaagggctgaaaagctgttactgttacaagatagtattgaaggacgagtcaatcatagaatcacggtttatgcatgacaactatgctgttagtgactcccctgaagctccgttggtggtagcaactcctatgaaagttagctctatcagtatgtccggaaagcgaacccgttaaacctctgtttatattttcttttctattttccatttgaaggtttcaaatttctagtgttaggagtgctttgaacaattaattcttgtatttagtttgtgcagaaaatgttaggttaccatgtatctcttttctttcttacactggttattttgtgattacaagtttggttttggttattacacaagtttgggtttgcaaagactgaggaaatgtcctttttaatttcgaaattaaagaaagagtagtttgttttc

SEQ ID NO: 9048 - DNA, 2825 bp, Solanum lycopersicum
gagcttctcacagtcgcgaaggtctagaactttccgatgaatcggattacgaggacgaagagggaagtagcagaacagaaagtgaagaacagtatgaagacgccgctgacgatcatgcttcgatgaggactccacaggtgagtaacagaaaccttgatgaattggattccaaactgaaagcgctaaaacttaagtatggttcgccggtgacgccgactaatctaagaaatgcggtgaagttgtacttgcatgttggcggtaatacgccgaaagcgaaatggataatctcgcagaagctgactaactatgagtttgttaaaacactgaaaatcggaggtgatgatgaagacgattacggatcgtcaagtggaggagatgagggcttttgggttttgaaggtggggaagaagattaaggttagggtttcgactgatatgcagctgaagatgtttggagatcagaggaggattgattttgtggataacggagtatgggctttgaagttttttgtggatgacgagtataggaatttcattaccaagttccaggactgcttatttgagaatgtgtatggaatggaggctacggaggctaacaaagtgaagatttatgggaaggagtttattgggtggttaaaacctgaggaatcagatgatgcaatgtgggaagatgcggattctggagtctggaagggtagtggaaagagtcccatgacaccggctagggataggcaagatttgctggaggaatttgaggaagctgctactggtggaggaatacagagtttggcattaggggctttagataatagttttcttgtgaatgattcaggagttcaagttgtgaaaaatttcagccacggaatccacgggaagggtgtttatgtgaaatttgatgagaaggataagtggtccggaggctcaactcccaaaaaggctcttttgatgcgtggagaaaccaatatgatgctaatgagtccttttaaggaagggaagccccgttcaactggacttcaccaattggatatcgagactggtaaagttgtgactgaatggaagtttgagaaggacgggactgatattaccatgaaggatataacaaatgataccaaagggtcacagttggatccttctgaatcgacacttttgggtttggatgataaccggctgtgtcagtgggacatgcgtgataagaagggaattgttcagacattagcaaatacgagttctccagtgttgaattggactcaggggcatcagttttcaagaggaacgaattttcagtgctttgccacgactggtgatggctccattgtagttggatcacttgatgggaagattcgcttgtactcgaagacctctatgaggcaagcaaagactgcattccctggccttggctctccaattacacatgttgatgttacttacgatggcaaatggatactgggcacgactgatacatatttgatcttaatatgcactttgtttacggataaagctgggaagaccaaaactggttttactggtcgaatgggaaataaaatcccagctccaagattattaaagctgactcctgtggatgcgcatatagctggggcaaacaacgagttccatggtggacatttctcttgggtaagaataacaaatttatttagctttttaacatataaatgttgcatagctaattgcaactttcatgttgcttgtttgttgaagaggccgtatgtgaggattcatgttatctccatgaaaattgttttctgtgttgtgagttcatataactcggttgttgctccttccgtgtaaactcttttgagacttcagtaaatgcgatgaccttagactgaaatgatcagtatggcataggtaatgaacctctacttcagtaaatgttctgaaacctcatgcgactagcttacaaactcaactgctattagaatattacaaatctttactttttggtcgattaaaattcaagtatctttccattaaagaacgtactcaaggtgcaaacttcaattgccgttgaaactagcaagtttcagatgagcgacaatgtagtatcttctttgcttccatattttgtttggccatagaatattcttagtagagttggcaatagattaagtagaccattacacctctttgtcaagcttcatacatttttctatgtcactgggagttatcttctttgttgcccgccctctgtcactgtgctgcagcaattcattggaatggaatatgaccaccccatagctatggaatgacagaagtatcacttgagtttgcatacatttttttacttgcaccagatccaccaaagatctggttaatgtttgttgcatgataaatttgtttgtcctagcaactcttaccctctttttgcatgacaatagattgcttggaaatctttttttctttgttagctgtttttattttttttgtgcagaataatactgtagtagcagttcatgcttgtgttttactcatccttgagctgaaagtaagcgactgatgtgacctgccttgtatgtcatcttccaggttactgaaagtggaaaacaagaacgccatttggttgcagcagtaggcaaatttagcgtgatatggaatttccaacaggtgaaggacagtgctcatcgttgctatcagaatcagcaaggcctgaagagttgttattgttacaagatagtgcccaaggatgaatccattattgagagtcgtttcatgcatgacaagtatgctgtcagtgactcaccggaggctcccctggttgtagcaacgccaatgaaagttacttccatcagcatgtcaggcaagaggcgt

SEQ ID NO: 9049 - DNA, 1999 bp, Solanum lycopersicum
atgggagcttctcacagtcgcgaaggtctagaactttccgatgaatcggattacgaggacgaagagggaagtagcagaacagaaagtgaagaacagtatgaagacgccgctgacgatcatgcttcgatgaggactccacaggtgagtaacagaaaccttgatgaattggattccaaactgaaagcgctaaaacttaagtatggttcgccggtgacgccgactaatctaagaaatgcggtgaagttgtacttgcatgttggcggtaatacgccgaaagcgaaatggataatctcgcagaagctgactaactatgagtttgttaaaacactgaaaatcggaggtgatgatgaagacgattacggatcgtcaagtggaggagatgagggcttttgggttttgaaggtggggaagaagattaaggttagggtttcgactgatatgcagctgaagatgtttggagatcagaggagggttgattttgtggataacggagtatgggctttgaagttttttgtggatgacgagtataggaatttcattaccaagttccaggactgcttatttgagaatgtgtatggaatggaggctacggaggctaacaaagtgaagatttatgggaaggagtttattgggtggttaaaacctgaggaatcagatgatgcaatgtgggaagatgcggattctggagtctggaagggtagtggaaagagtcccatgacaccggctagggataggcaagatttgctggaggaatttgaggaagctgctactggtggaggaatacagagtttggcattaggggctttagataatagttttcttgtgaatgattcaggagttcaagttgtgaaaaatttcagccacggaatccacgggaagggtgtttatgtgaaatttgatgagaaggataagtggtccggaggctcaactcccaaaaaggctcttttgatgcgtggagaaaccaatatgatgctaatgagtccttttaaggaagggaagccccgttcaactggacttcaccaattggatatcgagactggtaaagttgttactgaatggaagtttgagaagaacgggactgatattaccatgaaggatataacaaatgataccaaagggtcacagttggatccttctgaatcgacacttttgggtttggatgataaccggctgtgtcagtgggacatgcgtgataagaagggaattgttcagacattagcaaatacgagttctccagtgttgaattggactcaggggcatcagttttcaagaggaacgaattttcagtgctttgccacgactggtgatggctccattgtagttggatcacttgatgggaagattcgcttgtactcgaagacctctatgaggcaagcaaagactgcattccctggccttggctctccaattacacatgttgatgttacttacgatggcaaatggatactgggcacgactgatacatatttgatcttaatatgcactttgtttacggataaagctgggaagaccaaaactggttttactggtcgaatgggaaataaaatcccagctccaagattattaaagctgactcctgtggatgcgcatatagctggggcaaacaacgagttccatggtggacatttctcttgggttactgaaagtggaaaacaagaacgccatttggttgcagcagtaggcaaatttagcgtgatatggaatttccaacaggtgaaggacagtgctcatcgttgctatcagaatcagcaaggcctgaagagttgttattgttacaagatagtgcccaaggatgaatccattattgagagtcgtttcatgcatgacaagtatgctgtcagtgactcaccggaggctcccctggttgtagcaacgccaatgaaagttacttccatcagcatgtcaggcaagaggcgttgacttaggaactagttgactgttgattgattgatcagtgtgcaagaagatttatctagtgtgtatatagggtggtcctagt

SEQ ID NO: 9050 - DNA, 2215 bp, Arabidopsis thaliana
aaattttccaatttcctttcgatttcgcccagaaatttcggtaactttcagattctgttcagaacgaagaaacttgttatttttggctacttctctccgattctgttcttcttgtagtagctgatcgcattccatgggtacttctcagagtcgtgaagatcgaatcagcgaatcggatacagaatccgattcagattactatgaagaagaagacgaggatcaatacgatgacgcgaagaagcaaggatcatcatctgtttctggtacaagaccgtctgattcttcttcttcttcaggaccaactgattcatcgtctctcgatattgagcagaagctaaaagccttgaagttgaaatacccatcttcttcttccgtaacacccaagatgaagaacgctgtgaagctttaccgccatatcgggggaaacacacccaaagcgaaatggatcgtttcggataagatgacatcatacaagtttgtgaaaacttcgtcagtggatggagaagatattgatgattatgatgattgtgaagaatcaggtgaaggaggtgagtctttttggtttctgggtgttggtactaaggttaaagctagggtttctacggatatgcagttgaaaatgtttggggatcaacgtagggttgactttgttagtaatggtgtttgggctttgaagttcttgacggatgaggattataggaagtttgttactaggtttcaggactatctgtttgagaatgtgtataagatcagggcaagtgaggagaatagagttaaagtgtatggtaaagatttcattgggtgggctaatcctgaggctgctgatgattctatgtgggaggatgctgaagctccacctgaggaagaggaaactcaggggaagaggaatacggatttgacggaagagtttgaagaggtggctaatggtggagtgcagagtttgactttgggagcgttggataattcgttcttggtgaatgattatggggttcaggtttataggaatatggagcgtggtattcatgggaaaggtgtgtgcgtgagatttgattctggaaactcaaagttcggatcagggtcaagccagacaacaccgaacaaggctcttttgatgagggcagagactaatatgatgctgatgagtccagctaaacaagggaaacctaactccactggtgttaagcagctcgatatagagtcagggaagattgttactgaatggaaatttgagaaagacgggactgaaatcacgatgagagacataacaaatgataccaaagggtcgcagctagatccatcagagtcaacgtttttgggattggatgacaataggctgtgtcaatgggacatgagggataggagaggtatagtgcagaacattgactctcccatcttggaatggactcaaggccatcagttctctagaggaacaaatttccagtgctttgcaactactggagatgggtcaatcgttgtgggatcacttgacggaaagataagactttactcaaagacctcaatgagaatggcaaaaacggcttttccagggctcggttcaccaattacacatgtggacgtttcttatgatgggaaatggatactgggcaccacagatacgtacttggttcttatttgcacccttttcacagacaaaaatggtctgacaaaaacaggctttagcggaagaatgggaaacaaaataccagcccctaggctgctgaagctaacaccactagattcacacttggcaggaaaagataataagtttcatggcggtcacttctcatgggtaactgagagtggaaagcaagagagacacatagtagcaacagtggggaaattcagtgtgatatgggacttggagcgggtgaagaacagtgcacacgaatgctataggaaccaacaaggactcaagagctgttactgctacaagatcttgttgaaggatgagtcaattgttgagagccgattcatgcacgataacttctccttctccggtaacaaatcgccagaagcaccgcttgtggttgccacgcctttgaaagtcagctccatcagcctctctggaaaacgactttaaataaccagtttgtatcgtaaagctttcttttgtttttgtaatgaaatttgattgtagtgtttggctttttgtcatcgtgtgaaggtttgtgaatgagtgacattttgctttttactcaaatatgactactcaaat

SEQ ID NO: 9051 - DNA, 2891 bp, Vitis vinifera
ccttctcagagccctgatttgcccaatgctgtcaagctctaccttcacatcggtggcaacgcccccaaagcgaaatggattgtttccgagaaaattgccttctattccctcgtgaagacgtgtaaaatggacggtggtgatgaggatgaggatgacggtgagggtggtggtggcagtgggagtgagttgttctgggtgttgaaggtggggtcgaagattcgagctagggtttccacggagatgcaaattaagatgtttggggagcagaggagggttgattttgtgtgcaaaggcgtgtgggcgatgaagtttttcagggatggtgactatcggagttttgtgactcggtttcaggattgcttgtttgagaatgtgtatggggtgaaggcgacggaggagaataaagtaaaggtttatggaaaagactttatcgggtggttgaagccggaggtggctgacgattccatgtgggaggatgccgaggaggggccgtggaaaagccctcaggcgagatcgaccaatgatttgatggaggagtttgaggaggcagccacaaatggaggaatccaaagcttggcgttgggggcattggataatagtttcttggtgggtgattcaggtgttcaggttgttaagaattttagccatgggattcatggaaagggggttcatgtcaaatttgataatggggggtataagggaggtgcaaccccaaagaaggggcttttgatgaaggcggagacaaacatgcttcttatgagcccattgaaggatgggaagcctcatgcaacagggcttcaccagcttgatattgagacggggaagattgtgaccgaatggaagtttgagaaggatgggacagatattaccatgagggatgttacaaatgatgctaagggttcacaattggatccttcgcaatcaacctttttgggattggatgataatagattgtgccaatgggatatgcgggagaagagagggatggtgcagaatatcaccactgctagttcacctgtattgcactggacacaagggcatcaattctctagagggacaaattttcagtgctttgctactactggagatggttcaattgttgttgggtcactggatgggaagataaggttgtattcgaggacctctatgagacaggctaagactgcattcccggggcttggctcacctattactcatgttgatgttacatatgatgggaaatggatattgggtacagcagacacttttttgatccttatctgcacttcgttcactgacaaggatgggaagacaaagactggattcagtggtcgtatgggaaataagatcccagctcccagactgttgaagctgactcctgttgattcacatatggctggggtggataataaatttcacggtggccaattttcatgggtaagttgattcatgtcttccatatttcatgctatgtcttgcttgatccatacatttctatcttggtcatttaaatttggctgataagagcttacatgatattttgttagtttgttgcaggttattcattgtcacttttgttgttggcaatcctgttcaatttcagcttttcttttcacactctttgtgcatattatcagaatcacatttcttgttaatagcataactaaaaaggaaaaatcatgtcctttgctagtgtttttcgggttcttcaacctgtctttttttataggtttcaacctgaatattttgaaatcacgcctttttccccatttgaagactggatattttagaatattgctagacttgttcctttggatgcagttgtcagtttgaacctgttgaacccctctcaatctaactgatttggaaagtttggaagactgaggtgaatagtttctcactaaataaaaaatgattgggctaattgatttaggttaatttgtgattggaggcaattttatagggaaatttgcttcacttatatgccagaatggtttttttagatatttgatctaaactgatttagaaaatttggaagactgaaatgaatagtttctcaccaaataaaaatgattgagctaattggtttttaggttaatttgtgattggaggcagctttaagggagatttactttacaaggatgcgagaatgtggtttttattggatatcaatgtcacattggtttttgtttggattatgtggttgcatatactggagatgaaagtacgctattctacattctaatgctagatttgaggaagcatttgtggagatactttgttattcttctgaaataatttgtttttcacttttggggttgttggggctggggggtgggggggggaggggggggaggagggtaggggagaagaaaaatagctcaggtgggtgcatgcaacttgaatacttcttttgccaccttcaaacatggattcttataaaagagcaagtgatgccttttttttcaattaacaaaacaccatggatcttttagaatttctttaaacttcgaatacactccatgtttctcatttcagttccagtcgtcaaagataaactattggactactcgtcaaaaaaaaaaaaagcaattggactgatggatgtgttgcattttatattgtatttccaggtgactgagaatgggaaacaagagcggcatctagttgcaacagtgggcaagttcagcgtgatatggaacttccagcaggtgaaaaacagtagtcatgagtgctaccagaatcagcaagggctcaagagctgttattgttacaagattgtactgaaggatgaatccattgtcgagagtcgattcatgcacgacaagtttgcagttagtgactcaccggaagctccactggtggtggcaaccccattgaaagtcagctctttcagcatttctaataagcga

SEQ ID NO: 9052 - DNA, 1234 bp, Glycine max
gttcagtgttgttttttcaattcagattcagaaggagacgatggaagaacccgtgaaggaacagcccctctctgctgggaactctgcgcgacccaagcttcagagatacgcgcttcgttcgtcctctaaatccaaggaaaacaagcaagacaccgcacccgatctctccatttcttctgaatctaagagggggttaagtactccacacgtaagcagaagtgtaggtggtcttgatttctctggcaacaaggataagtctactagtgctaaaccaccaagaaggctctccaatcctgtgaaagcagcatctcccactccaaaccctaagttggttggcaacattaccccaatctcagagagcagaacaatgaggtctggtaaaggtcaagtgtctcaaagcagaagccagacaccggcctctgacatttccagaacatcgagcagaatgaagttcaatctcttatcttcctcttcatattggctaaaccagatcaagctctctgagtctgctgataagcacacagtttcacttggattcttcaaacttgcctcggaggcaagatgtgagccgttccagaagatgaaagatgagctaaagtcttatgtgcaacgacatcagcttgctgaacttggagaagtgaaagagctgcttcaaacctatgacattgctgaaaatatagagcagccacaagtgtctgagagcatttcacaggtgccagaagagggaactcgatcctctgatgatgaagaagttcactgcagttctgcatccaccatggagactgtaaaactgaaacccgaacccttggacactgaatccactgaacctgctcctgttataatagagtcaaccaagaaggaaactagccaaaagaaaaatcccttggacactgaatcaactcaacctactcctgttaaaatagagtcaatcaagaaggaaagtagccaaaagaataaccctggatccaggttgagagaaaatctcaagaagaactctgcaaattcaagacctgcttctgacaatgggagttctaggttgtttaaaaaaccagaaaaaccaactaagcaactaaccaataagggaaaaagcgaggtcaagaaagaaggaaagaaatctgatgttattaaagctccaatcagccctacgcatgctgaaaataataatgcacagggaaacaaagaaaatatggatgttcagaccactgatgagatgagtttgacagaaatcgcgtaa

SEQ ID NO: 9053 - DNA, 1164 bp, Glycine max
aacattcgattagtgttgctttttcaatttcagattcagaaggagacgatggaagaacccgtgaaggaacagcagcccctctctgctgggaactctgcgagacccaagcttcagagatacgcgcttcgttcctcctctaaatccaaggaaaacaagccagacgcacctgatcgctccatttcttctgaatctaaacgcgggagggggttaagtactccccgtctaagcagaagtgtatgtggtcttgatttctctggcaacaaggacaagtctactagtgctaaaccaccaagaaggctctccaatcctgtgaaagcatctcccactccaaacctaaagttggttggtaacattaccccaatctcagagagcagaacaatgaggtctggtaatgtccaagggtctcaaagcagaagccagacacccgcttctgaaatttcaagaacatcaagccgaatgaagttcaatctcttatcttcctcttcatattggctaaaccagatcaagctctctgagtctgctgacaagcactcagtttcacttggattcttcaaacttgcctcggaggcaagatgtgagccgtttcagaagatgaaagatgagctaaagtcttatgtgcaacgacatcagcttgctgaacttggagaagtgaaagaactgcttcaaagctatgacattgcagaaaatatagagcagccacaagtgtctgaaagcattacacaggtgccagaggaaggaactggatcctccgatgatgaagaagtgcactgcagttcttcgtccaccatggacactgcaaaactgaagcctgaacccttggacactgaatccactgaacctgctcctgttaaaatagagtcaaccaagaaggaaactagccaaaagaataaccaccccggatccaggttgagagaaaatctcaagaactctgcaaattcaagacctgcttctgacagtgggagttctagattggttaaaaaatcagaaaagccaactacgcaacaaactaataaggaaaaaagcgaggtcaagaaacaaggaaagaaatctgatgttataaaagctccaattagccccacacatgctgaagataatgcacagggaaacaaagaaaatatggatgttcagacccctgatgagatgattttgacagaagtcgcgtaa

SEQ ID NO: 9054 - DNA, 1234 bp, Glycine max; identical to SEQ ID NO: 9052

SEQ ID NO: 9055 - DNA, 1983 bp, Glycine max
atggtgactgagaattgtctttatcaacttggattaaattgctcacttctcgaagaggttgatcttactgattgctttggtattgatgacatagctctaagatatctatcaagatgttcagaacttgtaagattgaaattaggattatgcacaaacatatcagacataggattggcacacattgcttataactgcccaaaaatgactgaacttgatctctatcgatgtgtacgtattggagatgatgggctagcggcgctaacgagtggatgcaaggggttgacaaacctcaacttgtcatattgcaatagaattacatatagagggttgaagtatatctgccatcttggtgaactatctgatctggagttgtgtgggctttcaaatatcacaagtgttgaagagaaaagggtttgtttggatatggaaggtgacgagcacatgaacgaggttccatcagagaacagcaacttgggaagtgattctttggaaaaggagaacattttggaagatgaaaaggaggatttgcaagatgggttgaagttgaaggtggtcactgaggaagtgagtggaggattgctcgctgagaatggttgcatttctcttgaggatgggagtctcaaaagaagccttgagactgttggaacatccgtatcaggtgctaaaagagctcgaattacagttgatgaatatcaaccttcagttcattttacgtataattccctaacaagagctagtagacagaagcttcaggaacttctacagaaatggtcagcatggcatgctaaacatgtttcgtcatccagtgatgctagcgaagtgttggaatccggtgaggagacattttttcctgctttgcatgttggacttgaaaagacttctgccgtgtcattctggatggagaaccaaacaagaaatgataagaacaaagatttcattcctttagctgataatactgtgcctctatatgatcgtggatatgctttgggattgacttcagctgatggctcaagtaatgtggatggtggtctggagattattgatgctgctgctaggtgtttcaattgtggttcttacaaccactctttgagagagtgtccaaggccccgtgacaacattgctgtcaataatgctcgcgataaactcaagtcccgacggaatcagaattcttcttcccggcatccaactcgttattatcagaattctccagctggaaagtatgatggtttgaggccaggatctctggatgatgcaacacgtaaacttttgggcttgagggagcttgatccacctccgtggcttaacagaatgcgagaactaggatacccacctggatatcttgatgtggacaatgaggatcagccttctggcattacaatattcactgatagtgagattgctgaccaagaggatggggaaattatggaagctaatgcttccaaaccaaagcgtaaaaagactgtcaaatttcctggaataaatgctcctattccagaaaaagcggatgaaagattgtggggcactagggctggaccctcgagttcagatatatcaagaaacttgtcattgccacagcacaggtcgaattatagtactgattatggcagtcgaggatatcatcgcgaacatagattaggggatcttagggatgaaggtccaccaggggacccaggacatagttcatttatgttcagttttcatcctaggtttggtggccatgattctgcactaagaagtccttcaatggcaaggtctcaatctgacaggagtagaagtcctatgcatgatgaagaatcctcaatgcctttttctttccattctcttcattattcatcttcagagaggcatttttcgcccttggaccgagattctggtagactagggagctggacctctgaaagtatgtattatgacagggaccgtgttttttcgtctcgatttatggacaggttcgacgatcgtcactaccgcagttggaggtga

SEQ ID NO: 9056 - DNA, 1125 bp, Medicago truncatula
gcagaaaagtgcgtttcactatcacactctgaagtgattctctcaacagattcggtgttttcgcacattttcttcggatcttaattctcaccatgaatcgcaaccacgatcccaatcctttcgaagaagaagaagtcaatccattttcgaatggtactggatcaaaatcacgtgttccctcagtggcttctgaaccactaggctttggtcaaagacatgatgctactgttgatattcctttggagacttcaaatggggactccaagaaaaaaagtcaagagctagcagtgtgggaagctgatttgaaaaggagagagaaggatataaaaagaagggaagattctgttgctaaagctggtgtgcctgttgatgataagaattggcctccatttttcccaatcattcaccatgatattgccaatgagattccagttcatgctcagagattgcaatattcagcctttgctagttggttgggaatcgttctctgcttagtttttaatgtagttgcagtgattgtctgttggatcagaggcgggggtgttaaaatatttttccttgcagtgatttatgcgctgcttgggattcccctttcatatgtgctttggtacaggcccctctatcgtgctatgaggactgatagtgcactgaagttcagttggtttttcatgttctacttgcttcatatagcattttgcatctttgctgcaattgcacctccagttgtttttcatggaaagtcattaacgggcatccttgcagcgattgatgtgttctcagaccatgtattggttgggatattctatttgattggatttggtctgttttgcttggaggctcttctaagcttgtgggtaattcagagaatatacatgtttttccgggggcacaagtgagactatgctcaagattttgttctagcggcttttatagtgtcagtcactatccagcgtggcctagtatattctcttttttctcaatcctcttctccattctttgcaatatctttgtgtggtattgttctgttgtttgtctgtagtgattgtaccatagttttgtctgtacttgacagtatagtgagaattatgtgaaactgattatgtttttagaatctctagaaagttg

SEQ ID NO: 9057 - DNA, 1204 bp, Glycine max
caggtagctagaaaaagcgataaaagtgcggtctctcaccgcacgcactagcactgtctctcactgaaacttgttcgcacattttcacggatctaactaagttatcgccatgaatcgccaccacgatcccaatcccttcgaagaagaagaagtcaatcctttttcgaatggcactactgctcctgcatcaaagtcacgtattccaccattagcatctgagtcactgggctttggtcaaaggcatgatgctacagttgatattcctttggatactacaaatgactccaagaaaaaaggtcaagagctagcagcttgggaagcagatttaaaacggagagagaaggaaataaaaagaagagaagaggctgtttctagagctggtgttcctgttgatgataagaattggcctccatttttcccaatcattcaccatgatattgccaatgagataccagttcatgctcagaggcttcaatatttggcctttgcaagttggttaggaattgttctttgcctaggttttaatgtagttgctgtgactgtctgttggattagaggcggcggtgttaaaatttttttccttgcggttatatatgctctacttggtgttcccctttcatatgttctttggtacagacccctctatcgtgctatgaggacggacagtgcactgaagtttggttggtttttcatgctctacttgcttcatattggattttgtatctttgctgcaattgcacctcccattgtttttcatggaaaatcattaacgggcatccttgctgcaattgatgtcttctcagaccatgtattggttgggatattctatttgattggatttggcatgttttgcttggaggctcttctaagcttttgggtgcttcagaaaatatacatgtatttccgggggcataagtgagactttctcctcaggattttgctccgggcttctataatgtctgtcacttcacaatgtggctcagcatattctttttgtctatcctcatttttctcttacaatatctgggtgtgatattggtcgtgttctttgtagttaccagtgtttagtttgtactatacagtataatgaattctgtgaagttcagtatctctacttgtgtgtttccctccagtgaaaagaatatttgctttcgattagcagatatatagtgaatttccaatgaactattattttattggtatt

SEQ ID NO: 9058 - DNA, 1371 bp, Glycine max
atcaattccaaaactatatcccgcgttacgaacaagccaggtagccagaaaaaagggagagaagtgcggtctctcaccgcacgcactagcactgtctcactctctcacgcacgcatcatctcaaacttcttcgcactttttcacggatctgatctaactaagttctcgccatgaatcgccacaacgatcccaatcctttcgaggaagaagaagtcaatcctttttcgaatggtggtgctgctcctgcatccaaatcacgtattccaccattagcatctcagccactgggctttggtcaaaggcatgatgctacagttgatattcctttggatactacaaatgactccaagaaaagaggtcaagagctagctgcttgggaagcggatttaaaacggaaagagaaggaaataaaaagaagagaagaggctgtttctagagctggtgttcctgttgatgataagaattggcctccaattttcccaatcattcatcatgatattgccaatgagataccggttcatgctcagaggctgcaatatttggcctttgcaagttggttaggaattgttctctgcctagtttttaatgtagttgctgtgactgtctgttggatcagaggcggcggtgttaaaatttttttccttgcggttatatatggtctacttggtgttcccctttcatatgttctttggtacagacccctctatcgtgctatgaggacggatagtgcactgaagtttggttggtttttcatgttctacttgcttcatattggattttgcatctttgctgcaattgcgcctccaattgtttttcatggaaaatcattaacgggcatccttgctgcaattgatgtcttctcagaccatgtattggttgggatattctatttgattggatttggcatgttttgcttggaggctcttctaagcttatgggtgcttcagaaaatatacatgtacttccgggggcataagtgagactgttctcttctggattttgatccgacggcttttataatgtcaatcacttcacaatgtggcttagcatattctttttgtctatcctcattttctcatacaatatcttggtgtgatattggtcttgttctttgtagttaccagggtttagtttgtatcagggtttagtttgtttgtaccatactgtgtaatgaattctgtgaagttcagtatctcttctagagtgtttcgctccagtgaaaagaaaatatgctttcgataagcagacatgtagtggatttccattgaagtattattgtatggtattgcagttgtgatgcgcctcaaaaaagctagtcctctagacaagaaaaaaaaaatacaaaaattcactagcatacgttgtgaatga

SEQ ID NO: 9059 - DNA, 816 bp, Nicotiana tabacum
atgagtagaggaaacgatccgaatccgtttgacgaagaggagcctgaagtcaatcctttttcaaatggtggctctgcgcctgcatctaaatcacgctttcctcaaatgattgctagtagtcttggttttggtcaaaagcatgatgcaactattgacatcccattggattctacgaatggttccaataaaaagcaaaaagaattagcaaattgggaagcagatctgcaaaggagagaaagagatattaaacgaagagaagatgctgttgctggcgctggtgtgccaactgatgataggaattggcctccctttttcccaattattcatcatgatatagcaaatgaaataccagctcattctcggaagctgcagtatttggcatttgcgagttggttaggtattgtcttttgtctggcgttcaatgttcttgccgtgactatctgttggattaggggtggtggtgttaaaatctttttcctggctataatatatgctttaatgggatgtcccctttcgtacgttttgtggtacaggcctctgtataacgcgatgaggactgacagcgcactgaagtttggctggtttttcatgttctacttgattcacatcggattttgcatacttgctgctattgctcctcccattgtatttcacggaaaatccttaacgggtatccttgcagcaattgatgtcttctctgaccatgtgttggttgggatcttttatttgattggatttgccttcttctgcttggaagctttgcttagcttgtgggtgctgcagaaagtgtacatgttttttcgagggcacaagtaa

SEQ ID NO: 9060 - DNA, 1168 bp, Populus trichocarpa
ggcaccagaacaacaacacttcttaacgacgagtgtgtttctctgtctaaaaacacacgcccatcgacactttcctctctctaaaagttttgtgttctgtttgtcaaattggggatctgaaagaattcaagaactatgagtcgattcaacagcgaccctaaccctttcgatgaagaggaagaagtgaatcccttctcgaagggctcaagtgttcctgcagtaaaggcacgcattcctcctttggggcatgaaccaatgggatttgggcacaatgatgcaacagttgacattccgcttgatacaatgaatgactcaaagaaaaaggagaaagatcttgcatcttgggaagcagatcttaaaaggagggaaaaggaaatcaagaggagggaagatgctgttgctaagactggcatcaccccagatgataaaaactggccaccattttttcccatcatccatcatgatatagcaaatgaaatacctatccatgctcaaaggctacagtatttggcttttgccagttggttaggtatagttctatgtcttgtcttcaatttaattgctgtgacagtatgttggattagaggtggaggtgtcaaaatttttttccttgccgtaatctatgtgctgatgggatgtcctctttcatatatcctatggtacaggcctctctatcgagcaatgaggacggatagcgcattgaagtttggctggtttttcttgttctacctgatacatattggtttctgtatatttgctgctattgctcctccaattgtcttccatgggaagtcactgacgggcatccttccagcagttgatgtcatttctgatcatttgttggtcgggattttctacctggtagggtttggcctgttttgcttagagtcacttcttagcttgtgggtccttcagaaaatttatatgtatttcagggggcataagtgagaatttaggcgtgggactcgattcagtttttcaagtgttgctgcttcgcggggtggtttagtatattcctttttctatagctatatacatgttcatttctttgtagtgattattatgtgagttgatacaatccgagcgagcattatatttcaaaaattactgagctgttcagacttcagcatcaatattaaaaaaattatttctaaaaaaaaaaaaaaaa

SEQ ID NO: 9061 - DNA, 1138 bp, Vitis vinifera
gcttgttgtgctgtgttttctctccaaccaaacacactatctacttttttttctctctccatctctaaaaacagacatgattcgtcaaaacgatccgaacccgttcgatgaggaagaggtcaatccattctcgaaggttgctactgctcctggatcaaggtcgcgcgttcctccagctgcgtctgcaaacctgggatttaatgacaaatatgatgctactgtagatattccattggacacactgaatgattctaacaaaaaagagaaagaacttgcagcttgggaggctgatttgaaacggaaagaaaaggacataaaacggagggaagatgctgtgtcaaaaaaggggatcccaactgaggataaaaactggccttcgttctttcctattatccataatgatatagccaatgaaataccggttgatgctcaaaggttgcagtatttggcttttgcaagttggttaggaatagttctttgtcttgtattcaatattatcgcagtgactgtttgttggattaaaggcgggggtgccaaaatctttttgcttgcaatcatctatgctttggttggatgccccctttcatatgtgctgtggtataggcctctctatcgtgcaatgaggacgaatagtgctctgaactttggttggtttttcctggtgtacgctatacacatttgtttttgtatagttgctgctattgctcctccaattgtctttgaagggaagtcattgacgggcatcctttcagcaattgatttgttctctgaccatgtgcttgtggggattttctacttaattgggtttgccttgttttgcttagagatgcttctaagcttatgggtgattcagaaagtttatttgcgtttcagagggaggaagtgagacatccgattgcttcttctggttttgaatagcatttcagaattgtagtgttggccacatattgaactggcttagtagtattcttattttgttcgtcatattcatcattgaggatgattactggattaaaaaataaaatgatttgcctaattaatagatagatgatgatatattgctgggtttgaaaggctattttatcttggcttgtcaatatgagttgtggtataactaaaaattgtgttgatttattac

SEQ ID NO: 9062 - DNA, 1551 bp, Glycine max; identical to SEQ ID NO: 8472

SEQ ID NO: 9063 - DNA, 1639 bp, Glycine max; identical to SEQ ID NO: 8471

SEQ ID NO: 9064 - DNA, 1677 bp, Glycine max; identical to SEQ ID NO: 8473

SEQ ID NO: 9065 - DNA, 1745 bp, Glycine max; identical to SEQ ID NO: 8474

SEQ ID NO: 9066 - DNA, 1761 bp, Glycine max; identical to SEQ ID NO: 8475

SEQ ID NO: 9067 - DNA, 1383 bp, Medicago truncatula; identical to SEQ ID NO: 8476

SEQ ID NO: 9068 - DNA, 1630 bp, Glycine max; identical to SEQ ID NO: 8485

SEQ ID NO: 9069 - DNA, 1191 bp, Glycine max; identical to SEQ ID NO: 8484

SEQ ID NO: 9070 - DNA, 756 bp, Glycine max; identical to SEQ ID NO: 8554

SEQ ID NO: 9071 - DNA, 1189 bp, Glycine max; identical to SEQ ID NO: 8555

SEQ ID NO: 9072 - DNA, 1211 bp, Glycine max; identical to SEQ ID NO: 8556

SEQ ID NO: 9073 - DNA, 2004 bp, Glycine max; identical to SEQ ID NO: 8502

SEQ ID NO: 9074 - DNA, 2062 bp, Glycine max; identical to SEQ ID NO: 8503

SEQ ID NO: 9075 - DNA, 2067 bp, Glycine max; identical to SEQ ID NO: 8504

SEQ ID NO: 9076 - DNA, 1090 bp, Glycine max; identical to SEQ ID NO: 8465

SEQ ID NO: 9077 - DNA, 1029 bp, Glycine max; identical to SEQ ID NO: 8466

SEQ ID NO: 9078 - DNA, 1412 bp, Glycine max; identical to SEQ ID NO: 8467

SEQ ID NO: 9079 - DNA, 1278 bp, Glycine max; identical to SEQ ID NO: 8468

SEQ ID NO: 9080 - DNA, 2062 bp, Glycine max; identical to SEQ ID NO: 8503

SEQ ID NO: 9081 - DNA, 2004 bp, Glycine max; identical to SEQ ID NO: 8502

SEQ ID NO: 9082 - DNA, 1149 bp, Glycine max
cttggtgctggagcaagcaaagattaaagagaacaaagcttaaaccaaatatctagttactgctcaaaactcaatatatggttataaactgtacattaatgctgagcttcttgagtttgaagaatttatcaaaaggattgattttagtgggcttagtcagattgatctaagaaaaccatacaattctcttaatcctctcaattgtcatctgaagaccagtttctttataatgctgaaatcaaaagcttgggagaactaagtgatgttaaaaagtgaccaattgtatcaccgtggcaaccattgacaaaatatttgtgggaaatgggtggagctatgaaggctgcccaaaatgctttaagaaagttgaggcgcccccatgcaggttgtgcaaatgattgctcaactactattacaagtttggttgagaaaggtcaatggtttgatgtcgttaatgctgataggatcaagagtataaatgattttgctaacttttttgcctacaagttgattccagagtacaatattagagtccaagtgtatgatggaactggtaatgcctgctttaaattaccatataaggatgtcaaaatattactgaaaatatcgtgcaaagatattgttttacacattgagggtccatatgctcaggagttaccagcactactgtatgatctaaatggattggacctattatttttagtagacacaagaattgaaggatcagctacatcaagtagcaatgttagcgatcatgatgggtactctgtgtctgaaatatgtcatgagaaggagattttgagaatgctccagagaggggaacactatttccaatttgatgaggggcaagctaaacgtgctctctgtctatctgtcaaggaaaacaaattgaaggtaaccaaacaacatcatgctcctggttgtattgattgagatggtaaagaaacaaagtaaaatgcttttatcaaagtgtatctgatgctgctgatgtggaattacttttgtcaacaaatcaaagtctgctgaaatacagaagtagtctgattggtgtaatatgttttattgaacaaacctatctttatattatgcatatgtagtttaacttttgttcagacttgatttttaaaaatctgataagctaacttcttcata

SEQ ID NO: 9083 - DNA, 1745 bp, Glycine max; identical to SEQ ID NO: 8474

SEQ ID NO: 9084 - DNA, 1677 bp, Glycine max; identical to SEQ ID NO: 8473

SEQ ID NO: 9085 - DNA, 655 bp, Glycine max; identical to SEQ ID NO: 8514

SEQ ID NO: 9086 - DNA, 734 bp, Glycine max; identical to SEQ ID NO: 8515

SEQ ID NO: 9087 - DNA, 886 bp, Vitis vinifera; identical to SEQ ID NO: 8570

SEQ ID NO: 9088 - DNA, 925 bp, Betula platyphylla; identical to SEQ ID NO: 8571

SEQ ID NO: 9089 - DNA, 2067 bp, Glycine max; identical to SEQ ID NO: 8504

SEQ ID NO: 9090 - DNA, 1546 bp, Glycine max; identical to SEQ ID NO: 8507

SEQ ID NO: 9091 - DNA, 1643 bp, Glycine max; identical to SEQ ID NO: 8508

SEQ ID NO: 9092 - DNA, 1266 bp, Glycine max; identical to SEQ ID NO: 8509

SEQ ID NO: 9093 - DNA, 655 bp, Glycine max; identical to SEQ ID NO: 8514

SEQ ID NO: 9094 - DNA, 1163 bp, Glycine max; identical to SEQ ID NO: 8486

SEQ ID NO: 9095 - DNA, 1077 bp, Glycine max; identical to SEQ ID NO: 8487

SEQ ID NO: 9096 - DNA, 1122 bp, Glycine max; identical to SEQ ID NO: 8488

SEQ ID NO: 9097 - DNA, 1630 bp, Glycine max; identical to SEQ ID NO: 8485

SEQ ID NO: 9098 - DNA, 1412 bp, Glycine max; identical to SEQ ID NO: 8467

SEQ ID NO: 9099 - DNA, 1745 bp, Glycine max; identical to SEQ ID NO: 8474

SEQ ID NO: 9100 - DNA, 1639 bp, Glycine max; identical to SEQ ID NO: 8471

SEQ ID NO: 9101 - DNA, 1677 bp, Glycine max; identical to SEQ ID NO: 8473

SEQ ID NO: 9102 - DNA, 2004 bp, Glycine max; identical to SEQ ID NO: 8502

SEQ ID NO: 9103 - DNA, 1090 bp, Glycine max; identical to SEQ ID NO: 8465

SEQ ID NO: 9104 - DNA, 659 bp, Glycine max; identical to SEQ ID NO: 8596

SEQ ID NO: 9105 - DNA, 752 bp, Glycine max; identical to SEQ ID NO: 8597

SEQ ID NO: 9106 - DNA, 1266 bp, Glycine max; identical to SEQ ID NO: 8509

SEQ ID NO: 9107 - DNA, 1122 bp, Glycine max; identical to SEQ ID NO: 8488

SEQ ID NO: 9108 - DNA, 1077 bp, Glycine max; identical to SEQ ID NO: 8487

SEQ ID NO: 9109 - DNA, 1499 bp, Glycine max; identical to SEQ ID NO: 8168

SEQ ID NO: 9110 - DNA, 1499 bp, Glycine max; identical to SEQ ID NO: 8168

SEQ ID NO: 9111 - DNA, 1858 bp, Glycine max; identical to SEQ ID NO: 8191

SEQ ID NO: 9112 - DNA, 2030 bp, Glycine max; identical to SEQ ID NO: 8192

SEQ ID NO: 9113 - DNA, 1254 bp, Cucumis melo subsp. melo; identical to SEQ ID NO: 8193

SEQ ID NO: 9114 - DNA, 1627 bp, Vitis vinifera; identical to SEQ ID NO: 8194

SEQ ID NO: 9115 - DNA, 1757 bp, Arabidopsis thaliana; identical to SEQ ID NO: 8195

SEQ ID NO: 9116 - DNA, 1726 bp, Arabidopsis thaliana; identical to SEQ ID NO: 8196

SEQ ID NO: 9117 - DNA, 1720 bp, Glycine max; identical to SEQ ID NO: 8139

SEQ ID NO: 9118 - DNA, 1479 bp, Glycine max; identical to SEQ ID NO: 8141

SEQ ID NO: 9119 - DNA, 2030 bp, Glycine max; identical to SEQ ID NO: 8192

SEQ ID NO: 9120 - DNA, 1858 bp, Glycine max; identical to SEQ ID NO: 8191

SEQ ID NO: 9121 - DNA, 1533 bp, Glycine max; identical to SEQ ID NO: 8152

SEQ ID NO: 9122 - DNA, 1533 bp, Glycine max; identical to SEQ ID NO: 8153

SEQ ID NO: 9123 - DNA, 2461 bp, Glycine max; identical to SEQ ID NO: 8526

SEQ ID NO: 9124 - DNA, 2224 bp, Glycine max; identical to SEQ ID NO: 8527

SEQ ID NO: 9125 - DNA, 1907 bp, Medicago truncatula; identical to SEQ ID NO: 8528

SEQ ID NO: 9126 - DNA, 4275 bp, Vitis vinifera; identical to SEQ ID NO: 8529

SEQ ID NO: 9127 - DNA, 4269 bp, Vitis vinifera; identical to SEQ ID NO: 8530

SEQ ID NO: 9128 - DNA, 2321 bp, Vitis vinifera; identical to SEQ ID NO: 8531

SEQ ID NO: 9129 - DNA, 2630 bp, Vitis vinifera; identical to SEQ ID NO: 8532

SEQ ID NO: 9130 - DNA, 4269 bp, Vitis vinifera; identical to SEQ ID NO: 8533

SEQ ID NO: 9131 - DNA, 3715 bp, Vitis vinifera; identical to SEQ ID NO: 8534

SEQ ID NO: 9132 - DNA, 2009 bp, Glycine max; identical to SEQ ID NO: 8144

SEQ ID NO: 9133 - DNA, 1662 bp, Glycine max; identical to SEQ ID NO: 8145

SEQ ID NO: 9134 - DNA, 1479 bp, Glycine max; identical to SEQ ID NO: 8141

SEQ ID NO: 9135 - DNA, 1720 bp, Glycine max; identical to SEQ ID NO: 8139

SEQ ID NO: 9136 - DNA, 1551 bp, Glycine max; identical to SEQ ID NO: 8472

SEQ ID NO: 9137 - DNA, 1639 bp, Glycine max; identical to SEQ ID NO: 8471

SEQ ID NO: 9138 - DNA, 1677 bp, Glycine max; identical to SEQ ID NO: 8473

SEQ ID NO: 9139 - DNA, 1745 bp, Glycine max; identical to SEQ ID NO: 8474

SEQ ID NO: 9140 - DNA, 1761 bp, Glycine max; identical to SEQ ID NO: 8475

SEQ ID NO: 9141 - DNA, 1383 bp, Medicago truncatula; identical to SEQ ID NO: 8476

SEQ ID NO: 9142 - DNA, 1630 bp, Glycine max; identical to SEQ ID NO: 8485

SEQ ID NO: 9143 - DNA, 1191 bp, Glycine max; identical to SEQ ID NO: 8484

SEQ ID NO: 9144 - DNA, 2004 bp, Glycine max; identical to SEQ ID NO: 8502

SEQ ID NO: 9145 - DNA, 2062 bp, Glycine max; identical to SEQ ID NO: 8503

SEQ ID NO: 9146 - DNA, 2067 bp, Glycine max; identical to SEQ ID NO: 8504

SEQ ID NO: 9147 - DNA, 1090 bp, Glycine max; identical to SEQ ID NO: 8465

SEQ ID NO: 9148 - DNA, 1029 bp, Glycine max; identical to SEQ ID NO: 8466

SEQ ID NO: 9149 - DNA, 2062 bp, Glycine max; identical to SEQ ID NO: 8503

SEQ ID NO: 9150 - DNA, 2004 bp, Glycine max; identical to SEQ ID NO: 8502

SEQ ID NO: 9151 - DNA, 1412 bp, Glycine max; identical to SEQ ID NO: 8467

SEQ ID NO: 9152 - DNA, 1278 bp, Glycine max; identical to SEQ ID NO: 8468

SEQ ID NO: 9153 - DNA, 1745 bp, Glycine max; identical to SEQ ID NO: 8474

SEQ ID NO: 9154 - DNA, 1677 bp, Glycine max; identical to SEQ ID NO: 8473

SEQ ID NO: 9155 - DNA, 655 bp, Glycine max; identical to SEQ ID NO: 8514

SEQ ID NO: 9156 - DNA, 734 bp, Glycine max; identical to SEQ ID NO: 8515

SEQ ID NO: 9157 - DNA, 828 bp, Glycine max
aatatcagtcaagaaggaattgaactatggcgcacgatacatcatctgattctgaaaatgaaattattggagcacgggcaaagctctttggacatgaaaaaccgattcatgaagttcttggaggaggaaaagtggcagatatgttattatggagggacagatatgtatcaggtgcgcttttgggtgggatgactgtgatatggtttctatttgagatcgttgagtacaatttcgtggcactcctttgtcacatttccatcaccaccatgcttgttctattcatatggtccacggttgcagatatatttaaatggaaaggtccccagatcccaaacattgttttacaggaatctttcttccatgatcttgcttccatcctccacaaaagatttaaccagttattaccaatgctcctccacatttcatgtggaatagacctgccaatctttcttctgaacattgtttctctctatattctgtcagtgattggaagctacttcagttttgtcaatctgctatatattgggtttctctgcatgcaaacgctgccaattgtgtatgaacggtatgaggaagaaatcaacaattgggtcagcgatatcataatagttataaggaaaaactataggaggtttaacaagaactacctcaacaaaattcccagaggaccagtgaaggcaaagaaaacccaataaactattatactcaaacttctaaatataagatatacatgatgatttatacaagtttctttccaagaaaacaaataccaaacaatgtataattctatttttcatacatgtccaattgtgtaattcagaggtgttt

SEQ ID NO: 9158 - DNA, 886 bp, Glycine max
ggagtcaagaaggaattgaactatgatgaacgatacatcatctgattctgaaaatgaaattatcggatcacgggcaaagctctttggacacgaagaaccgattcatgaagttcttggaggaggaaaagtggcagatgtgttattatggaaggacagatatgtatcagatgcgcttttgggtgggatgactgtgatatggtttctatttgagatcgttgagtacaatttcgtggctctcctttgtcacatttccatcaccaccatgcttgtactattcatatggtccacggttgcagacatatttaagtggaaaggtccccagataccggacattgttttaaaggaatcattcttccatgatcttgcttccatcctccacaaaagatttaaccagttattaccaatgctcctccgcatttcatgcggaatagaccttccaatctttcttccgaacattgtttccctctatattctgtcagtgattggaagctacttcagctttgtcaatctgctatatattggttttctctgcatgcaaacgctgccaattgtgtatgaacggtatgaggaagaaatcaacaactgggtcggcgatgtcataatagttctcaagaaaaactatagaaggtttaacaagaactacctcaacaaaattcccagaggaccagggaaggcaaagaaaacccaataaactataatactcaaaacttcaaaatataagatatgatggtttatataaattcctttccaagaaaacaaataccaaacaatgtaatagttttatttttcatacatgtccaattgtgtaattcgaagtgtttacatggatagcgtgtgaggagtagtgtatttttattttcactgaaatccaactgtaagttttctt

SEQ ID NO: 9159 - DNA, 886 bp, Vitis vinifera; identical to SEQ ID NO: 8570

SEQ ID NO: 9160 - DNA, 925 bp, Betula platyphylla; identical to SEQ ID NO: 8571

SEQ ID NO: 9161 - DNA, 2067 bp, Glycine max; identical to SEQ ID NO: 8504

SEQ ID NO: 9162 - DNA, 1546 bp, Glycine max; identical to SEQ ID NO: 8507

SEQ ID NO: 9163 - DNA, 1643 bp, Glycine max; identical to SEQ ID NO: 8508

SEQ ID NO: 9164 - DNA, 752 bp, Glycine max; identical to SEQ ID NO: 8597

SEQ ID NO: 9165 - DNA, 659 bp, Glycine max; identical to SEQ ID NO: 8596

SEQ ID NO: 9166 - DNA, 1266 bp, Glycine max; identical to SEQ ID NO: 8509

SEQ ID NO: 9167 - DNA, 1090 bp, Glycine max; identical to SEQ ID NO: 8465

SEQ ID NO: 9168 - DNA, 1412 bp, Glycine max; identical to SEQ ID NO: 8467

SEQ ID NO: 9169 - DNA, 1278 bp, Glycine max; identical to SEQ ID NO: 8468

SEQ ID NO: 9170 - DNA, 1412 bp, Glycine max; identical to SEQ ID NO: 8467

SEQ ID NO: 9171 - DNA, 1639 bp, Glycine max; identical to SEQ ID NO: 8471

SEQ ID NO: 9172 - DNA, 1677 bp, Glycine max; identical to SEQ ID NO: 8473

SEQ ID NO: 9173 - DNA, 1191 bp, Glycine max; identical to SEQ ID NO: 8484

SEQ ID NO: 9174 - DNA, 1630 bp, Glycine max; identical to SEQ ID NO: 8485

SEQ ID NO: 9175 - DNA, 655 bp, Glycine max; identical to SEQ ID NO: 8514

SEQ ID NO: 9176 - DNA, 1163 bp, Glycine max; identical to SEQ ID NO: 8486

SEQ ID NO: 9177 - DNA, 1077 bp, Glycine max; identical to SEQ ID NO: 8487

SEQ ID NO: 9178 - DNA, 1122 bp, Glycine max; identical to SEQ ID NO: 8488

SEQ ID NO: 9179 - DNA, 1630 bp, Glycine max; identical to SEQ ID NO: 8485

SEQ ID NO: 9180 - DNA, 1551 bp, Glycine max; identical to SEQ ID NO: 8472

SEQ ID NO: 9181 - DNA, 2004 bp, Glycine max; identical to SEQ ID NO: 8502

SEQ ID NO: 9182 - DNA, 659 bp, Glycine max; identical to SEQ ID NO: 8596

SEQ ID NO: 9183 - DNA, 752 bp, Glycine max; identical to SEQ ID NO: 8597

SEQ ID NO: 9184 - DNA, 1745 bp, Glycine max; identical to SEQ ID NO: 8474

SEQ ID NO: 9185 - DNA, 1122 bp, Glycine max; identical to SEQ ID NO: 8488

SEQ ID NO: 9186 - DNA, 1077 bp, Glycine max; identical to SEQ ID NO: 8487

SEQ ID NO: 9187 - DNA, 534 bp, Arabidopsis thaliana
gggagaaagcagcaaagaagaaaaatggtagcaacatttgcaacaccatcgacggtgataggcctcggaggatcatccatcaccaccaaacccttctcttcatcctttttaaaaccaacattaagcgccaagaaccctttgagactcgccggtgcatcgggaggaagagtcacttgctttgagaggaactggttgaggagagatttgaacgtggtaggatttgggctgatcggatggctagctccgtcgagcattccagcgataaatgggaagagcctgacgggtctcttcttcgatagcatcggaactgagctcgctcacttcccgactcctccagctctcacttcacagttctggttgtggttggttacgtggcacttaggcctcttcctctgcctcactttcggacaaatcggattcaagggcaggactgaagattacttctaaggataactattcttgttttcgtttgtactatatgctctctcttggttatgtgtaatattatcaatcaaaacaaagctttctttgctt

SEQ ID NO: 9188 - DNA, 703 bp, Arabidopsis thaliana
cagaataaaaatctatttcttgtgtttgtgttgtatttacttaaaaaaataaaggagatcagtttgggagaaagcagcaaagaagaaaaatggcagcaacatttgcaacaccatcgacggtgataggcctcggaggatcatccatcaccaccaaacccttctcttcatcctttttaaaaccaacattaagcgccaagaaccctttgagactcgccggtgcatcgggaggaagagtcacttgctttgagaggaactggttgaggagagatttgaacgtggtaggatttgggctgatcggatggctagctccgtcgagcattccagcgataaatgggaagagcctgacgggtctcttcttcgatagcatcggaactgagctcgctcacttcccgactcctccagctctcacttcacagttctggttgtggttggttacgtggcacttaggcctcttcctctgcctcactttcggacaaatcggattcaagggcaggactgaagattacttctaaggataactattcttgttttcgtttgtactatatgctctctcttggttatgtgtaatattatcaatcaaaacaaagctttctttgctatttgatgtttcattctatatctcgacaagtctttcttatatgatcttgattttaagaatgtctgtcagtctaactaaagtattaaatgttaaaagcgtttctcg

SEQ ID NO: 9189 - DNA, 638 bp, Thellungiella halophila
ggggagaaagaagcaaaggagaaaaatggcagcaacatttacaaccccatcgacggtgataggcctcggaggatcatctgtttctcccagacccttctcttcatctttcttaaaaccaacattaagagcaaagaaccctctgagactcgccggggcatcggggggaagattcacatgctttgagaggaactggttgaggagagatctgaacgtggtgggatttgggttgatcggatggctagctccgtcgagcattccggcgataaacgggaagagtctgacgggtttattcttcgacagcattggaactgagctcgctcatttcccaactcctccagctctcacttcacagttctggttgtggttggttacgtggcacttgggcctcttcctctgcctcaccttcggacaaatcggatttaagggcaggactgaggattacttccaaaaataattcatgcctctactatatcatttgtactatatctcactctgtctttgtctctctcctttgcagcgttctctgtgtagtaccattactcaaaacaaagctttctaatttctttggtatttgatgtttcgttcaatatcgataaaagtgtttcttcatgatcttgattctaaaaaaaaaaaaaaaa

SEQ ID NO: 9190 - DNA, 438 bp, Silene latifolia
gctagcagttttgcagcatcctcaactgttgttggtctcggcacgtctaccctttctcgctcttacgcgaaatctactaccctttcttcaggcttcttgaagtcaaaggttgctgcagtgaaccctctgaggcaagcttgtggcacttctggtggaagatttacctgtagctttcaaagagactggctgaggagagacttgaatgtgattgggttcggattgataggatggttagctccgtcgagtatacctgctattgatggcaacagcctctctggactcttcttctctagcatcggggaggaactcgctcacttccccactcctcccgctgtcacttctcagttttggttgtggctggtattgtggcatttgggattgttcttgtgcctgacatttgggcagattggcttcaaaggaaggactgaagagtacttc

SEQ ID NO: 9191 - DNA, 715 bp, Medicago truncatula
ggcattgtcaacaccaaaatcatagattacagctgaaatggcagcaacaacctttccaaccgtcctaggaatggctggtgcatcacgtctcacctccggattcgtgaaaccgcaagtgattgctaggaatcctttgaagcaagctatggcacttggaaatggtgggagagtcacatgcttccaaagggattggttgaggagggatttcaatgtgattggatttgggttgataggttggttggcaccatctagcataccagctatagatggtaaaagtttgactggacttttttttgatagcattggcactgaacttgctcacttcccaactcctcctgctcttacttcacccttctggttatggctgatctgttggcaccttggactgttcatctctctcacttttggccaaattggtttcaaaggaaggactgaagattactttcagaaatgaaatcataacaactttaattcataagttattattactatgaattaaactcaggtgtacttctgatttttaattcataataacttatggtctgttattaatttcttttccctttatattactctcagccttgtaatctactaccatgagtaaaaaaaaaaccttgtagaacacttggcaccttttctcttgtactagaaaaattggtgtaatattgtcttcataatgaatgttgtaaattattatttgtattagttgctgccc

SEQ ID NO: 9192 - DNA, 810 bp, Silene vulgaris
agctagcagttttgcagcatccgcaactgttgttggtctcggcacgtctaccatctctcgctcttacgcgaagtctactcccctttcttcaggtaatcatcctttcattttgccatatttttttttatgatgcagttctcgacgcaattttctcggttcataggcttcttgaaatcaaaggttgctgcagtaaaccctctgaggcaagcttggggcacttctggtggaagatttacctggttaattactctttatctcgtctttcgttactttgacttgtttagaaatattcgacataagtctatgtttaagtgtcaaattttactatcttatgacatgttgttggcttaaaatgaagtgtctaaagtatcgtactcatatccgacatagatctttgcctaaggtattaacagaaagatgatggtatgtttaacagtagctttcaaagagattggttgaggagagacttgaatgtgattgggttcggattgataggatggttagctccgtcgagcatacctgctattgatggcaacagcctctctggactcttcttctctagcatcggggaggaactcgctcacttccccactcctcccgctgtcacttctcagttttggtaagtttcttgtaagacctgacagaagaataagctagtctcatgacaaaattatcacgagactgtctgatccgagaatttatgattgtgtctgtgtttggaatgaataggttgtggctggtcttgtggcatttgggattgttcttgtgcctgacttttgggcagattggcttcaaaggaaggactgaaga

SEQ ID NO: 9193 - DNA, 585 bp, Glycine max
atgagagtttcgacagaaaagttagagacagagccggagagcaaaaagataaaacgcattcgtggcggcggcggcggggactcgagcaataagcaccctttgtaccgcggcgtgcggatgcggaactgggggaaatgggtgtcggaaatccgcgagccgcggaagaagtcgcggatatggctaggcacattcccgacgccggaaatggcggcgagggcgcacgacgtggcggctctcagcatcaaaggctccgccgccattctcaacttccctcactttgccaactcgctccctcgcccggcttctctcgcgccgcgcgacgttcaagccgcggcggccaaagcggcgcacatggacccttcttccctctcctcccttgtctccgcaatggacttgtcctctgcctctgacgagttgagccaaatcatagagcttccttctttggaaagcaccgatgatggctccgtcgtcttagagaaagagtttgtttttgttgactcccttgatgcttggatgtatcagccaccctttggttttgacaccgaacaagacactggtttcgagggtttgatgtggaattactag

SEQ ID NO: 9194 - DNA, 999 bp, Glycine max
ttttttttttttttttctttaaagaaaatttctcctcttactttattcatctagccatttacaattaaaaacagaggaatcaggaaaaaagacagacgacagatagactcgatgatgaatacgacagcgatcgagtggcacgggcagcccctgaaagaaaaacaacaagtggctgcttactgcttatagacacacacgcaaagcaaaacataaagagacgatcaatattaatttatacagcataagacatagaatagaacagaaacatggatcgaaactagtaattccacatcaaaccctcgaaaccagtgtcttgttcggtgtcaaaaccaaagggtggctgatacatccaagcatcaagggagtcaacaaaaacaaactctttctctaagacgacggagccatcatcggtgctttccaaagaaggaagctctatgatttggctcaactcgtcagaggcagaggacaagtcctttgcggagacaagggaggagagggaagaagggtccatgtgcgccgctttggccgccgcggcttgaacgtcgcgcggcgcgagagaagccgggcgagggagcgagttggcaaagtgagggaagttgagaatggcggcggagcctttgatgctgagagccgccacgtcgtgcgccctcgccgccatttccggcgtcgggaatgtgcctagccatatccgcgacttcttccgcggctcgcggatttccgacacccatttcccccagttccgcatccgcacgccgcggtacaaagggtgcttattgctcgagtccccgccgccgccgccacgaatgcgttttatctttttgctctccggctctgtctctaacttttctgtcgaaactctcattgtttaattaactcggattggtgttcggaaatcgacaaggcttaaacaccgaggaaattattctaagaagaggttgttctcatttggcatgcaagtgaagtgaagtttttcttttcttttctttttcctggggtccc

SEQ ID NO: 9195 - DNA, 567 bp, Glycine max
atgagagtttcaacagagacagagccggagactaaaaagataaaacgcattcgcggcggcggggactcgagcaagcaccctttgtaccgcggcgtgcggatgcggaactgggggaagtgggtgtcggaaatccgcgagccgaggaagaaatcgcggatatggctaggcacattccccacgccggaaatggcggcgagagcgcacgacgtcgccgctctcagcatcaaaggccccgccgccattctcaacttccctcacttggccaactcgctcccccgcccggcttcgctggcgccgcgcgacgttcaagctgcggcggcgaaggcggcgcacatggacccttcctccctctcctccttggtctccgcaatggacttgtcctctgcctctgacgagttgagccaaatcatagagcttccttctttggaaagcaccgatgatggctctgttgacttaaagaaggagtttgtttttgttgattcccttgatgcttggatgtatcagccaccctttggttttgacaccgaacaagacactggtttcgagggtttgatgtggaattactag

SEQ ID NO: 9196 - DNA, 682 bp, Glycine max
gggggtcttgcaaattaagttcattttcctccctttcactctcgtagacatcacaaaccttccctccattcatcccacgcatggctgccatgaactctagcgtattggcctgtagctatgccatatcaggtgcagcgtgttcggagctcaatgggaaggtcacttccgtggcctatgttgcatgctctggctacaagttgccattgatcaaagctgaggccagagttcctaaagccaaagaatctgaaggaggaaggagaggtgcccttgttctcttggcagctacccttttcacctctgcagcttccaattcttctgccaatgctgggatcattgaagattaccttgagaggagcaaggccaacaaggaattgaatgacaagaagaggttagctactactggagcaaactttgcaagagcatacaccgtggaattcggtagttgcaagttccctgagaacttcactggttgccaagatcttgccaaacaaaagaaagtgccattccttagtgacgacttggagcttgaatgtgaaggaaaggacaaatacaagtgcggttctaatgttttctggaaatggtgaaaggaggcaacattttatgcctaactgcgaacttttcgccttgcaatgtacctaactgcttgaatatatatcatatttttctgcattgatttattatt

SEQ ID NO: 9197 - DNA, 702 bp, Glycine max
ggaggccttgcaaagtaagttcatttgactctcacaaaccttgcatccatccacacatggctggcatgaactctagcgtattggcctgtagctatgccatatctggtgcagcatgctccgagctcaatgggaaggtcacttccgtggcctctgttgcatcctctggctacaagttgccattgatcaaatgtgaggccagagttcccaaagccaaagaatctgaaggaaggagaggtgcccttgttctcttggcagctacccttttcatctctgcagcctccaattcttctgccaatgctgggatcattgatgattaccttgagaggagcaaggctaacaaggaattgaatgacaagaagaggttagctactactggagcaaactttgcaagagcatacaccgtggaattcggtagttgcaagttccctgagaacttcactggttgccaagatcttgccaaacaaaagaaagtgccattccttagtgacgatttggagcttgaatgcgaaggaaaggacaaatacaagtgcggttctaatgttttctggaaatggtgaaaggaggcaaccttttatgcccaactgcgaattattcgctttgcgatgtacctaactgcttgaatatataccatattttttctgcattgctttcagttattatattgttggtgttggattttagttgttgaagaaaatgtgtgaa

SEQ ID NO: 9198 - DNA, 760 bp, Arabidopsis thaliana
atcctcattcatctctaatactaaaatctaatctcttccttgctcactcaccaatcaaactcaaaaaactcttgaatttttcaagaacaaaagaaaaagacatctttaatggcggccatgaactcgagtgttctcacttgcagctacgcaattgctggctctggctcggtagagcttaaccagaaagttggtttggtgaattcatcagttgggtttggtcagaagaaacagatgattatgcctgtgatcaaagctcaacgcgttgttggtgatgatgttgatggatctaatggaagacgatcagccatggttttcttagcagctacactcttctccactgctgctgtttctgcttctgctaatgctggcgtcattgacgaatacctcgagaggagcaaaaccaacaaagaacttaatgataagaagagattggcaacaagtggagcaaactttgcgagagcattcactgttcaattcggaagctgcaagttccctgagaatttcactggctgccaagatcttgccaagcaaaagaaagttccatttatctcagaagatattgctttggaatgcgaaggcaaggacaagtacaagtgtggttccaatgttttctggaaatggtgaagaactttgtttgttttcatctattcttatataaatccaacaatgtatctatctctctctattcatgaaagttctcgcatccatttgaatctatcaagctaaaactctattgagagattaggatgcattattttgc

SEQ ID NO: 9199 - DNA, 646 bp, Populus trichocarpa x Populus deltoides
gattttgcaagcaatggcagccatgaattctagtgttttggcatgcaactatgccatctcaggcactggatcatctgagcttaatgccaagattgtttccatgcctgcagttgcatcccttgttgtgtgtggccccaagttgcctgtgatcagagcccaacagactagagctgatagcagagaaatgaaagcaagtgaaggaaggagagctgcaatggtttatcttgcagctacccttttcacctcagctgctgctgcttcttctgccaatgctggagtcatcgaagagtaccttgaaaagagcaaagctaacaaggaattgaatgacaagaagagattggccactagtggagcaaattttgcaagagcattcacagttcaatttggcacatgcaagttccccgagaacttcacaggctgccaagatcttgccaagcaaaagaaagtgccatttatctctgatgatttggctttggagtgcgaaggaaaggacaaatacaagtgtggttccaatgttttctggaaatggtgaagagggtgagctttgtctttgaatctccattttccaacatgtatctagttttccatgtaacaaaatttacaatccatttatctctagtttctctaaaaaaaaaaaaaaaaaaaa

SEQ ID NO: 9200 - DNA, 699 bp, Thellungiella halophila
gaccaatcaaacccaaaaactcttcaattttccgaaaaacaaaaagagaaagagatctgtaatggcgaccatgaactcgagtgttctcacttgcagctacgcaatctctggtgctagctcagcagagctaaaccagaaagtgggcttggtgaattcatcagttgggtttggtcagaagaaacagacgatgtctgtgatcaaagctcaacgagttggaggtgatgatgttgatgggtctaatggaagaagatccgccatggttttcctagctgctacactcttctcctctgctgctgtttctgcttctgctaatgctggtgtcatcgatgaatacctcgagaagagcaaggccaacaaagaacttaatgataagaagagattggcaacaagtggagcaaactttgcgagagcattcactgtccagttcggaagctgcaagttccctgataatttcactggatgtcaagatcttgccaagcaaaagaaagtcccatatatctcggaagatttggcgttggaatgtgaagggaaagacaagtacaagtgcggttccaatgttttctggaaatggtgaagaagtttgtttgttctcatattaaatccaacaatgtatctatctctctctatttattcatcaaagttatcatctccatttgaatgaatctatcaagttaattattgagaaaaaaaaaaaaaaaa

SEQ ID NO: 9201 - DNA, 1250 bp, Vitis vinifera
gaaaaaagcttgacggtgtagctaaccaaaggtgcttgttctcctcactttcctttcacttctaacgcttctatatctctctctctctacttcgatcatttcagctctttctagacctattcacccacttctgtcgagacttcttttctctctttttcttttacttgcatttttctatttctctgttatcaaacacggctgctgtgggctctataatcaagtgatcagtcagttacaatggctgagccgctgaattctgaaactgagagcagttccaactctggctcttcttcttcatcgtctccgtcctctcctggctcgactcagtcacgtcccaactcctcgaaaccggagccagagtcgaagaagatgaagagaatccgggactccagcaaacacccggtataccggggggtgagaatgcggaactggggcaaatgggtgtctgaaattcgggagcctcgcaagaaatcgcgtatctggctcggcactttccctacgcctgaaatggctgccagagctcacgacgtggcggcgttgagcatcaaaggaaactccgcgattctcaattttccccaactagccgcctcgctgcctcgccccgtctcactcgctccacgcgacgtccaagcggccgcggccaaggccgcggcgatggataaattcgactctccgtcatcctcctcctcgtcctcatcattgtcgtcattggtgtcctccatcgacctatcgacggcgtcggatgaattgagcgaaatcgtcgagttacccaatctggatccgagtttcgactcgccggagtccaagaccgatttcgtgttcgacgactctgctgatgggtggctctaccctccaccatggctgcagagtgtcgaggattgtgggtatttctccgaacagttactggtgccagagagtttgatccccggtagctttgaagcctttttgtgggataataactagtgttcaaaaaaaaaaaaaaaaaaaacatcttgtgtgtgtttttcttttttgtttttgtttttgttttctctgattttgattttcttgcttttgttttttgttgtttttgttttcatttttgagcccttgttatttttctttaaaagggctaaaaccctctctcccccgcccctctctcattaccttcctctttctctctgtgtccatgtaatctcttcaatgaatctaactgtacattgctagggtggaaagagctaaatgtcataaattttctttcttggttggtg

SEQ ID NO: 9202 - DNA, 1116 bp, Glycine max
atggagatcaccaatgtcagcgagtatgaagctattgcaaagcagaagttgccaaagatggtgtttgactactacgcatctggtgcagaggaccagtggactctgcaggagaacagaaatgccttttccagaattttgtttcggccacgtattcttattgatgtgagcaagatagacatcacaactactgtcctgggcttcaaaatatccatgccaatcatgcttgccccaacagccatgcagaaaatggctcatcctgagggagaatatgcaacagcaagagctgcatctgctgctggaacaatcatgactttgtcttcatgggctacttcaagtgttgaagaggtagcttcaacaggacctggcattcgctttttccagctatatgtgtacaaggacaggaatgtggttgctcagcttgtgagaagagctgaaagggctggattcaaagccattgcccttactgttgataccccaagactaggacgcagagaagctgatatcaagaacagattcacactgccaccatttttgacattgaagaactttgaaggattggaccttggaaagatggacaaagctgatgactctggacttgcttcatatgttgccggtcaaattgatcgtactcttagctggaaggatgtgaagtggcttcaaacaatcaccaaactgccaattctggtgaagggtgtgctgactgctgaggacacaaggatagctgtacaaagtggtgcagctggaattatagtgtccaatcacggagctagacaacttgattatgttccagccactatatcagccttagaagaggttgtcaaagctgctgaaggtcgtgttcctgtatttttggatggtggtgttcgccgcggaactgatgtcttcaaggcattggcactaggtgcctctggcatatttattggacgcccagtggtgttctccttggctgctgaaggagaggctggtgtaagaaatgtgctgcggatgctacgtgaggagtttgagctaaccatggctttgagtggttgcacctcactcaaggatatcactcgtgatcacattgtcactgattgggaccaaccacgcactatcccccgcgccttgccaagattatga

SEQ ID NO: 9203 - DNA, 1116 bp, Glycine max
atggagatcaccaatgtcagcgagtatgaagctattgcaaagcagaagttgccaaagatggtgtttgactactacgcatctggtgcagaggaccagtggactctgcaggagaacagaaatgccttttccagaattttgtttcggccacgtattcttattgatgtgagcaagatagacatcacaactactgtcctgggcttcaaaatatccatgccaatcatgcttgccccaacagccatgcagaaaatggctcatcctgagggagaatatgcaacagcaagagctgcatctgctgctggaacaatcatgactttgtcttcatgggctacttcaagtgttgaagaggtagcttcaacaggacctggcattcgctttttccagctatatgtgtacaaggacaggaatgtggttgctcagcttgtgagaagagctgaaagggctggattcaaagccattgcccttactgttgataccccaatactaggacgcagagaagctgatatcaagaacagattcacattgccgccatttttgacattgaagaactttgaaggattggaccttggaaagatggacaaagctgatgactctggacttgcttcatatgtttctggtcaaattgatcgtactttaagctggaaggatgtgaagtggcttcaaacaatcaccaaactgccaattctggtgaagggtgtgctgactgctgaggacacaaggatagctatacaaagtggtgcagctggaattatagtgtccaatcatggagctagacaacttgactatgttccagccaccatatcagccttagaagaggttgtcaaagctgctgaaggtcgccttcctgtatttttggatggtggtgttcgccgtggaactgatgtcttcaaggcattagcactaggtgcctctggcatatttattggacgccctgtggtgttctccttggctgctgaaggagaggctggtgtaagaaacgtgctgcggatgctacgtgaggagtttgagctaaccatggccttgagtggttgcacctcactcaaggatatcactcgtgatcacattgtcactgattgggaccaacctcgcattcttccccgcgcattgccaagattatga

SEQ ID NO: 9204 - DNA, 1439 bp, Glycine max
tttttttttttttttggtcacacaagtatcatcatataatacttaaaagaaattaagcatagagttttccaaatacaaccttaaatgagttctccaaaaaggaaaagaaaggaggttcatgaaacacatatagaactgtttcctccattgttctgcaccacattatacaaacttggctcaaatgaggagcaaatttttcataatcttggcaatgcgcggggaagaatgcgaggttggtcccaatcagtgacaatgtgatcacgagtgatatccttgagtgaggtgcaaccactcaaggccatggttagctcaaactcctcacgtagcatccgcagcacgtttcttacaccagcctctccttcagcagccaaggagaacaccacagggcgtccaataaatatgccagaggcatctagtgctaatgccttgaagacatcagttccacggcgaacaccaccatccaaaaatacaggaaggcgaccttcagcagctttgacaacctcttctaaggctgatatggtggctggaacatagtcaagttgtctagctccatgattggacactataattccagctgcaccactttgtatagctatccttgtgtcctcagcagtcagcacacccttcaccagaattggcagtttggtgattgtttgaagccacttcacatccttccagcttaaagtacgatcaatttgaccagaaacatatgaagcaagtccagagtcatcagctttgtccatctttccaaggtccaatccttcaaagttcttcaatgtcaaaaatggcggcaatgtgaatctgttcttgatatcagcttctctgcgtcctagtattggggtatcaacagtaagggcaatggctttgaatccagccctttcagctcttctcacaagctgagcaaccacattcctgtccttgtacacatatagctggaaaaagcgaatgccaggtcctgttgaagccacctcttcaacactggaagtagcccatgaggacaaagtcatgattgttccagcagcagatgcagctcttgctgttgcatattctccctcaggatgagccattttctgaaaggctgttggggcaatcatgattggcatggatattttgaagcctaggacagtagttgtcaagtctatcttgctcacatcaataagaatacgtggccgaaacaaaattctggaaaaggcatttctgttctcttgcagagtccactggtcctctgcaccagatgcgtagtagtcaaacgccatctttggcaacttctgctttgcaatagcctcatactcactgacattggtgatctccattttcagaactgcttgttgatgctacccttcttcaggaattcttggtttccaaaactatgcaactgtgtgcatgcagatgaagaaccagtggagaggagctcctagtgaggaatagaaacagaaccc

SEQ ID NO: 9205 - DNA, 3731 bp, Vitis vinifera
atggagattacaaatgtgacggagtatgaggctattgcaaagcaaaagttgcccaagatggtgtttgactattatgcatcaggtgcagaggaccagtggactctgtatcagaacagacatgctttttcacagattctgtaaggctttcttcttcttcttcttcttctcctcctttgatctttatttataaaatctaatactccagctaaataatttgactacaaaaacctttggttccatgttttacctttcctttctatatgaacaaacttgtgtaggaatcaatgtagatgttatctgaaaaaacttgtgtttttttttttttaaaaaaaggtttcggccccgcattcttattgatgtaagcaagatagacatgaccaccactgtcctgggtttcaagatttcaatgcctattatgatcgccccaactgccatgcagaaaatggctcaccctgaaggtataccactctttgaccttgcattactgctctttccattgccatgcaaaatggtaaaccttcttgctctataattgtctccaagttctttgagcattcttagaagttttcttttatttgattttttgctttaatacagacagagcaatatcactgccacatattattcaccctatggcgaaagtttaggaatcttgacttgattgagattagttcaattcaaaatgtaaactgatgagcctgtagtgtcatcagcttatcgaatttacagatttttatagtaacctaaaatcgatttttttttgtatttattgggcttctgagtaggtgttacccaagtgtagaaccacaaatccactcttagacaagtttataatttaaggattctttaaatagttattagagttcattctagatgaaggttccctcccttttctgaaaatttggtttctgctgcaaacatgttcggaacttcggtatcatttcatcagtttatcttttactgtttacataaaaggcatacataacatcttagtccaaataaacttttgctgcatacttaaattgctcgaccagttcttttctaagtgccgttacactccatttagtttcttattagcagatggaagaaaatttttatgaccaatggagctttttatatgccataaagttgatttgtaattaatggaatgtgcttgagtttgaagtagtcaggtagatatctagctggatctgttctgccaactgacttacttttggaccctattatggccattaaaatgggaacaaggttttcaatctgataacatggttaattctcatgtaggagagtatgcaacggcaagagccgcatcagctactggaacaattatggtttggcttctatcttttctatgccccatttgaaattggatagtttggatcattagtatatctcacaagttctaaaaaccatggattttagaagctatgctacttttaatagtaagataagaaacagggtaaattgaacaccagaatacagaataatttattaatttggtcatgtttcagtaatttttgaaaacctgagggaagtttctgaaacaaaccttggggtttttggatatttatccattttttttcctttgcaatacctaactagtagcataatgttatgatgcaaattaattagcatagtgcttaacaataatctgtgaagcctaaagaattttgtctatgaacatgtcatgaagacaattttcaaggcaagctactttgtgttcaacttctgaagccatgaaatgaatttattggagttactgttttatagatgttataatcccaactaggatttgtgcttcatttcatctattcatgactactttgttggtttcagaccttatcttcatgggctacttcaagcgtggaagaggttgcttcaacaggacctggaatccgcttttttcagctctatgtatgcttgacatctttcatgtctttcagttggttaatgttttcattgatatcaatctataggtgcaaaattgccctttgtgttctttaagtgatggatgattttactactcaaaatgttcaggtatataaggacaggcatgtagttgctcagcttgttagaagagctgaaagggcaggcttcaaggctattgcccttactgttgatacccctaggctggggcgcagagaggctgacatcaagaacaggtgtgcactttgactcaaacatcattattagaaacgtcactgattttgaagattgagttggactgtctcatgactctaaaagaatttaaaatttattgtgctgcatttggtttatagtcaacaattggtccaagtgtttatatggcagattcactttacccccattcctgactctgaagaactttgaaggcttggaccttgggaagatggataaagtaagtggtgaaatttaacaatctggttggtcgatgtggattaatgagaagcctcatttcagatatcattttggtcatgactcattccatggagtcttgcaggctgatgactctggacttgcttcatatgttgctggtcaaattgatcgaaccctgagctggaaggtaagtcaggagggattttattgttaaggggaaggattgaaatttcaaggtcatcacaatatagtttttagtgtctgctaattggagattcgaggaaaaattggttgaaaagtgtttggtttcgtcccaagatttcatcaatttgtaaatagtttcactcggcccttggacaggatgtgaagtggcttcagacaatcaccaacttgccaattcttgtaaagggtgtgctcacagctgaggatagtaagaaagattgccctggctattttccatcaccaccattctgattctatatatggatgtttaaaaacattagtattatatatgttttgattatgcagccaggttagctatacaagctggtgcagcagggattattgtatccaatcatggagctcgccaacttgattatgtccctgccactatcatggctctggaagaggtacctctgcttgctcatgactgatttgcttaattatatctgtattattcacctcaaatatatttgaacttgccctttttttcaaacctcaggttgtcaaagctgcacaaggtcgtgtgcctgtgtttttggatggtggtgtccggcgtggaacagatgtctttaaagccttggcactgggagcctctggaatatttgtaagaacacatgcagtatcatattccatgcctagctaattagatcattgaataatttatgtaacctcaagtcacctaaattatgatattatttctctacctcttctgatcaaataatcaacaaaagagcttgtccaagttattcttactgatgacaaaacaacaatgctgaaacctagggaaagtcagtgttgtactatccagatgaataactcatttaacccaaatatctgtcatttaaagtagacggtcagttcatatttgttgattctcatcttccaaattctgcaagtctttaggtgctgcagaaaaatcttaatctgatatgatgatggttaacttgttaatttctcagattgggcggcctgtggtgttttcattggccgcagaaggagaggctggtgttagaaaagtactccagatgttgcgtgaggagtttgagctgaccatggctttaagcggatgccgttctctcaaagaaatcactcgtgatcacattgtcaccgaatgggaagttcctcaccctggctctcgccccctaccccggtta

SEQ ID NO: 9206 - DNA, 1363 bp, Mikania micrantha
gacccaagtctcaaaaagatttagagaaactactcgggtagtgaagcgaaatgggggtcacaaatgtcaccgagtatgaggctattgccaaggagaagttgccaaagatggtgtatgactactatgcttctggtgccgaggatcagtggactcttgaagagagccgaaatgctttttcgagaatcttgtttaggccccgtatccttatagatgtgagcaagatagtcatgactacaaccattttgggattcaagatatcgatgcctataatggtcgccccaactgctatgcagaaaatggctcaccccgaaggtgaatatgcaacagcaagagctgcatcttcagctggaactattatgactttatcatcatgggctacatccagtgttgaggaggctgcttcaactggacccggaatccgtttcttccagctttatgtttacaaggaccggaacgtggttgctcagctcgttagaagagctgaacgagccggtttcaaggctattgctcttacggttgatacaccacggcttgggcgccgagaagctgacatcaaaaataggtttacattgccaccatttttgacattgaagaactttgagggtttggatcttggcaagatggatgaagctaatgattctgggttagcttcttatgttgctggtcagatcgaccgcactttgagctggaaggatgttcagtggctgcaaacaatcaccaagatgccgatccttgtgaagggtgtgataaccgccgaggacacaaggctagctattcaagctggagcagcaggtattatcgtctcgaatcatggtgcccgccagctcgattatgttcccgctacgatcagtgctttagaagaggttgtgaaagcggctcaagggcgtgtacccgtgtttttggatggtggtgttcgccgtggaaccgatgttttcaaggcactggctcttggagctgctggcatatttatcggaagacctgtcgtgctttcattggctgctgaaggcgaagctggagtgagaaaagtactccagatgctacgtgacgaatttgagctaaccatggcgctaagtggttgcacctcactcaaagagattactcgtgaccatattgtgaccgagtgggacgctcccaaggctcgtcctgcacctcgattatgaacaaaaacattatatagtcgcaaggaactcgtctttattgtcaaaatataaggtatacactcgtgttacgaatgcaaaactcatcatgtttccttgtataatgttcgtttctggatgataaactttatggacaatgtataattcataaatgttcattgcttttcttacgcgaagaaaaaaaaaaaaaaaaaaaaaaaaaaaaa

SEQ ID NO: 9207 - DNA, 1575 bp, Vitis vinifera
ttgtgagccccctcctcttgtcttttctctttcaaccatatttgcatacccccttctccctcctttttctgttcttatttttcctttccctgccgctctttctatacttcttatcctcacttagcttcactgctggcacccttctgaatagcagtcttaactctgaagaagccaagattgcctttgaggggaggcatacatagttaactgaaaaatggagattacaaatgtgacggagtatgaggctattgcaaagcaaaagttgcccaagatggtgtttgactattatgcatcaggtgcagaggaccagtggactctgtatcagaacagacatgctttttcacagattctgtttcggccccgcattcttattgatgtaagcaagatagacatgaccaccactgtcctgggtttcaagatttcaatgcctattatgatcgccccaactgccatgcagaaaatggctcaccctgaaggagagtatgcaacggcaagagccgcatcagctgctggaacaattatgaccttatcttcatgggctacttcaagcgtggaagaggttgcttcaacaggacctggaatccgcttttttcagctctatgtatataaggacaggcatgtagttgctcagcttgttagaagagctgaaagggcaggcttcaaggctattgcccttactgttgatacccctaggctggggcgcagagaggctgacatcaagaacagattcactttacccccattcctgactctgaagaactttgaaggcttggaccttgggaagatggataaagctgatgactctggacttgcttcatatgttgctggtcaaattgatcgaaccctgagctggaaggatgtgaagtggcttcagacaatcaccaacttgccaattcttgtaaagggtgtgctcacagctgaggataccaggttagctatacaagctggtgcagcagggattattgtatccaatcatggagctcgccaacttgattatgtccctgccactatcatggctctggaagaggttgtcaaagctgcacaaggtcgtgtgcctgtgtttttggatggtggtgtccggcgtggaacagatgtctttaaagccttggcactgggagcctctggaatatttattgggcggcctgtggtgttttcattggccgcagaaggagaggctggtgttagaaaagtactccagatgttgcgtgaggagtttgagctgaccatggctttaagcggatgccgttctctcaaagaaatcactcgtgatcacattgtcaccgaatgggaagttcctccccctggctctcgccccctaccccggttataggaactgcataccaaatggctagtaagttttaaatgttgagtaacctaccttttcttttggagaactcatttcctcttcaatgagtcagaaaatatattgcaaaattttaagctctgtaatcatcatggattgttatacttcaattcatatatgcctactactgccttcactgtatattctgtcctctaactttaaataggggtagttgcttcatgcgaacatacaatgacacttctacttccact

SEQ ID NO: 9208 - DNA, 1522 bp, Glycine max
tccttttgaattacacggttggatttgaagtttcagagtctagaaaagcagaaattgaaggttttgaatagaaatcagcaacgactttccctatggctggaacatcatggttggtggacaaaagtagaattgcaaccaaaataaaaatgtgcatcaggagcttgtgatcatggaaaggttatatggaaaagcaatcctaccaaggcttgcccaaattgtcaacatgctattgacaacggtgatgtgttaggcaagatggaagtgcttcccacttcttccatagagcaatcaaggcttacaacacgggcacccgaaagcgccgaaaaatactagggcaagattttggtgatgtccgctggcacaagactggaaggactaaaccagttgtcttgagtggggttcaaaaaggctgtaaaaagattatggttctgtatgtgagcaatgtaagaggaggaaaagctgagaaaactaattgggttatgcatcaatatcacctaggaacagaagaggatgaaaaggatggggagtacattatctctaaagtgttttaccagcagcagcaagtcaaattgggtgataaaaatgaccaagatgttcctgaggcctctgaaatcactggaccccacccaggtctgtctgtgggagaagaagggactattgagaaagtggatccagtcactccgaaattggtgactcctgagcctccttgtaatggaaggtggtgtgcagatctagacctaggacaagaaacacataatgttcctcagcctcctcggatggattgtttagatgaaattcaagctgattgccaagtacttgcaaatgaatcatccatggtagaaactcaacacaatgaagggatggatgataaagaaaataatgcggaggatggccaaaaatggtgggacagtgagtcacagaatctgttggattcacaacaactggtcgaggcactgtcgctgtgtgacgatctactccaaagccagtctcccagtagagatggaaaacatgaagatcacaagaaccaacccggtctttctgtttatgctcagttaggaccagaacatctgaagaaggatattgaagagtgtcaaaatcttgcccttaatcctgcaaatatagagaacgatacaccttcagagtttcaactaagtcagctggtatttctgtgttctcaacaattgttaaaatgaattcattttaatgtcattctaatgtgttttcttgtttttgtaggaatttggttcacaggacagctttatttcctggggctacagcaaggcagtgaactaatatggttcttcacctcagctggggaaactgatgctttttgtaactacatttttgttgttgagcttaccttcaaaattttgggctaaaccttttcccttttagttaaaggggtaaactcaactgtaactcctttgcttgactaattgagctgtaatgttaaagcaatgaactttattgcttgatactttgatcaagtagtgctgtaattacaaaaaaaaaaaaaaaaaaa

SEQ ID NO: 9209 - DNA, 1647 bp, Glycine max
atggctttcaaactgaaatcactacctctcctttgctctcttcactccccttcccgccaaaaccctaattcaacactctcaaaccatcacttttctcgtcgcttcttcgcaccttccattcctcccaccctgtgcctatccggcgcagcctcagcgtccacctttcatcgccatcgcttcttcgtaaccgctcgaagccaagacgaagaccagatcactgaggctcttgaacaagaagaagagaaagacaacgaagaaatatcgaggcagggtgagaaaaaggaactcgcgaagcaaggcatatgggatcagataaaggaaattgtgatgttcacaggaccagcaactggactttggatatgtggaccacttatgagtctcatcgatactgcagttattggtcagagaagttcaattgagcttgctgctttaggtcctgctacagttgtttgtgattacatgtgctacgtgttcatgtttctatcaattgctacttccaatatggttgctactgcccttgccaaacaggacaaagaagaagtacaacatcacatatctgtattgctttttgttgggttatcttgtggcattgcgatgcttttgttcacaaggctatttggtgctgctataataactgctttcactggaccaaagaatgtacacgtagtacctgcagctagcaattatgtaaagattcgaggcttggcatcacctgctttacttgttggatgggtagctcagagtgcaagtcttggtatgaaagattccttgggacccttgaaagctttagctgctgctacagttataaatgtcgctggttgtgtacttttgtgcacctatttaggttatggaattgtaggggctgcgtgggctacaatggtttcacaagttgttgcttcttacatgatgattcaaaatctaaatatgaagggatataatgcacttgccttctccattccttcagggaaggaacttctgacgatatttgggcttgctgctcctgtttttataacattgatgtcaaaggtggctttttacgcactacttatatattttgctacatcaatgggtacacatacaatggctgctcatcaagtcatggtccaaacctatttaatgtgtaccgtatggggtgaacctctctcccaaacctctcaatcatttatgcctgaattgatatatggagtaaatcggagtttgtcaaaggcccgaatgcttctaaggtctctcgtgataattggagctatacttggattgttgttagggattattggaacatcggttccttggttatttcccaatatttttacacctgatcggatggtcatccaggagatgcataaggtgctgattccatactttatagccctggctgtaacaccccctactgtcagccttgagggaacgttgctggctggacgggatctgaaatttataagtttgtcaatgagtggatgcttttgtgtgggttcactagtattatgggctttgagtagtagatacggtttgcttggctgctggttttccctcgcattatttcaatgggctcggttttcaatggccctccagcgccttctttctcccaaaggcatcttatactcggaagatacagaacagtataagctgctaaagctaaggactgcctag

SEQ ID NO: 9210 - DNA, 671 bp, Glycine max
ggaatggcagtagtagcagtgtctcattcatcagcaccacccactttcaacttgaacaagtctcccaaattccctccctccccaatctctgctacctttccaatccctaactccgccacttccacttccagaattttctgccgcgccaccaattcacgcaccgaccccgtcaaaaacaaaaacaacaagaagaagaagcgcaagaagacttccgacgaatccctccctcaaatgaatcccaacgatgatttccaagttctgaacgattttcccctccaaaatggccccgacacttccgatgctcctatccattatccttccatgccgttgcccgaaccgccagctggattcgtcttagacgataacggcaacgttctccacgcttccccaaatcgacttatcactgtcgttgatcctaccaacaaccttccgttggagtgcgtgattgggagagtcttcaaaagttccgagagagatgaatgtatgttgctctgccctgttgacacgcctgtccaaatattgaagagcacaaaagctgatggatggtctgctatcagtgatgaggaagttgaatctattctgcctgccgcagcttatgcacttgccaagatacacatgcatcttgtttatagtgggtattgttatacagcacgtggtggtttttgctacac

SEQ ID NO: 9211 - DNA, 1653 bp, Glycine max
gggtggttcaacggtgagtgtttactttcctcatggattctaagagcttcaaattttacgcgctgagcggctccattgctcggcgcgtattcttccgcgcgttattgctctcctccgctgtctccctcgttgccctgatccgcttcctccccaccgtcgatttgggatctttgactcccaagacctactttgactgcgtcgacgacgactcagattcgctctccgaaaacgccaccttaacagccggctcctacttgctccagagccgcatcctcaacaccttctggggctccttcgactccatgaactgcaaaaacgacacgagtttagcttccaccgtcatcaccattctaacgggtaaacgactcttgaacttcggcgcaagaagcctctgcgttggagaagggtctaatgtaattgtctcctcaatgcaacggttgggattctccagtgtcgttggtctccacaagcacccttttttgtccctccacaaaaagaaaaccgtgtgccacttcgagtacgatgattccaccttcgacttcgtgttctccaaggatgttgttgaccaggtttctgtcccagctgcattgctcgtgcttgaggttgagcgcattcttaagcctggtggaatcggtgccttgcttgttggttcttcttcttcatcatcagtgccttcattgctgagatcttccaacctggtgcatgttggttatgtcaatgaactcaaccttgtggttttcaagaaaagatctgaaaacgcaagcacaagctctcctttttataaccatgtactaccagaagattgtgcaagtgttgaattcaccaagcctttggtgaaactaatggagcctcttgtggtggaaagagtaggacatgatgtcaagtatgagaaaaaaaatgtctcctatttgcctaagtttgtggacgtttctaataagaagaggctggtgtatattgatattggggtgagggagttggtgaatgcaaatgtcaatgttactaattggttcccaccgtcttatcccattgatcagaaggctttcagtgtttactttgttcattacaacgcttctgtgttgtcctatgtgaaactgcctcgtgtcacgttcgtttatcatccgggtttagctgggaaaattgcacacaagaatggtgtggatggagaaatggaaccgtttttcggtgaggaagagtttgattttcttgtgtggttcaaggaaactgtgcagcatgctgattttgtggttctgaagatgcatgctggggaagttgaaatgaagttccttgcggatatatttgagagtggagctatatgctctgttgatgagttgtttcttagttgctcagagagtggagatggtaaaagggagaccatgagcagcagggaacactgcatggatacttacaagggtctcagaagcaatggtgtctacgttcatcaatggtgggatgcaaaattgcatcaaggtgcttaagggtcatatgtacagtgattgtcgcgtgagagaaattgtactatttgtatcttctttgtgtgtttgatatcttggattgcagaacaactatctagtggtattattgtttttgttgtctatcctagaaagtaggatgcttaatgctaaggctatgaacacccgcaaaaaaaaaaaaaaa

SEQ ID NO: 9212 - DNA, 1332 bp, Glycine max
atgatgcctccaaagccatcgccaccgcctgctccaccagcttatgctggtcaacctcccccaccaccgcctcctttcatcagcagcagtggcggatctggatcaaacaattcaggcggtgaatttcttcctcctccttctccaggaatttcattggggttctctaagagcacattcacgtatgaggagttggcacgcgcaactgatggcttctctgatgccaacctccttggacaaggaggatttggatatgtgcacagaggaattcttcccaacggcaaggaggtggcagtgaagcaattgaaggctggaagcgggcaaggggagcgtgaattccaagctgaagttgagataattagccgtgtccatcacaagcatcttgtttctttggttggatactgcatcactgggtcccagaggctgcttgtttatgaatttgttcccaacaacacattggaattccatttgcatggaaaagggagacctaccatggattggcccacaagactaagaattgctttaggatctgctaagggactggcgtatcttcatgaagattgtcatcctaagatcatccatcgtgatatcaaatctgccaacatccttctggattttaagtttgaagcaaaggttgcagattttggtcttgcaaagttttcttctgatgtcaatacccatgtttctactcgagtgatggggacttttgggtatttggctccagaatatgcttctagtggaaaactcacagacaaatcagatgttttctcctatggaatcatgctccttgagttaataaccggacgacggccagttgataaaaatcaaacttacatggaggatagtttggtagattgggctaggcctttgctcacacgagctttggaagaggatgattttgattctattattgacccaaggctccagaatgactatgatcctcatgagatggcacgaatggtggcttctgctgcggcttgcatacgtcattcggcaaagcgtcgaccaaggatgagccaggttgtccgcgctctcgaaggagatgtctctctagcagatctgaatgaaggaataagacctggacacagcactatgtatagttctcatgaaagctcagattatgacactgcacagtacaaggaagacatgaaaaagttcaggaaaatggcattgggaactcaggagtatggtgcaagcagtgagtacagtgccgctacaagtgagtatggtttaaacccatcaggctcaagtagtgaagcacagagccgccaaaccacaagggaaatggaaatgagaaagatgaagaacaatcaaggtttcagtggaagttcttga

SEQ ID NO: 9213 - DNA, 2150 bp, Vitis vinifera
gcttttttccgctttcatttacttctaaatattctcttctctctctcggaaaagtgcttcctagagagagaaataaggagttaaagccttttaaacactcgccggagtttgcgtgagtttctgggcggacatgtcgtcaccgtcgccggggcagtcccctggtccgacttcgcccccctctacaaacactacctcgcctccgcccccctctacaaacaccaccgcgcctcctccggccactcctgctgcgcctccgccatcttcgccgtcgcctccaccgcccactgcaccgacgggatcgccgcctacagccccggctggttctcctccgcctcctccggactctcctggctctccaccaccttcgggccaaaccggttcaccaccgccaccttctagggcttctccgccaccaccaccatcttcaccatcttcgaacaagagcccaccgccacctccgtccgactcaaaatcacctccgccgccgccttcgtctccatcctcaaacactgtatctacaggtcttgtagttggaatcgccataggtggagttgttattctcgtggtgctgagtcttctcttcatatgttgcaagaagaagaagaggagagatcacagacaggactactatgtgccgccgccgccgggtttctcaaagagcacattcacgtatgaagaattggtgatggcaacagatggcttctcaaatgccaaccttcttggacaaggtggttttgggtatgtgcacagaggtgtccttcccaatgggaaagaagttgcagttaagcagctcaaagctggaagtgggcagggggagcgtgaatttcaggcagaggttgagatcattagtcgagtacatcacaaacatcttgtaaccttagctggatattgcatcactggatcacatagactgcttgtttatgagtttgttccgaacaacaccttggagtttcatttacatggaaaaggacgacctactatggattggtccacaagactgaaaattgctttaggatctgcaaaaggactcgcatacttgcacgaggattgtcaccctaagatcattcatcgcgatatcaaggcagctaatatacttttggatttcaagtttgaggcaaaggttgcagattttggacttgctaagttttcttctgatgccaatactcatgtctcgactcgggtaatgggaacttttgggtacttggctccagaatatgctgcaagtgggaaactttcagacaagtcagatgttttctcctttggagtcatgcttcttgagttgcttactggtcgcagacctgttgatgcaaaccaaaccttcatggaagatagtttggtggactgggcgagacctttgctcacaagagctcttgaagatggaaactttgatactcttgttgatccgcgcttgcaaaaggattacaaccaccacgaaatggctcgcatggttgcttgtgctgctgcttgtgtgcgtcattcagcccggcgtcgaccaagaatgagccagattgtccgggcattggaaggagatgcatctctatctgatcttaatgaaggaatgagacctgggcaaagctcaatctacagttcccatggaagttcagactatgacaccaaccagtacaatgaggacatgataaaattcagaaagatggcgttggcaagcagggactatggcagcagtgagtacagtggacctacaagtgaatatggtttgtatccatctggctcaagtagcgaaggccaacgaaccacccgagagatggagatgggaaagatgaagaaagacagtcgaggctacagtggaggctctgaaaaataacgctcatttctgtaaagacccacccctttattcttataccatcactagtctcaattgcaagaatgccattctacatgagataacagccaccattttttccccttctatcctttttttcttttaaaaaatgtatttattaatgcttatacaacaaaataatggagatcttgattctattcttttgtttgatcctttgtttgttggctttgatttggccactgatatcttgtagactttttcccttttatcttctggcttcatcatctgtttccctcttatttgaaattcaaatgtttgatcagaatctactgtagaatacatttatttt

SEQ ID NO: 9214 - DNA, 733 bp, Glycine max
gggatctctctttacaaacttccttgtcctgctgcactttcccactatcaaaacttccaaactcaacaacatggaacgttttgtgcgcctcctaactgttgtattagccatggctatggtgctggctgcaccagcccacgctcagatcagcacgccatgcagcacatcaatgataaacggctttttcaacccttgtatgaatttcctcacaaatagcagtggcaatggcaatggcacttcacctactgctgagtgctgcaattccatcaagtccctcacaagtggcggcatggactgtttgtgtctcattatgactggcaatgttccctttagaataccaatcaaccgaaccctggccatctctcttcctcgtacttgcaatttgcctcgtcttccacttcaatgcaaaagttcaccacttccagctccaggacctgcggcttttgggccatctctttctccatctgctccatctcttagtcctgaagcttcctctgtacttccttcaccttctttggcaccactgtctgacataacccctcctcttttgactccatcatctgcaaccacgggaagtggtcgttctgatctgactccatcttctgccatgccatcttaccgttttctaccttcagttgtgttgattgcgttaggatttgctgttcttaaacactattagttgccgtgccttccacaattccacatccttaatttgtggatgcgcacgtaccta

SEQ ID NO: 9215 - DNA, 1414 bp, Glycine max
gaggtccctccaaaacaaacctgtatcatcttcttactctttcgtttgtctctcttctttccctttcccctctctttcgagggtttttctttttctttttttcccccttttttatttttcctttttttttttttttactttctcttgtttttcagttttgcttccatttcctttgaatccccatttcttgttcctctgcaactctaaccctagaattgaagatgcaaccacagaggttaaggcagcatgccatgttgcaaccatctctctaccaccaccccgctctccttactcctcctcagatagagcctatcttgagtggaaatctgccacctggctttgattcgagttcatgccgcagtgtttatgttggcaacattcatccccaggttacagattcccttcttcaagagcttttttcaactgcaggcgcccttgaaggatgtaaacttattaggaaagagaagtcatcctatggctttgtggactactttgatcgcagttctgctgcatttgccattgtaactctcaatgggaggaatatttttgggcagcctattaaggttaactgggcttatgctagcagccagagagaggatacctcaggtcactttaatatttttgtcggtgaccttagtcctgaggttacagatgcgacattgtatgcttgcttctctgtatatcctagttgttctgatgcaagggtaatgtgggatcagaagacaggccgttccaggggatttggatttgtttcttttcggaatcagcaggatgcccaaagtgctataaatgatttgactggaaaatggcttggaagtagacagattcgttgtaattgggcaaccaaaggggccagtgccagtgatgaaaagcagagttcggattcaaaaattgtcgtggagttgatcaatggatcatccgaagaaggccaggaaacaaccaatgatgacactcccgagaagaatcctcaatataccactgtttatgttggtaatcttgctccggaggttacttctgttgatctccatcaacattttcattctcttaatgccggaattattgaagatgttagggtgcaacgagacaaaggttttgggtttgtgagatacagtacccatgctgaagcagctcttgctatacagatgggtaatgcccgaattctatttggcaaacctatcaagtgttcatggggtagcaagcctactcctctgggaactgcctctactcctcttctgccaccttctgcaaatgtgccgggcttttctctggctggtcttgcagcatatgaacgtcaaatggctttgagtaaaatgggtggtgcacacacccttatgcatcaacaaggtcaacatgccctaaagcatgtagacatgggaatgggtgctactgggactggttctgatgcaagttccag

SEQ ID NO: 9216 - DNA, 1724 bp, Vitis vinifera
gctttcgagggttttttttttttttttgaatttttttcttttaaatttttttattttttatttcttctcgccggaaccctaaccctaaatctcgtcggagaaatctttgcccgatcagcgaagatgcagcagcagagactgaaacagcagcaacaagccttgatacagcaatcgcttcttcagcagcagtctctgtaccaccaccctggtctcttggctcctcctcagatagagcctatcttgagtggaaatctgcctcctgggtttgattcaagtacatgccgcagtgtgtatgtgggtaatatccacccacaggttacagaaccacttcttcaagaggttttctctagtactggtcccctcgaagggtgcaagctcattaggaaagagaagtcatcctatggttttgtcgattactttgaccggagatctgctgccctttctattgtgactctgaatggaaggcatctgtttggtcagccaatcaaagttaattgggcatatgctagtagtcagagagaggatacatcaggtcattacaatatttttgttggtgatcttagccctgaggttacagatgctacactgtttgcatgtttctctgtttatcctagctgttcttctggtatcagagatgctagggttatgtgggatcagaaaactgggcgttcaaggggttttgggtttgtttctttccggaaccagcaggaagcccaaagtgcaattaatgacttaaatggaaggtggcttggaagcagacagattcgttgtaattgggcaacaaaaggtgctggaggtaacgaggacaagccaaattcagatgccaaaagtgttgtggaactaactaatggaacatctgaagatgggaaagacaagtcaaatgatgaagctccagagaacaatcttcagtataccactgtttatgttggcaatcttgctccagaggttacttcagttgacctccaccgacattttcatgcacttggcgctggagctattgaagatgttcgggtgcaacgagataaaggctttggttttgtgagatacagtacccatgctgaagcagctctggctattcagatgggaaatgctcggattctctgtggcaaaccaattaagtgctcatggggcagcaaacctactccagcagggacaagctccacccctcttcccccaccagctgctccacatatgcctggtatttcagctgctgactttgcagcgtatgagcgacagatggcattgagcaaaatgggtggtgcacaaggcctcatgcatccgcaggctcagcatgccctaaagcagacagccatgggaatgggtgctggtgggagtagtcaggcaatctatgatggtggattccagaatgctgcaacaacccagcaactcatgtactaccagtaggtacaagatgacaactcccattatataccttggcaggcaggaattaaatctttgttgaactgtagaacgctttgttttctttcttctttacccgtgtcatatacattctgcgtgcatggaattgtaacatacaatgtattcccgagggatgatcccgcattcaggctttctgtgaggatgagcatgtagcatacaatgtattctgggggatgatcccacctgcaggctttctgtgcggatgagtggctacggtttctgatgggatccttttcattacccactatagtttttccttctaccggttttcttttccctgttac

SEQ ID NO: 9217 - DNA, 1733 bp, Vitis vinifera
gctttcgagggttttttttttttttttgaatttttttcttttaaatttttttattttttatttcttctcgccggaaccctaaccctaaatctcgtcggagaaatctttgcccgatcagcgaagatgcagcagcagagactgaaacagcagcaacaagccttgatacagcaatcgcttcttcagcagcagtctctgtaccaccaccctggtctcttggctcctcctcagatagagcctatcttgagtggaaatctgcctcctgggtttgattcaagtacatgccgcagtgtgtatgtgggtaatatccacccacaggttacagaaccacttcttcaagaggttttctctagtactggtcccctcgaagggtgcaagctcattaggaaagagaagtcatcctatggttttgtcgattactttgaccggagatctgctgccctttctattgtgactctgaatggaaggcatctgtttggtcagccaatcaaagttaattgggcatatgctagtagtcagagagaggatacatcaggtcattacaatatttttgttggtgatcttagccctgaggttacagatgctacactgtttgcatgtttctctgtttatcctagctgttcagatgctagggttatgtgggatcagaaaactgggcgttcaaggggttttgggtttgtttctttccggaaccagcaggaagcccaaagtgcaattaatgacttaaatggaaggtggcttggaagcagacagattcgttgtaattgggcaacaaaaggtgctggaggtaacgaggacaagccaaattcagatgccaaaagtgttgtggaactaactaatggaacatctggtgaggtcatttatggaatacaaaatgggaaagacaagtcaaatgatgaagctccagagaacaatcttcagtataccactgtttatgttggcaatcttgctccagaggttacttcagttgacctccaccgacattttcatgcacttggcgctggagctattgaagatgttcgggtgcaacgagataaaggctttggttttgtgagatacagtacccatgctgaagcagctctggctattcagatgggaaatgctcggattctctgtggcaaaccaattaagtgctcatggggcagcaaacctactccagcagggacaagctccacccctcttcccccaccagctgctccacatatgcctggtatttcagctgctgactttgcagcgtatgagcgacagatggcattgagcaaaatgggtggtgcacaaggcctcatgcatccgcaggctcagcatgccctaaagcagacagccatgggaatgggtgctggtgggagtagtcaggcaatctatgatggtggattccagaatgctgcaacaacccagcaactcatgtactaccagtaggtacaagatgacaactcccattatataccttggcaggcaggaattaaatctttgttgaactgtagaacgctttgttttctttcttctttacccgtgtcatatacattctgcgtgcatggaattgtaacatacaatgtattcccgagggatgatcccgcattcaggctttctgtgaggatgagcatgtagcatacaatgtattctgggggatgatcccacctgcaggctttctgtgcggatgagtggctacggtttctgatgggatccttttcattacccactatagtttttccttctaccggttttcttttccctgttac

SEQ ID NO: 9218 - DNA, 1668 bp, Nicotiana plumbaginifolia
catcttctgttttgcagctctctccctctccttcgagggtttcttttcttttcttttttttctttctttctttttttcttttcttttcgatttttccttctttcaatcaaaaccctaattatcccttcaatttctttatctttttttttttctatttaaattccccatatttagaaagatgatgcaacagcaaaggctgaaacaacagcaacaacaagcattgatgcaacaatcactttatcaccctggtctcttagcaccccctcagatagaacccatcttgagtggaaatctgcctcctggatttgattcaagtacttgcaggagtgtgtatgtgggaaacatccacccacaagttacagaaccacttcttcaggaggttttcgcaagcactggtccccttgagggatgcaagctcataagaaaggacaagtcatcctatggttttgtggattactttgatcgccgatcagctgcccttgcgattgtgacccttaatggaaggcacttgtttggacagcctataaaagttaactgggcatatgcaagtgctcagagagaggacacatcaaatcactataacatttttgtgggtgatcttagtccggaggttacagatgccacattgtttgcatgcttttcagtctacactagctgctctgatgcaagagtgatgtgggatcagaaaacaggccgatcgagggggtttggatttgtctccttccgtaatcagcaggaggcccagagtgcaataaatgacttgaatgggaagtggcttggtagcagacaaatccgctgcaactgggcagcaaaaggtgctggagccgttggcgagcagaattcagatgccaaaagtgttgttgaattgactagtggaacatcagatgatggtcaagaaaaggtggtcaacgaagatgctccagaaaataatccccagtatacaactgtttacgttggcaaccttgctcctgaagttacttcagttgacctccatcgacattttcatgctcttggggctggtgttattgaagatgtccgtatccaacgagacaaaggttttggttttgtaagatacagcagccatgctgaagcagctcgagctattcagttggggaatgccagactcctttttggtaaacctgtcaagtgctcgtggggaagcaagccaactccaccaggaagcagttccaaccctctaccacctccggctataggacaaatccccggtctttcagcaatggatcttgcagcataccagaggcagcttgctttagctaagatggctggtgctcaggctttcatgcagccccagggtcagcgaatcggcgctcccggtcagggtatttatgatggtggttatggaggcattgcttcaactcaaccaccaatgtacttctagttaatcaataatgctacctacatgtaaacaccttttgttgttacttcactgcattttgaagttgtaggatcatttccttttcctatttattattagcttgtcagcttcttgtaatacctgtagcatgtatggtttacatggtttgtattctgctcgaggttaaatagttgattagctaaaccgatggcagttcattggatgagcagtgatcaactattttcctctttattttttatcttttcttataaataaatatcattgaaaaagcg

SEQ ID NO: 9219 - DNA, 1578 bp, Vitis vinifera
cagaaaatgcagcatcagaggctgaaacagcaacagcaagccttgatgcagcaagctcttcttcagcagcagtcgctctaccaccccggcctcttggctcctcctcagatagagccaataccaagtggaaatctgcctcctggttttgattcaagtacatgccgcagtgtgtatgttgggaacattcatacgcaggtatcggaaccacttcttcaagaggtttttgcaagtactggtcctgttgaaggctgcaagctcgttagaaaggaaaagtcatcctatggattcatccactactttgatcgcagatctgctgcattggctatattgtctctaaacggaaggcatctgtttgggcagcctatcaaagttaattgggcatatgctagtggtcaaagggaggacacatcaggtcacttcaacatttttgttggtgatctcagccctgaggttactgatgctacattgtttgcatgcttttctgtttttcccagttgttcagatgcgagggttatgtgggatcagaagactgggcgttcaagagggtttggatttgtttctttccgcaatcaacaggacgcccaaagtgctatcaatgacataaccggaaagtggcttgggagtcgacagatacgttgtaactgggcaactaaaggtgctggttccaatgatgataaacaaagttcagatgccaagagtgtggtagagctgaccaatggttcatcagaagatggtaaagagacagcaactaatgaggctcctgacaacaaccctcagtatacaactgtttatgtgggcaatcttgctccagaggtgacacagcttgatctccatcgtcactttcatacttttggtgctggggtaattgaggaagttcgggttcaacgagataagggctttggttttgttagatacaatactcatgctgaggctgctctggctattcagatgggaaatacccagtcaattctgtgtggcaaaccaatcaagtgctcatggggtagcaagccaactccaccaggaacaagttcaaacccactccccccacctgcagctgcacctctgccaggtctttcagccacggacctcctagcttatgagcggcaactagcaatgagcaagatgggccatgcactgatgcaccctcaggggcagcatcctcttaagcaggcagcaatgggaatgggggccgctggagcaagccaggcaatatatgatggcggcttccagaacgttgctgctgctcagcagctcatgtattaccagtaatataatcagagttagttattatcctatgttaaaaaaacttttattttcctgcatttgcagggtttattctgagtttctaaacctctaggaagctttctgatgtttttccttttgtccagtggtgtgaggctgttacccacccttttatatgcttgccatttgtatggatacgtatatgtactacctttttctgttttctttctgttctgtagcgatgatgagtgcttatgttattagaggcagtttggcatttggatactacacatatctgatatccctccataactggtttctttttctatccttttt

SEQ ID NO: 9220 - DNA, 4228 bp, Vitis vinifera
tagagccaataccaagtggaaatctgcctcctggttttgattcaagtacatgccgcagtgtgtgagtgtttgtctggacatttttttttcttttgttttttttgttgcatgtttgttgcttctcatgcatgcaactagaagagcacttttatttttcttaaccatgaaattcttgtagctctccatttgtagattttcagcttcaaaatttgacgtcatttctttggttaccccattatttttacacctacacctgcttttaaaaaatcacttttaaatggtgtttacttatatggatgtctatttgtatgctgtatatatatgtatatattttttttggggattcaaaggggattttcctttttgctcaagcttttctttgttcttttcttttctagaatttatagtttctttatctttgaggaaatgcaggtatgttgggaacattcatacgcaggtatcggaaccacttcttcaagaggtttttgcaagtactggtcctgttgaaggctgcaagctcgttagaaaggaaaaggtatattcttctttatgctatcttgttaatttttggattgtacctgttaagctgaagatctgtatggaaaagttattagacttctcacatgttagtttagcattctatcccttactttgctggtttatcatcatattgacatctccattgattctcctcggtgcagtcatcctatggattcatccactactttgatcgcagatctgctgcattggctatattgtctctaaacggaaggcatctgtaagaagaacccttgatttttatttatgttacatgttgggatttgtttctgttgctcattttgtaatttgcaggtttgggcagcctatcaaagttaattgggcatatgctagtggtcaaagggaggacacatcaggttggtttctgtagtttaattctatgcataagtttcactcttatgctgcaaactgattctatggagttttggcattcatcattgttgatgttgtattcttgtatgatgttgtgtaggtcacttcaacatttttgttggtgatctcagccctgaggttactgatgctacattgtttgcatgcttttctgtttttcccagttgttcgtaagcttcactttacccatccttctgtttcttttgtcctttttcttttccttttttcctttttttcctttttcctttgaaaaacagaattgggtgattctttgttgggttaaatttttatgaatgtggactcactakttagaccttattatgattaaatgaagctatcttttactttcattgtcggaaaatagatgacattatgtttgtgctggttttagagatgcgagggttatgtgggatcagaagactgggcgttcaagagggtttggatttgtttctttccgcaatcaacaggttctttttttctttttgattttttcaatttttttttttcctagacagatattgtttcttctaataattttctacaatattttatttcttttgttcaggacgcccaaagtgctatcaatgacataaccggtaaggatggtgcagttttacttcagatctgctccttcaccatatttttaactccaacctattttcatgtcagataaagccaaaatgggttctagaaatctagtcacactttttgtgatgtatctgagacaatgaaattgtgataagcaccatttagaagttttcattgtgctcaagtcttatcgttgatgtgtagccatttagaatttgttgtggtgtgcaaaggagtaagtttcctttggagttcatcggcattctgacatgtgataattatgttgcatatgcttgcctttacatcgccttttcttatgataatttgtgttctgacttaaacacattcaggaaagtggcttgggagtcgacagatacgttgtaactgggcaactaaaggtgctggttccaatgatgataaacaaagttcagatgccaagagtgtggtagagctgaccaatggttcatcaggtgagttggatacaagacattatattagatgctgagaactggtggtagttgcccttgaggatcattttaactagaccatactttttaatgtaaaaattatgagtgaaggcatattttcttttcttttcttttcttttcttttctttttgtgtgttttttttttttttggaacaggtagtgttcttgtaggcatttctggtatctcttgatcattgtttgcgtttggtagttaagggagagagtttagtcttgtaaaggttcatgagtccagtagtgatacttttgttcttaatttagatttttatgaactgtttggaggtagtttgagcagtattttctttgtcgtgtttttttgcttatcccttttttgttgtctttagttttgggtgtttcttaatacatttttgctgaggtccttttcttaaatatcttattgatgtttgcctgttgaaaatttgtttgctcactctattcaaggatgcttttgtactaaatcattgtctcctttggattatatgctagagattatgatagtgatataagaaaccttatgtttgttgcattccttgtgcagaagatggtaaagagacagcaactaatgaggctcctgacaacaaccctcagtatacaactgtttatgtgggcaatcttgctccagaggtaggaaacaattcgccaaaaattttccctttttactttatttatttgtttatgctttggtttggcatctcattaacttgtgaaaatcctttttgttcatctgctatgcaggtgacacagcttgatctccatcgtcactttcatacttttggtgctggggtaattgaggaagttcgggttcaacgagataagggctttggttttgttagatacaatactcatgctgaggctgctctggctattcagatgggaaatacccagtcaattctgtgtggcaaaccaatcaaggtatgatttatgccttcctagtcaaactgtgctactccaatggaatgatgacgcatacctttttatccaatcttgaataatagcagtcagatgttagtggcccagttatgtcttcatggtatgtctcagatggtagtttgtgggttcaagtccttaaaagtagtttatacaggtttgcaaagcatcaatcatgcttcttttgtggggttaaatttgatgtgctttttttgaatccttaaacacattaccggcagtacatatcctagttgaattaatagagctgcccactgctacatttctagatctcccatctgccaggattcgttgtatgttcgagaattatttcttcagacagccatagcgttgagattgaattaatagagctaccctttgcagttctagatctcccatctgccaggatctgtcgttgtatgttcaagacctatttcctattacagtcatagtattgagacatggtgtgataatttggtaacatctatgcaaatttcattgggttagaatgaggcatatgaactagaattatatattctggtgctctgatggcccctcttagttctttgttgtatgtggtggaagttcaattgccaaataaacagtctaatattgcaattcgtcaagttaggaaattattgtcaaacatctgtaactaacacagtttgaccttcattaacatatttctggtaggctggaaaaccttcccattgagagcataagctcttttattatgcatttaaattgtactctacatttttttgacagatgcagcgtttgacgtaattccagtttagaatgtggtttaattattcaatgccaaaattttctttcagattagggcaagaaatcactgagcattgtttcttgattttcaattcccttgtctgtgatgaaagcaatacatcgatccaccttttttccataatattggtgatctactgttggattgaccatagaatatgcttccttttatgctgttgtagtgctcatggggtagcaagccaactccaccaggaacaagttcaaacccactccccccacctgcagctgcacctctgccaggtctttcagccacggacctcctagcttatgagcggcaactagcaatgagcaagatgggccatgcactgatgcaccctcaggggcagcatcctcttaagcaggcagcaatgggaatgggggccgctggagcaagccaggcaatatatgatggcggcttccagaacgttgctgctgctcagcagctcatgtattaccag

SEQ ID NO: 9221 - DNA, 1885 bp, Medicago sativa
ggcacgaggcattcaaacccaaaaaactataggaatattcacaatcatatagctgcataaattaacacaaaaccatatggattctcttctaaaatatccaatcatggagaactttaaggaagaaccatttcttatggcaatcatgttcatcttaccactaatactcttgttgggtttagtgtcacgaatcctcaaaaggccaagatatccaccaggaccaaaagggttacctgttataggtaacatgctaatgatggaccaattaacccaccgtggtctagccaacttagccaaaaaatatggaggcatctttcacctacgcatgggattcctccacatggtagctatttccgacgcagacgccgcacgacaagttctccaagttcaagacaacatcttttccaaccggccagcaactgtagccattaaatacctaacttacgaccgtgctgacatggcgttcgctcactacggtcccttttggcgccagatgcgaaaactttgcgtgatgaagcttttcagccgcaagcacgcagagtcttggcaatctgttagagacgaggttgaccatgctatccgaactgtttcggacaacataggcaaccctgtgaacattggagaactggtgttcaatttaactaaaaacattatatatcgagcggctttcgggtcgagctcaagagaaggacaagatgagtttattggaatattgcaagagttttccaaattgtttggagcttttaatatttccgactttgtaccttgttttggagctattgaccctcaagggcttaatgctaggcttgtgaaggctcgtaaagatttggatagtttcatagacaaaatcatagatgaacatgtgcagaagaagaaaagtgttgttgatgaagaaacggatatggtggatgagttgcttgctttctatagtgaggaggctaaattgaataatgaatcagatgatttgcataattccatcaaacttaccaaggataacatcaaagccatcataatggacgtgatgtttggaggaacggaaacggtagcatcagcaatcgaatgggctatggcagagttaatgaaaagcccagaagatcttaaaaaagtccaacaagaactagcagaagttgtcggcctgagccgacaggtcgaagagcccgatttcgagaaactaacttatctgaaatgcgctcttaaggaaaccctacgtcttcacccaccaattcctttgcttcttcacgaaactgcggaagaagcaacggttaatggttatttcattccaaagcaagcgcgtgtgatgataaacgcatgggctattggaagagacgcaaattgttgggaagaacccgagagttttaagccatcacggtttttgaaaccaggtgtgcccgattttaaagggagtaattttgagtttattccgtttgggtcaggacgtagatcctgtccaggtatgcagttgggtttgtacgcgcttgatttggcggtagctcatttacttcattgctttacttgggagttgccggatggaatgaaaccaagtgagatggatatgagtgatgtatttggactcactgctccgagagcaagtcgactcattgctattcctactaagcgtgtcttgtgtcctctggattagaaagaaaaagaggaagaaaaaaaattgaccttgaattttctattttgagtttttcttttttattgttattctattaaacaataagcataagtgttatgtgatgataaaataagacacgtaacaagaacgtgagagtgtaaaagaattggaattttcttcacttttcttgatgtaagcttctattttcaaatattataatgtattatcctataagaaacaattccttgaataaaaaaaaaaaaaaaaaaa

SEQ ID NO: 9222 - DNA, 1904 bp, Medicago sativa
ggcacgagggttgcaagcaatcccttcaaaccaaaaaaaactataggcacattcacaatcatatagctgcataaattaacacaaaaccatatggattcgcttctaaaatttccaatcatggtgaacttgaaggaagaaccatttcttatggcaatcatggtcatcgtaccactaacactcttgttgggtttaatgtcacgaatcctcaaaagaccaagatatccaccaggaccaaaagggttacctattataggtaacatgctaatgatggaccaattaacccaccgtggtctagccaacttagccaaaaaatatggaggcatctttcacctacgcatgggattcctccacatggtagctatttccgacgcggacgccgcacgacaagttctccaagttcaagacaacatcttttccaaccggccagcaactgtggctattaaatacctaacttacgaccgtgctgacatggcgttcgctcactacggtcccttttggcgccagatgcgaaaactctgcgtgatgaagcttttcagccgcaagcacgcagagtcttggcaatctgttagagacgaggttgactatgctgtccgaactgtttcggacaacataggcaaccctgtgaatatcggagaactggtgttcaatttaactaaaaacattatatatcgagcggctttcgggtcgagctcaagagaaggacaagatgagtttattggaatattgcaagagttttccaaattgtttggagcttttaatatttccgactttgtaccttgttttggagctattgaccctcaagggcttaatgctaggcttgtgaaggctcgtaaagatttggatagtttcatagacaaaatcatagatgaacatgtggagaagaagaagagtgttgttgatgaagaaacggatatggtggatgagttgcttgctttctatagtgaggaggctaaattgaataatgaatcagatgatttgcataattccatcaaacttaccaaggataacatcaaagccatcataatggacgtgatgtttggaggaacggaaacggtagcatcagcaatcgaatgggttatggcagagttaatgaaaagcccagaagacctaaaaaaagttcaacaagaactagcagaagttgtgggtctgagccgacaggttgaagaacccgatttcgagaaactaacctatctaaaatgcgctcttaaggaaaccctacgccttcacccaccaattcctttgcttcttcatgaaactgcggaagaagcaacggttaatggttatttcattccaaagcaagcgcgcgtgatgataaacgcatgggctattggaagagacgcaaattgttgggacgaacccgagagttttaaaccgtcgcggtttttgaaaccaggtgtgcccgattttaaagggagtaattttgagtttattccgtttgggtcaggacgtagatcctgtcccggtatgcagttgggtttgtatgcgcttgatttggcagtggctcatttacttcattgctttacttgggagttgccggatggaatgaaaccgagtgagatggatatgagtgatgtatttggactcactgcaccaagagcgagtcgactcattgctattcctactaagcgtgtcttgtgtcctttggattaaaaagaaaaagaggaagaaaaaaaaatggaccttgaattttctattttgagttttttttttattgttattctattaaacaataaggataagtgttatgtgatgataaaataagacacgtaacaagaacgtgagagtgtaaaagaattggaattttcttcacttttcttgatgtaagcttctattttcaaatattataatgtattatcctatcctataagaaacaattccttgtataaaaaaaaaaaaaaaaaaaa

SEQ ID NO: 9223 - DNA, 1897 bp, Medicago truncatula
agcaacactcaaatatagttgcaagcaatatcttgaaacccaaaaaactaacgcacatccacaatcatatagctgcataaattaacacaaaaccatatatatggattcgcttctaaaatctccaatcatggagaacttgaaggaagaaccatttcttatggcaatcatgttcatcgtaccactaatactcttgttgggtttagtgtcacgaatcctcgaaagaccaagatatccaccaggaccaatagggttacctactataggtaacatgttaatgatggaccaattaacccaccgtggtctagccaacttagccaaaaaatatggtggcatctttcacctacgcatgggattcctccacatggtagctatttccgacgcggatgccgcacgacaagttctgcaagttcaagacaacatcttttccaaccggccaacaactgtagccattaaatacctaacttacgaccgtgctgacatggcgtttgctcactatggtcccttttggcgccagatgcgaaaactctgcgtgatgaagcttttcagccgtaaacacgccgagtcttggcaatctgttagagacgaggttgactatgctgtccgaactgtttcagacaacataggcaaccctgtgaacattggagaactagtattcaacttaaccaaaaacattatatatcgagcggctttcgggtcgagctcgagagaaggacaagatgagtttattggaatattgcaagagttttccaaattgtttggagcttttaatatttctgattttgtaccttgctttggagctattgatcctcaagggcttaatgctaggcttgtgaaggctcgtaaagaattggatagtttcatagacaaaatcatagatgaacatgtgcagaagaagaagagtgttgttgatgaagaaacggatatggtggatgagttgcttgctttctatagcgaggaagctaaattgaataatgaatcagatgatttgaataattctatcaaacttaccaaggataatatcaaagccatcatcatggacgtgatgtttggaggaacggaaacggtagcatcagcaattgaatgggccatggcagagttaatgaaaagcccagaagacctaaagaaagtccaacaagagctagcagaagttgtgggcctgagccgacaggtcgaagagtccgattttgagaaactaacttatccgaaatgcgctcttaaggaaaccctacgtcttcacccaccaattccattgcttcttcacgaaactgcggaagaagcaacagttaatggttatttcattccaaagcaagcgcgtgtgatgataaacgcatgggctattggaagagatgcaaattgttgggaggaacctcagagttttaagccgtcacggtttttgaaaccaggtgtgcccgatttcaaaggaagtaattttgagtttattccatttgggtcaggacgtagatcctgtcccggtatgcagttgggtttgtacgcgcttgatttggcggtagctcatttacttcattgcttcacttgggagttgccagatggaatgaagccaagtgagatggatatgagtgatgtatttggactcactgctccaagagcgagtcgactcgttgctatccctactaagcgtgtcttgtgtcctctggattagaaagaaaaagatcaagaaaaaaaaatggaattgagttttctattttgggttttcttcttttattattattctattagacaataagcataagtgttttgtgatgataaaataagacacgtaacaagcacgtgagtgtgtaaaagaattggaattttcttcacttttcttgatgtaagcttctattttcaaatattataatgtattatactatcctataaaaaaaaaaaaaaaaaaaaa

SEQ ID NO: 9224 - DNA, 1878 bp, Glycine max
gagcgacaacaacacttacttgaagttgtgctattcaatcccaaagccacagaaataatattattcagattttagagactgaaaacatcatggccaacctcgacctcgacccattccagacaagcatcttaatcctcgtcccaatagcactcctggtggcgttactatctcgtactcgtcgaagagcaccctacccaccaggcccaaagggtttaccaatcataggaaacatgttaatgatggagcagctaacccaccgcggcctcgccaacctggccaaacactacggcggcatcttccacctccgcatggggttcctccacatggtcgccatctccgaccccgtcgccgcgcgtcaggttctccaagtccaagacaacatcttctccaaccgcccagccaccatcgccatcagctaccttacctacgaccgcgccgacatggcttttgcccactacggccccttctggcgccagatgcggaaactctgcgtcatgaagctcttcagccgcaagcgcgccgagtcctggcagtcagtccgcgatgaggtcgacgccgccgttcgcgccgtcgctagcagcgtcggaaagcccgtcaacattggagaattagtgtttaacctcaccaagaacatcatctaccgcgccgcgttcgggtcgagttcccaagaaggccaggacgagttcattaaaatactgcaggagttctccaagctctttggcgcgtttaatattgcggattttataccctatctcgggtgcgtggatccacaaggtttgaactcgagactcgctagggcacgtggcgcgctcgatagcttcattgataagatcatcgacgagcacgtgcataagatgaagaatgataagagcagtgaaattgttgatggagaaacggacatggtggatgagttgctggcgttctacagcgaggaggcgaagttgaacaatgaatcggacgatttgcagaactctatcagactcactaaggataacatcaaggctatcattatggacgtgatgttcggaggcacggaaacggtagcgtcagcgatcgagtgggccatggcggagctcatgagaagcccagaagatcaaaagcgggtccaacaagagctggcggatgtagtgggcctggaccgtcgggccgaagagtccgatttcgagaaactcacttatctcaaatgtgccctcaaagagaccctccgcctccaccctccgataccgctcctcctccacgagacggcggaggacgccaccgtcggcggctacttcgtccccaggaaggcgcgtgttatgatcaacgcgtgggccattgggagggacaagaattcctgggaggaacccgaaacttttaagcccgcccggttccttaaaccgggcgtgcccgatttcaaggggagcaacttcgagttcattccattcgggtcgggtcgaagatcctgccccggaatggtgttggggctctacgcgcttgaattggcggtggctcatcttcttcactgcttcacgtgggaattgccagatggaatgaaaccaagtgagatggacatgggtgacgtgttcggactcaccgctccaaggtccacgcgactcattgctgtaccaaccaagcgcgtggtgtgccctctcttttaaaaataaaaaaaaaacacttggatctttctttttttcctctttgtattttctttttatcccttaattatacataatcataataaatgatataaagggaaaaaagggaggtgcgcaataagaatgtgggagtatttggaagaaaaaaatttgtaaaactcttcttgatcattgatgtgagcttttgtgcagaaacaattaattatgtatgtattttgtttctttttgcctcaaaaaaaaaaaa

SEQ ID NO: 9225 - DNA, 1457 bp, Medicago truncatula
  misc_feature (1420)..(1420): n is a, c, g, or t
tataaaggctccaatactcttcgctcaactcagcaacactcaaatatagttgcaagcaatatcttgaaacccaaaaaactaacgcacatccacaatcatatagctgcataaattaacacaaaaccatatatatggattcgcttctaaaatctccaatcatggagaacttgaaggaagaaccatttcttatggcaatcatgttcatcgtaccactaatactcttgttgggtttagtgtcacgaatcctcaaaagaccaagatatccaccaggaccaatagggttacctattataggtaacatgttaatgatggaccaattaacccaccgtggtctagccaacttagccaaaaaatatggtggcatctttcacctacgcatgggattcctccacatggtagctatttccgacgcggatgccgcacgacaagttctgcaagttcaagacaacatcttttccaaccggccagcaactgtagccattaaatacctaacttacgaccgtgctgacatggcgtttgctcactatggtcccttttggcgccagatgcgaaaactctgcgtgatgaagcttttcagccgtaaacacgccgagtcttggcaatctgttagagacgaggttgactatgctgtccgaactgtttcagacaacataggcaaccctgtgaacattggagaactagtattcaacttaaccaaaaacattatatatcgagcggctttcgggtcgagctcgagagaaggacaagatgagtttattggaatattgcaagagttttccaaattgtttggagcttttaatatttctgattttgtaccttgctttggagctattgatcctcaagggcttaatgctaggcttgtgaaggctcgtaaagaattggatagtttcatagacaaaatcatagatgaacatgtgcagaagaagaagagtgttgttgatgaagaaacggatatggtggatgagttgcttgctttctatagcgaggaagctaaattgaataatgaatcagatgatttgaataattctatcaaacttaccaaggataatatcaaagccatcatcatggacgtgatgtttggaggaacggaaacggtagcatcagcaattgaatgggccatggcagagttaatgaaaagcccagaagacctaaagaaagtccaacaagagctagcagaagttgtgggcctgagccgacaggtcgaagagtccgattttgagaaactaacttatctgaaatgcgctcttaaggaaaccctacgtcttcacccaccaattccattgcttcttcacgaaactgcggaagaagcaacagttaatggttatttcattccaaagcaagcgcgtgtgatgataaacgcatgggctattggaagagatgcaaattgttgggaggaacctcagagttttaagccgtcacnggtttttgaaaccaggtgtgcccgatttcaaaggaag

SEQ ID NO: 9226 - DNA, 1857 bp, Glycine max
ggaattcggcacgagggcgaaatcatccaaacacattccatctattaagattttagagagtgaaaatggattggcaaagcatgatgggcaacctggacccattccaaagaacaatcttaatcctcgtcccactaacactactcctgctgctgttactatctcgtacccgtccaagacccccctatccaccaggccctaagggcttcccaatcataggaaacatgtttatgatggaccagctaacccaccgcggcctcgccaacctggccaaacactacggcggaatcttccacctccgcatgggcttcctccacatggtcgccatctccgaccccgacgccgcgcgacaggttctccaagtccaagacaacatcttctccaaccgcccagccaccatcgccatcagctaccttacctacgaccgcgccgacatggcttttgcccactacggccccttctggcgccagatgcggaaactctgcgtcatgaagctcttcagccgcaagcgcgccgagtcctggcagtcagtccgcgatgaggtcgacgccgccgttcgcgccgtcgctagcagcgtcggaaagcccgtcaacattggagaattagtgtttaacctcaccaagaacatcatctaccgcgccgcgttcgggtcgagttcccaagaaggccaggacgagttcattaaaatactgcaggagttctccaagctctttggcgcgtttaatattgcggattttataccctatctcgggtgcgtggatccacaaggtttgaactcgagactcgctagggcacgtggcgcgctcgatagcttcattgataagatcatcgacgagcacgtgcataagatgaagaatgataagagcagtgaaattgttgatggagaaacggacatggtggatgagttgctggcgttctacagcgaggaggcgaagttgaacaatgaatcggacgatttgcagaactctatcagactcactaaggataacatcaaggctatcattatggacgtgatgttcggaggcacggaaacggtagcgtcagcgatcgagtgggccatggcggagctcatgagaagcccagaagatcaaaagcgggtccaacaagagctggcggatgtagtgggcctggaccgtcgggccgaagagtccgatttcgagaaactcacttatctcaaatgtgccctcaaagagaccctccgcctccaccctccgataccgctcctcctccacgagacggcggaggacgccaccgtcggcggctacttcgtccccaggaaggcgcgtgttatgatcaacgcgtgggccattgggagggacaagaattcctgggaggaacccgaaacttttaagcccgcccggttccttaaaccgggcgtgcccgatttcaaggggagcaacttcgagttcattccattcgggtcgggtcgaagatcctgccccggaatggtgttggggctctacgcgcttgaattggcggtggctcatcttcttcactgcttcacgtgggaattgccagatggaatgaaaccaagtgagatggacatgggtgacgtgttcggactcaccgctccaaggtccacgcgactcattgctgtaccaaccaagcgcgtggtgtgccctctcttttaaaaataaaaaaaaaacacttggatctttctttttttcctctttgtattttctttttatcccttaattatacataatcataataaatgatataaagggaaaaaagggaggtgcgcaataagaatgtgggagtatttggaagaaaaaaatttgtaaaactcttcttgatcattgatgtgagcttttgtgcagaaacaattaattatgtatgtattttgtttctttttgcctc

SEQ ID NO: 9227 - DNA, 1826 bp, Leucaena leucocephala
atggattcccttcttcttcatctccaacctcttgccatggccttgttgttcgcaatcccactcttactcctgctcggactcctctctcgattccgtaaaaggccaccctaccctccggggcccaaaggcctccccatcatcggcaacatggccatgatggaccagctcacgcacagaggactagccaagctggccaacctctacggcggcatactccacctccggatgggcttcctccacatggtagccatctccgacgccgactccgctcgccaggtgcttcaggtgcacgacaacatcttctccaaccgccccgccaccatagccatcagctacctcacctacgtccgggccgacatggctttcgctcactacggtcccttctggcggcagatgcgcaagatctgcgtcatgaagctcttcagccggaagcgcgcagagtcgtggcagtcggtgcaagatgaggtggagacggtggtccgtacggtgggggcgaataccgggaaggaagtgaatatcggggagctggtgttttcgctgacaaaaaacataacgtatagggcggctttcgggtcgagctcgagggagggacaggacgagttcattggaatacttcaggagttctccaagttgtttggagctttcaatatagcggactttataccgagtctcagctgggttgacccacaagggctaaacgccagactggccaaggctcgtggctcactggacagtttcatagacaagatcatcgacgaacacatgcaaaacaagaagaaggaagatgaagaaggtgacatggtggatgagctgctggctttttacagcgaggaccactctaaagtcagcgaatcggacgatctgcacaactccatcaaactcaccaaggataacatcaaagccatcattatggacgtgatgttcggagggacggagacggtggcgtcggcaatagagtgggccatggcagaactgatgagaagcccagaagatctgaagagggtccaacgggaactggccgaggtggtgggtcttgatcggagagtgcaagagtccgacatggagaagctgacttacctgaaatgcgctctgaaggagactctccgcctccacccaccgatccccttgctactccacgagaccgcggaagacgccgtggtttcgggctatttcgttccgaagaagtcacgcgtgatgatcaacgcctgggccatcgggagggaccgcaacgcctgggaggaccccgacagcttcaagccggcccgcttcctcggggagggcgtcccagatttcaaaggcagcaacttcgagttcatcccgttcgggtcgggtcgaaggtcctgcccggggatgcaactgggcctctacgccttggaaatggccgtcgctcaccttctccactgtttctcgtgggagttgccggacggcatgaagccgagtgagatggacatgagcgacgtcttcggactcaccgctcccagggcgagtagacttgtcgcggtctccaggaagcgcttggtctgccctctcttttaagggcagggagcatggcacgtaacgtgagcgaatgagacaggtctggtttctgtgttttattattttttgtagaaataaattatatttcaattattcataaatatgaagggaaacgttcgaagaaagaagaaagaaagaatggaaacggcaatagctggataggtggcaaaataaggagagtcgtgatgtggtgtggataaactttgtatgaattcctactgtaataatctcccctccttttgggttcaaaaaaaaaaaaaaaaaaaaaaaaaaaaaaaaaaaaaaaaaaa

SEQ ID NO: 9228 - DNA, 2194 bp, Camptotheca acuminata
aaatggatgctcttcgccaagttttgcatcctatgcccacagctctcttcttcattgcccctttgttcttcttgtttattctatctcgccttcgccgaaaactaccatatccaccggggccaaacggcttaccacttgtcggaaacatgatgatgatggaccagttaactcaccgcggactcgccaaactcgccaagcaatacggtggcatctttcaccttcgaatgggatttcttcacatggtggccgtgtccagcccagaaatcgcccgccaggttcttcaggtccaagacaatatcttctcgaatcgtccggcgaccatagccatcagctacctcacctacgaccgcgccgacatggcttttgctcactacggccctttttggaggcagatgcggaagctatgcgtcatgaagcttttcagccgcaaacgtgctgagtcgtgggagtccgtacgagacgaggttgattcgatggtccgagtggtggtgtcccacaccgggaaatctgtgaacataggcgagttagtgttttcactgactcgggatattatttaccgagctgcgttcggttcgagctcgcatgaaggccaggacgagttcatcaagatattgcaggaattctcgaaattgtttggtgctttcaatatcgctgatttcattcctggactggggtgggttgatcctcagggactcaacgccagactggttcaggctcgtgcatcgctcgatggcttcattgactcaatcattgatgatcatatcgagaagcatagaagaagaaacgtcgtcgactctgatggtgatatggtggatgatttattagctttttacagcgatgaggcaaaagtcactgaatccgacgatttacagaacgccatcagactcacaagagataatatcaaggccatcatcatggtaaggatcaacaaatatccaatctctttagttattccaactcgatctctttttgcaacgcttaaaaattacttccataaaaacatcttcttacaaaaacaaccaaattcatccctctattcatacgtattataagttttatatatatatatatatatatatatatatatatatatatatatatataaaaaactttttagctttaaatttaaaaatatatatgtaataaattatatttacaacacctacgagaataaattaaaattaaatattatttatattttataacaaaatgctttatttgattataaaaatataataaaatcaccttatttgagtgggtatatatataaaagttaatcattctggttggagcttttaaaaagaacaaaaatatttgagtagaagatcagtttcttgaataaataaaataaaaataacatatttgagtagaaatttattaatttattaagttttgattcaatttgagcttaagttaataaatcctctaatttttttttaaaaaaataaattactttcaagatgatatcaagaaattaatgagttcaaattaaataatgagttcaaacttaaacaaactactattccaaccatttactaccctaattatggtttgatgttgttaatatgagcaggacgtgatgtttggagggactgaaacagtggcatcggcaatcgagtgggccatggcagaactaatgaaaagcccagaagaccttaagagagtgcaacaagaactcgccgaggttgtaggtctcgaccggagactcgaagagagcgactttgacaagctaacatacctcaaatgtgcgttaaaagagaccctccgactgcacccgccgattcctctcctcctccacgagaccgccgaggacacggaggttgcgggctactatatccccgcgaggtcgcgtgtcatgatcaacgcatgggccattggacgcgacaagaactcgtgggacgaacccgagaccttcaagccttctaggttcctcaaagaaggcgtgccggactttaaaggaagcaacttcgaattcattccatttgggtcgggtcggaggtcgtgccccggaatgcaactcggactctacgcgctcgagatggccgtcgctcaccttcttcactgttttacgtggacattgccggacgggatgaaaccaagtgaactggacaccgacgatgtgtttggactcactgctccgagagcgactctttttgtcgccgttccgagcccacgtttactgtgtccactctat

SEQ ID NO: 9229 - DNA, 1781 bp, Glycine max
tctttcactactccccatctgttaaatttcgaacactagggttcaattttctccaacaatgaccctcactctattcctctgacttcccatagaccacaatacactcaccccaggcaaaaaatttcgtttcaaaattgtgatatggacggaagagcgagcagcagcgtgggcggagaagcatcgccagctccagcaccggtgccgataacgaatgcgaacgcgccgccgcctttcttgagcaagacatacgagatggtagaggacccttcgacggactcgatagtgtcgtggagtccaacgaacaacagtttcgtggtttggaaccctcccgagttcgccagagatctcttgcccaaacacttcaagcacaacaacttctccagcttcgttcgccaattaaacacctacggatttaggaaggtagatccagatcgctgggaatttgcaaatgagggatttttgaggggtcaaaagcacttgcttaagactataactcggcggaaacctgcccatggtcataatcaacaggcacagcaagcacatggacagagttcatctgttggggcttgtgttgaagttgggaagtttggacttgaggaagaggttgagattctcaagagagataagaatgtgctcatgcaagagcttgtgagattgaggcagcagcaacaggctactgataaccagctgcagagtatggttcagcgccttcaaggaatggagcaacgacagcaacaaatgatgtcattccttgcaaaggctgttcagagtcctggttttttagctcaatttgtacaacagcaaaatgagagtagtagacgcataacggaggcaaataaaaaacgccggcttaagcaggagggtattggtgaaatggaacatactgctgcttctgatggccaaattgttaaatatcaacctctgataaatgaagcagcaaaagcaatgctgaggcaaatgatgaaattggatacttctcgactagaatcttttagtaataacgctgataattacttgattggtgatcattcatcatcatccggtgcaacggacaggggaaactctttgagccggacttctggagtaacacttcaagtggtccctctgactacaatccagtcttctcacattccatctgcaacggggataggggatgacccttcaacaggaaaatctgagattctatctactcctcaagttgtagcctgtgatgaagttacgaaagctcagtactctaatgtaaatgtttcggttggagaatctaatgcacctgctatccctgctactcaaacagatgaaatcatgcgggacctctctacaataccagacatagtggcaggaaatattcttgatattcctcaagaaaattatatggcacctgagacaggcggtgaaggatatatggatcctacttcatttggagtgaatgtgtcattgcccattgattttgatagtatttcacctgaagcagacattgatgatttgttgaacaatcctcacttttgggatgatattttgcgaactccagtgtcagaggagattgatacgaatgatgctgaagtattcaaggagaatgaggtgcagccaatggaaaatggattggacgaatcacaaaatatggaccaacttactgagcagatgggcctactttcttctgatgccaaaagaatttgagtgtattatgaaagtgtacattattaatatttcatattgtgcaaggtaaccttagcctagacaatgggttatgttgttttagttaaaaaaaaaaaaaaaaaaaaaaa

SEQ ID NO: 9230 - DNA, 2003 bp, Lotus japonicus
acggtatcgataagcttgatatcgaattcctgcagcccgggtcgacccacgcgtccgaaccgattggagtctctgcaatcggcgtttgactatgctgtccagtctgaggggtatggctcccattaccagggggtttacccggtgaaatgcaaccaggacaggttcgtggtggaggacatcgtgagattcggttcttcgttccggttcggtttggagtcagggtctaaaccagagcttctcatggctatgagttgtctatgcaaaggcaacgcagaagcgcttctcatctgtaatggattcaaggacgccgagtacatttccctcgccctggctgcgaggaagctggctctgaactccgtgattgtgctggagcaagaggaggaggttgacctgatcattgatctgagcaacaagatgcacattcgccctgtgattggaatgcgggcgaagctgcggaccaagcattcgggccatttcggtgggacttccggtgagagggggaaattcgggctcacaactgctcagattctgagggttgtgaagaagcttgagcacgctggcatgctggattgcctgcaactcctgcattttcacataggctctcagattccttccaccgcgttgctcgctgatggtgtgggagaagctgcgcagatctattgtgaactggttcgtctcggggctcaaatgcgagtcattgatattggaggtggcctcggcattgattacgacggtacaaaatctagtgactctgatatctctgttgggtatggtcttcaagagtatgccactgcggtggttcgcgccgttcagggtgtctgcgaccggaggtccatcaagcacccggttatctgcagtgagagcggcagggctattgtttctcaccattctgtgttggtgttcgaagctgttggtgctagcagctatggagcgccccctgcattctcatctctggctctgcagtacttggtggaggggctctcggaggaagctcgtgctgattactgcaacctctctgatgcggcgatcaggggagaacatgagacctgcttgctgtacactgaggagatgaaacggcgctgcgtggaggagtttaagcaagggcttttgggaatggaagagcttgccggcgtggaggggttgtgtgatttggtaaggaagacggtgggggaggctgatccagttcggaggtaccacgtgaacctctccattttcacctctatccctgacgtgtggagcattgatcaggtgtttcccattatccccattcaccgcctcgatgagaagcccactgtgaaaggcatcctctctgatctgacctgtgacagtgatgggaagattgacaagttcatcaacggagagtcaagcttggcgatgcacgagttggaaggtgggaggaagtactatctgcgaatgttcttgggcggtgcttatgaggaggcgcttggtggttaccacaacttgtttggaggtcccagcgtggttcgggtgttgcagagcgaaggtccacacagcttcgcggtgacgcgtgcaatgccgggtccttccaatggagacgtacttcgagtgatgcagcaccagcctgagctcatgtttgagactctcaagcaccgcgcagaggagtctgtgcatgatgatgagctcactgctgcggctctcgccacagccctggctcgctcgttccacaacatgccttatctggtaactgctgctgaccatgctggagaggatgagcatgatcaatggtcttattgcattgcttgagtttggtcagtttctggttggttgtcgtcatttcaaaatttattcaacattttctgctctagtttagtttgttattagtttagcatacagaatgcagggaagtgagtgtcctctgtcattttgttttgtaatttccgccatcagctgaacctgtctatgactttcagtaaccaaattttattgatgcctccattgtcatatttagaataaaagtgctctgttattgaaaaaaaaaaaaa

SEQ ID NO: 9231 - DNA, 2112 bp, Vitis vinifera
catcaagagattgatctgatgaagatcgttaagaaagtttcggatccgaaatctgcgggaggactcggtttgcagcttcctctcatcgttcgattgcctgatgtgctccagaatcgtctggagtctctgcagtctgcgttcgacttcgcaatccaatctcaaggctacgaatctcactaccaaggtgttttccccgtgaaatgcaatcaggaccggttcatcgtggaagatgtcgtgaagttcgggtcggctttccggttcggcctcgaagctggttccaaaccggagctccttctggccatgagctgtttgtgcaaaggaaaccctgaagctcttctggtctgcaatggcttcaaagatgctgactacattgcgcttgctctggttgcgaggaaacttgctttgaatactgtgatcgttcttgagcaagaggaagagcttgatctggtgattaatctaagccagaagctttccgtgcgtccggtaattggtgtccgagccaagctgaggactaagcacgctggccattttgggtccacgtctggcgagaaagggaagtttgggttgactacgacacagattttgcgagtagtaagaaagcttgaacaagcaggaatgcttgattctctgcaattactgcatttccacatcggatctcagattccttctacagacttgctcgcagatggggtcagtgaagctgctcagatttactgtgaattggtccgtctcggtgcccatatgcgagtcattgacattggagggggtctcggtattgattatgatggatcgaagtcgagtgagtctgatatttctgttggttatgggcttgaagagtatgctatggcagtagttcgagctgtccagcatgtatgtgatcgcaagtcagtgaaacaccctgtgatttgcagtgaaagtggccgggctttagtctctcaccattcaattttgatctttgaggctgtttcggcaagtgtacatgattcacctgctacttcactcagtttacagcgctttgtggagggactttctgaggaagcccgtgttgattaccagaatctggctgctgctgcagttagtggcgagtatgagacttgcttgcgttttgctgatcaattgaagcaaagatgtgttgatcaattcaaggaagggtcgttaggtattgaacagcttgctgacgttgatgggctgtgtgacttggtttccaaggaggttggtgccactgatccagtgcgcacttaccatgtgaatttatcagtcttcacatgtattcctgatttctggggtattgggcagctgttccctatagtccccattcaccgactcgaccagaggcctggggcgaggggcattttatcggatttgacctgtgacagtgatgggaagattgataagttcattggcggtgagtcaagcttgcctctgcatgaactagaaggttcagatgttgtttttggtggtagtgggaagtactacttggggatgttcttgggcggggcttacgaggaggccctcggtggtttgcacaatctgtttggtggcccgagtgttgttcgggtgttgcagagcgatggacctcacagcttcgcagtgacgcgtgccatgccagggccttcctgcggagatgtgctccgagtgatgcagcatgagcctgagctcatgttcgagacacttaagcaccgcgctgaggagtgcggtcacgaggatggtatgaccaatggttctcttgctagtggacttgccctttccttccacaagatgccctatcttgtggcgggttcttcttgctgcatgactaacagcggttactattatggcaatgaagacaactacagtcgtgttgctgattctgctgctggggatgatgaccattggtcttactgctttgcttgagctagtcttggcatccccatgttttgtttgtcctggaggtcgccttaattttttttccttttttttttttagtttggttagaacagttttctgaattctgtgaagaagagaggggaatgggcccgaatcagacccttgtaaattcggaatcttattcccctttttctgtaatctttttatttccatctagtaaactttggaaattttagtttaaaaaaa

SEQ ID NO: 9232 - DNA, 2903 bp, Cucumis sativus
acgcgggggctcattctaacctcgtttaaacgcattccgtcgtctccgacggctctacatttctctccgcgttttctccgttaggtttccgtttcttccttcttctttttctccgcctcttttgcccggataattctcctttccattcattcccgattcctctttgttttcttttcttttttttttttgtttttggaccgaaattcttaatcccgttctttgaattcgtttccagatctgcatgggaagaacagtttcggtgtttaaggctttgattggtgtgtgttttaatttcattttttgtttcttcgttcttgtgaaattcttcttctgaccggatcgcggtgggatattgcaagtgtataggtgatcgtggtaaatttggcggtggaaatagctactctttctgcttcttttggggggggtagccggggcctcggcctcggcgggttttaaagcccccacttgcacaaaactctgaaacttccattactttttcttaacaacttctctaactacgactctcttctttctttaatttttccattttcttctttttattcatttcttgatccgtcgtcggagagatgccggccctagcttattgcgtagacgctgctgtagctcctcctcctggctacgtttttgctggggatagctctcttccgtcgtcggttttattttccggcggacctccggagactaccatcttttcctctcctgactctcctcccacctctgaaaacatgtcatggtctcctcctctttcgtcctctctttacaagattgatgggtggggtgctccttatttctctgttaatggttctgggaatatggctgttcgtccttatgggacagctactttaccccatcagaagattgatttgcttaaaattgtgaagaaggcttcagatccgatttgttctggtggtcttggcttgcagcttcctcttattgtgagatttcccgatgtgcttaagaatcgtcttgagtctcttcagtctgcatttgattatgctattcaatctcaaggatatggttctcattaccagggtgtttatcccgttaaatgtaaccaggataggtttgttgttgaagatattgtgaaattcggatcttctttccgttttgggcttgaagctgggtcgaaaccagagcttcttctggcaatgagctgtttgtgtaaagggaattcagatgcctttttggtgtgtaatggtttcaaggatgcggagtacatttctttggcgcttattgccaggaagcttgctttgaacacggtgattgttattgaacaagaggaagaaattgatttggttattgatttgagcaagaggctgtttgttcgtcctgtggttggtatgcgcgcgaagctgagaaccaaacattctggacattttgggtccacctctggcgagaaaggaaagtttggtcttacgactacccagatccttcgggtggttcggaagcttgaacaggctgatatgcttgattgccttcaattgctacattttcacattggatcccagatcccttctacagctttgctcgctgatggcgttggcgaggctgctcagatctattgcgaattggtccgtctcggtgccaacatgcgtgttattgacattggaggtggtctgggtattgactatgacgggtcgaagtcttcggactctgagttatctgttgcttatggactcgaagagtatgctgctgcggttgttgatgcagtccgctgtgtatgcgactgtcggtccgtgaagcacccaataatttgcagtgaaagtggccgagcaatcgtctctcgtcattccgttttgatatttgaggctgtctctgctagcagctatgaggtcccatccatgagctcacttgaacttcagtatcttgtcgatgggctaaccgatgaggctcgtgtagattatcagaacctttcggctgcagcttatatgggtgagtataaaacatgcttggtgtatgcagatcaactgaaacaacgatgcgttgagaaattcaaggatgggtgtttgggaatggaacaactagctgctgtagatggactttgcgctcttgttgccaaggctgttggagagttggactctgttagaacctaccatgtgaacctctctattttcacgtcaattcctgatttctggggtatcgaccagctgtttccaattgtccccattcatcgtcttgatcagagaccaaccgtgagaggcgtgctgtctgatcttacctgtgacagtgatggtaagattgataagtttattggtggtgagtcgagtttgccgttgcatgagctggaaggcaatggcagtttgtcaggtggaggaggtgggcgatactatcttgggatgtttctgggcggggcttatgaggaggctctcggtggtgttcacaacctgtttggtggcccgagtgtgattcgggtgatgcagagtgatggaccgcatagctttgcggtgactcgcactgtgcctggcccatcatgtggggatgtcctccgagtgatgcagcacgagcccgaactcatgtttgagaccctcaagcaccgagctgaagagtttggacaggaggatgacgatggtggtgagggcatagctaatagcttggccatgtcctttcgcaatatgccttatttggcgagtgcgtcttcctgctgcagtgagactgattacaatggtgctgtggattctggtgctggcgatgccgagcaatggacttactgttatgcttgacaaagtttgttaagatttaggcgtcctccagccatccctaattagctattgcatttcttctctagtaggtctgtttttgttgtccttatgggtccgtcgatgtatttccattaatttcccttttctatattttgcaaaaaaaagaaaaaaaaaaaaaaaaaa

SEQ ID NO: 9233 - DNA, 2851 bp, Trifolium pratense
ggcacgaggaacacgtcttctcaatctctattccaaaacctatcccattttttctcctcttttacccattcattcattcccaattgactcattctcattaaaaaaaaaccgtttcattctattatttttccattagatccgcatgttttgcttaaccttacaaacttaatttctctcattaacctcattatcattatttcccattcctattcattcattctatcaattaaccttgtttcattacccttaattaatccttcttctgattgttagttgtggggattcatttgttcatagaacggttcgtttggttcttctccatttttcattagatctatcactgtcatcttttgggggggtagccggggcttttgcctcggcgggtttcaaagcccccatttcacaaacctaattacaaaaaacatcacaaccctaattttttttattttcaattttaacctaatttttcattcggttgcgtaagagatgccggctttagcttgttttgtggatgctgctgctgcagttcttcctcctccttccggatacgctctcgccggagattcaactcttccgccgcctctcacatttacgacagcaacaactgacggtgtcgatgatgattccgattcagcttccaattggtctccttcactttccagcaaacttttcaaaattgacggatggggatttccgtatttcggcgtcaataacgccggagatatcgccgttaggccacatggcgcggcgacgatgtctcatcaggagattgatttgctgaaagttgtgaaaaaagcttccgatccgaaatgctgtggtggactcgggttacagcttcctcttgttgttcgatttcctgatgttttgaagaatcggcttgaatcgattcaaggtgcttttgatggtgcaattcaattgcaagggtatgaatctcattaccaaggtgtttatcctgtgaaatgtaatcaggataggtttgttgtcgaggacattgttgaattcgggtcaggttttcgcttcgggctagaagctggttctaagcctgaattgcttctggctatgagctgtttgtgtaaaggtaacagagaagcttttttgatttgcaatggttttaaagacagtgaatatatttcgctggctttggttgcgagaaagcttgctttgaacactgttattgttcttgagcaagaggaagagcttgatatggtggttgagattagcaacaagctgtgtattcgtcctgtgatcggtgttcgtgcaaagctgaggacgaagcattcgggccattttggttcgacttctggtgataaaggtaaatttggtttaactacaattcagattttgcgtgtggtgaagaaacttgaacaattagatatgcttgattgtcttcaattgttgcattttcatattgggtctcaaattcccaccactgaattgcttgctgatggtgttggagaagctgcacagatttactgtgaattgcttcgtttgggtgcccagatgagagttttagatattgggggtggtttaggtatagattacgatggttccaagtcaggtgattctgatatatctgttgcttatggtatagaagagtatgctgcagctgttgttcatgctgttaagtatgtatgtgatcgtaggaatgtgaatcaccctgtgatttgtagtgaaagtggtagggccatagtgtctcatcattccgttttgattttcgaggctattggtgcaagttcaaacaaagcaccttcattgtcctccattggattgcagtacttaggagaagggctctctgaggaagcccttgcagattatcagaacatatctgctgccacccttcgcggtgaacatgaagcttgtttgctctacaccgatcaattcaagaaacgttgtgttgagcaattcaagcaaggtactttagggattgaacagcttgctgcagtggatggtttgtgtgatttgattacggagacaattggggcaaaggatttggttaagaagtaccatatgaatctttctgtgttcacatccattcctgatttttggagcatagatcagttgtttcccatagtccccattcatcgtctggatgagaaaccaactgcaaggggtattttatctgacttgacttgtgacagtgatgggaagattgacaagttcattggtggtgagtcaagcttaccacttcatgaattggaaggacacggtggaggatactatctgggaatgttcttgggcggggcttacgaggaggcgcttggtgggttgcacaacctgtttggtggccctagtgttgttagggtgttacaaagcgatggtccacacggtttcgcagtgacgcgggctgtgtccggaccatcttgtgcagatgtccttcgagtgatgcagcacgagccgcagctcatgtttgagacgcttaagcaccgtgcacttgagttttgtgaacagcatgatgatgacagtgtggtgaatgcagctggtttggcaaatagtctagctagatccttcgacaacatgccttatctggtttcatccacaacttgttgcttgaatgctctcactaacaatgatggtttttactactgttctggtgatgatttcagtgctgcagattctgcttctgttgttacttctgttgctggagaagatgagcattggaattattgctgtgcttgagtttcgtcttttagcattccctttacattatgatgttgttggttgtcgttaaggtggcctgttttttttatcattctatgttgtttttttgttttttttagtaaaggatgtatgaagaagcagaacagggtcattatgtgccctttgtttttgccatttcggcatcttaatgttc

SEQ ID NO: 9234 - DNA, 2981 bp, Vitis vinifera
cccgcttcttcttcgttaacgtggtctttggagttgaacgccaaccctagctctcgccgtctctctttccctcgccgccgttagggttccgtccatttccccctattttctcgactattttctcgctcctctctttcccttttctttcaacctcctctccctttcggtcgccgaattctgagatctctgaacgagttttggttttgtgtccgtgttcgttttctttctgtgttgtttcgtgtattcttcattttctttgtggtcagagcggatctgtatggtgagatttattcagaaagtttagatctttgccgggtttttgagtttttaggcctttcaggttgtgttttggttggaaaatcgtcttctgacggtcaggcgtggggataattgagtgtcataagggtgagttagggtccggatctgttttctccgatctttattgcttcttttgagggggtagccggggctccggcctcggcgggttctaaagcccccaccttcacaatcgaagatctaaaaccctatatttttttcatcattttcattttgttttgatatcggggaagagatgccggccctggcttgttgcgtagatgctgctgttgcacctcccggctacgcctttgccggggatagctctcttcccgcgccggtgccattcgccggcgatcctctggcgacaaacgacgctgcagctctcccgaccggcgaacattctcattggtccccatccctctcggcggatttgtataggatcgacggttggggggcgccgtacttctccgttaacacctccggcaacatttctgttcgtccgtacggtaagaacacccttcctcatcaagagattgatctgatgaagatcgttaagaaagtttcggatccgaaatctgcgggaggactcggtttgcagcttcctctcatcgttcgattgcctgatgtgctccagaatcgtctggagtctctgcagtctgcgttcgacttcgcaatccaatctcaaggctacgaatctcactaccaaggtgttttccccgtgaaatgcaatcaggaccggttcatcgtggaagatgtcgtgaagttcgggtcggctttccggtttggcctcgaagctggttccaaaccggagctccttctggccatgagctgtttgtgcaaaggaaaccctgaagctcttctggtctgcaatggcttcaaagatgctgactacattgcgcttgctctggttgcgaggaaacttgctttgaatactgtgatcgtccttgagcaagaggaagagcttgatctggtgattaatctaagccagaagctttccgtgcatccggtgattggtgtccgagccaagctgaggactaagcacgcgggccattttgggtccacgtctggcgagaaagggaagtttgggttgactacgatacagattttgcgagtagtaagaaagcttgaacaagcaggaatgcttgattctctgcaattactgcatttccacatcggatctcagattccttctacagacttgctcgcagatggggtcagtgaagctgctcagatttactgtgaattggtccgtctcggtgcccatatgcgagtcattgacattggagggggtctcggtattgattatgatggatcgaagtcgagtgagtctgatatttctgttggttatgggcttgaagagtatgctatggcagtagttcgagctgtccagcatgtatgtgatcgcaagtcagtgaaacaccctgtgatttgcagtgaaagtggccgggctttagtctctcaccattcaattttgatctttgaggctgtttcggcaagtgtacatgattcacctgctacttcactcagtttacagcgctttgtggagggactttctgaggaagcccgtgttgattaccagaatctggctgctgctgcagttagtggcgagtatgagacttgcttgcgttttgctgatcaattgaagcaaagatgtgttgatcaattcaaggaagggtcgttaggtattgaacagcttgctgacgttgatgggctgtgtgacttggtttccaaggaggttggtgccactgatccagtgcgcacttaccatgtgaatttatcagtcttcacatgtattcctgatttctggggtattgggcagctgttccctatagtccccattcaccgactcgaccagaggcctggggcgagggggattttatcggatttgacctgtgacagtgatgggaagattgataagttcattggcggtgagtcaagcttgcctctgcatgaactagaaggttcagatgttgtttttggtggtagtgggaagtactacttggggatgttcttgggcggggcttacgaggaggcgctcggtggtttgcacaatctgtttggtggcccgagtgttgttcgggtgttgcagagcgatggacctcacagcttcgcagtgacgcgtgccatgccagggccttcctgcggagatgtgctccgagtgatgcagcatgagcctgagctcatgttcgagacgcttaagcaccgcgctgaggagtgcggtcacgaggatggtatgaccaatggttctcttgctagtggacttgccctttccttccacaagatgccctatcttgtggcgggttcttcttgctgcatgactaacagcggttactattatggcaatgaagacaactacaatcgtgctgctgattctgctgctggggatgatgaccattggtcttactgctttgcttgagctagtcttggcatccccatgttttgtttgtcctggaggtcgccttaattttttttccttttttttttttttttttaaaatttggttagaacagttttctgaattctgtgaagaagagaggggaatgggcccgaatcagacccttgtaaattcggaatcttattcccctttttctgtaatctttttatttccatctagtaaactttggaaattttagtttaaaaagcagttgcagtgtttttgttcc

SEQ ID NO: 9235 - DNA, 2864 bp, Trifolium pratense
gaacacgtcttctcaatctctattccaaaacctatcccattttttctcctcttttacccattcattcattcccaattgactcattctcataaaaaaaaaccgtttcattctattatttttccattagatccgcatgttttgcttaaccttacaaacttaatttctctcattaacctcattatcattatttcccattcctattcattcattctctcaattaaccttgtttcattacccttaattaatccttcttctgattgttagttgtggggattcatttgttcatagaacggttcgtttggttcttctccatttttcattagatctatcactgtcatcttttgggggggtagccggggcttttgcctcggcgggtttcaaagcccccatttcacaaacctaattacaaaaaacatcacaaccctaatttttcttttcaattttaacctaatttttcattcggttgcgtaagagatgccggctttagcttgttttgtggatgctgctgctgcagttcttcctcctccttccggatacgctctcgccggagattcaactcttccgccgcctctcacatttacgacagcaacaactgacggtgtcgatgatgattcggattcagcttccaattggtctccttcactttccagcaaactgttcaaaattgacggatggggatttccgtatttcggcgtcaataacgccggagatatcgccgttaggccacatggcgcggcgacgatgtctcatcaggagattgatttgctgaaagttgtgaaaaaagcttccgatccgaaatgctgtggtggactcgggttacagcttcctcttgttgttcgatttcctgatgttttgaagaatcgtcttgaatcgattcaaggtgcttttgatggtgcaattcaattgcaagggtatgaatctcattaccaaggtgtttatcctgtgaaatgtaatcaggataggtttgttgtcgaggacattgttgaattcgggtcaggttttcggttcgggttagaagctggttctaagcctgaattgcttttggctatgagctgtttgtgtaaaggtaacagagaagcttttttgatttgcaatggttttaaagacagtgaatatatttctctggctttggttgcgagaaagcttgctttgaacactgttattgttcttgagcaagaggaagagcttgatatggtggttgagattagcaacaagctgtgtattcgtcctgtgattggtgttcgtgcaaagctgaggacgaagcattcgggccattttggttcgacttctggtgataaaggtaaatttggtttaactacaattcagattttgcgtgtggtgaagaaacttgaacaattagatatgcttgattgtcttcaattgttgcattttcatattgggtctcaaattcccaccactgaattgcttgctgatggtgttggagaagctgcacagatttactgtgaattgcttcgtttgggtgcccagatgagagttttagatattgggggtggtttaggtatagattacgatggttccaagtcaggtgattctgatatatctgttgcttatggtatagaagagtatgctgcagctgttgttcatgctgttaagtatgtatgtgatcgtaggaatgtgaatcaccctgtgatttgtagtgaaagtggtagggccatagtgtctcatcattccgttttgattttcgaggctattggtgcaagttcaaacaaagcaccttcattgtcctccattggattgcagtacttaggagaagggctctctgaggaagcccttgtagattatcagaacatatctgctgccacccttcgcggtgaacatgaagcttgtttgctctacaccgatcaattcaagaaacgttgtgttgagcaattcaagcaaggtactttagggattgaacagcttgctgcagtggatggtttgtgtgatttgattacggagacaattggggcaaaggatttggttaagaagtaccatatgaatctttctgtgttcacatccattcctgatttttggagcatagatcagttgtttcccatagtccccattcatcgtctggatgagaaaccaactgcgaggggtattttatctgacttgacttgtgacagtgatgggaagattgacaagttcattggtggtgagtcaagcttgccacttcatgaattggaaggacacggtggaggatactatctgggaatgttcttgggcggggcttacgaggaggcgcttggtgggttgcacaacctgtttggtggccctagtgttgttagggtgttacaaagcgatggtccacacggtttcgcagtgacgcgtgccgtgtctggaccgtcttgtgcagatgtccttcgagtgatgcagcacgagccgcagctcatgtttgagacgcttaagcaccgtgcacttgagttttgtgaacagcatgatgatgacagtgtggtgaatgcagctggtttggcaaatagtctagctagatccttcgacaacatgccttatctggtttcatccacaacttgttgcttgaatgctctcactaacaatgatggtttttactactgttctggtgatgatttcagtgctgcagattctgcttctgttgttacttctgttgctggagaagatgagcattggaattattgctgtgcttgagtttcgtcttttagcattccctttacattatgatgttgttggttgtcgttaaggtggccttttttttttatcattctatgttgttttttttgttttttttagtaaaggatgtatgaagaagcagaacagggtcattatgtgccctttgtttttgccatttcggcatcttaatgttcatttcctgtcatgtgtagactttc

SEQ ID NO: 9236 - DNA, 2256 bp, Prunus persica
caaaccctaacccccaatttctctaattttttatttcattttttgattcatcttcgtcgcggaagaagagatgccggccctggcttgttgcgtggacgctgctgtggctcctcccggctacgccttcgccggggatagctctcttcccgcgccgccattttccggcgtacctccggcgaccaccgccgtcaccactgacagttcccattggtctccctccctgtcatccgacctctaccgaatcgacgcctggggtgggccctacttcaccgtcaattcctccggcaacgtctccgtccgtccgcacgggtcggcgaccctgccccaccaggagatcgatctgctgaagatcgtgaagaaggtttcggatccgaaaccagattgcgggctcgggttgcagctcccgctcattgttcgcctgcccgatgtgctcaagaaccggctggagtcgctccagggggcgttcgatctcgcgatccagtctcacgactacgggtcccactaccagggcgtgttcccggtgaaatgcaaccaggaccggttcgttgtggaggacattgtccggttcggctcgccgttccggttcggattggaagctgggtcgaagccggagcttctcttggccatgagctgcttgtgcaaaggtaacccagaagcccttctcatctgcaatggattcaaagacttcgagtacatctctctggctctgtttgctcgcaagctcgccttaaacacagtgattgttcttgagcaagaggaagagctcgatgtggttatcgatttgagcaagaagctaggtgttcgacccgtgattggggcccgagccaagctcaaaaccaagcattcgggtcatttcgggtcgacttcgggcgagaaagggaagttcgggctcactaccactcagattttacgggttgttaagaaacttgatcaattgggtctgcttgattgctttcagttgttgcatttccatattgggtctcagatcccttcgactgctctgctcgccgatggcgtatccgaagctgctcagatctactgtgaattggtccgcctcggtgcccacatgaagttcatagacattggaggcggtctgggtatcgattacgatggatccaaatccagtgactctgagatttcagtcagctatagcctcgaagagtatgctgccgctgttgtccgagcagtcctgaacgtttgtgaccggaagtcggtgaagcacccggtgatttgcagcgaaagtggccgagccctcgtgtctcaccactcggttatgatatttgaggccatttcttccagcgcctgtgatgatgttcctcccatgtctgcgtttgcgcttcagtatttcatcgaggggctcacagaggaagctcgtgccgattaccgaaacctctcggctgcggcaatcagaggtgagtatgaggcttgcttgacatatgctgatcagttgaaacaacgctgtattgatcagttcaaagaagggtctctgggcattgagcaattagccactgttgatgggctttgtgatatggtttcgaaagcaatcggggcatctgaccctgtccgtacgtaccatgtgaatctctcggtttttacttcaattccagacttctggggcattgggcagacgttcccaatagtcccgattcaccgcctcgatcagcggccggcggtgagggggatattgtcggacttgacctgcgacagtgatgggaagattgacaagttcatcggtggcgagtcgagcctgccgctgcatgaattggaaggtaatggtggggctagtggcggtgggcagaagtactatctggggatgttcttgggcggggcttatcaggaggcactcggaggcgtccacaacctgtttggaggcccgagcgttgttcgggtctcccagagcgatggaccccacagctttgcggtaacgctggctgtgccagggccgtcgtgttcggatgtccttcgagtgatgcagcatgagcccgagctcatgttcgagacactgaagcaccgtgcggaggagtacgggcagggcgacgatggcggcatggctagcgccgcagtcgccaccagccttgcccgctccttccacaacatgccgtatctggtggcagcttcatcgtgttgcttgactgcaatgaacaaccatggcttgtactattgcagtgaggatgattatgacgttgttgcagattctgctggtggtggtggtggtgaggaagatcagtggtcttactgctgtgcttgacagagctt

SEQ ID NO: 9237 - DNA, 2430 bp, Nicotiana tabacum
atgcctgccttaggttgttgtgtagacgctgctgtttctcctcctcccggctattccttccttggggatagttctcttcccgcgccggagatttttccctccggcgtacctccgtcgacaaacaccgccgttgccaccaccaccaccacccattggtctccggcgcactcatccgctctttattctattgacggatggggcgctccgtatttcaccgttaattcctccggtgatatctccgttaagccacatggtacggatactctgcctcaccaggaaatcgatctccttaaggtcgtgaaaaaggcctccgacccgaaaaatttgggcggactcgggttgcagtttccgctcgttgttcggttccctgatattctgaaaaaccggttggagtctcttcaatccgtttttgattatgcggttcagtcacaaggttatgaagctcactaccaaggtgtttatcctgtgaaatgcaaccaggacaggttcgttgttgaagatattgtcaaattcggatcgggtttccggttcggtctcgaagctgggtctaaacctgagctcctcctagctatgagctgtctctgcaaaggcagtcatgagggtcttcttgtgtgcaacgggttcaaggatgctgagtacatttcgcttgctttggttgcaaggaagctcatgttgaatacagtaattgtccttgaacaagaggaggagcttgatttggtgattgacatcagcaagaaaatggcggtccggcctgtgatcgggcttcgggctaagctcaggaccaaacattcgggtcatttcggatccacttctggagagaaaggtaaatttgggctcacgacaacacagattgttcgtgtggtgaagaagctagaagaatccggaatgctggattgtcttcagttgctgcattttcatatcggatctcaaatcccttcgacggctttgcttgctgatggcgttggtgaggctgcccagatttactgtgaattagtccgcctcggtgctggcatgaaatacattgattgtggtggtggccttggaattgactatgatggtacaaaatcatgtgattccgattgttctgttggatatggccttcaggaatatgcatctacggttgttcaagctgttcgatttgtttgtgaccggaagaacgtgaaacatccggtgatctgtagcgagagtgggagagcaattgtatctcatcactctgttctgatatttgaggctgtgtcttcaactacaacacgctcacaagagttatcttctgttgatctccagtcatttgtggagaagctcaatgatgatgctcgtgctgattatcggaatttatctgctgctgctattcgtggagagtacgatacgtgtgtactttatgctgatcagttgaaacagagatgtgtggagcagttcaaagatggtgatttggacattgaacaacttgctgcagtagatggcatttgtgatttcgtgtcgaaggctattggggcttctgatcctgtccgcacataccatgtgaatctttcgatcttcacttcagttcctgatttttgggcaattgaccaactattcccaattgttcccatccataagctagatgaacggcctgtagttcgaggaattttatcggacttgacctgtgatagtgatgggaagattgataagttcattggaggagagtcaagcttgccgctccatgaattaggaagtaatggtggtggtggtggtgatggtggaaaatattatctaggaatgtttttgggtggggcttatgaggaggcgcttgggggactccataacctatttggcggacccagcgttttgcgtgtgtcacagagcgatagcccacacagcttcgccgtgacatgtgctgttcctggtccgtcctgtgctgacgttctccgggcgatgcagcacgagcctgaactcatgttcgagacgctcaagcaccgcgctgaagaattcgtgcacaatgacgacgaacaagaagaagataaagggcttgcatttgcatctttggccagcagcttagctcagtcattcaacaatatgccttaccttgttactaattcatcttgctgccttactgctgctgccaataacggtggctattactattgcaatgatgagaacattgttggagttggcgcagaatctgctgcagctgaagaagagctttggccttactgtgttgcatgaagtatcttggaacatttccagtttccaccattgttgttccttttttgtttcaataaagtggcaatttagtttgtcgttgaggtcgtctgtttcgttaattatgtcatagtttaagtcattttttggtttaattttctgttgttggacgccagaaattgtggagaaaccaaggactatgtaatctcccccgtcttattaaatgcatttacttttgttacaaaaaaaaaa

SEQ ID NO: 9238 - DNA, 1873 bp, Vitis vinifera
atgaagatcgttaagaaagtttcggatccgaaatctgcgggaggactcggtttgcagcttcctctcatcgttcgattgcctgatgtgctccagaatcgtctggagtctctgcagtctgcgttcgacttcgcaatccaatctcaaggctacgaatctcactaccaaggtgttttccccgtgaaatgcaatcaggaccggttcatcgtggaagatgtcgtgaagttcgggtcggctttccggttrggcctcgaagctggttccaaaccggagctccttctggccatgagctgtttgtgcaaaggaaaccctgaagctcttctggtctgcaatggcttcaaagatgctgactacattgcgcttgctctggttgcgaggaaacttgctttgaatactgtgatcgtrcttgagcaagaggaagagcttgatctggtgattaatctaagccagaagctttccgtgcatccggtyattggtgtccgagccaagctgaggactaagcacgcgggccattttgggtccacgtctggcgagaaagggaagtttgggttgactacgaracagattttgcgagtagtaagaaagcttgaacaagcaggaatgcttgattctctgcaattactgcatttccacatcggatctcagattccttctacagacttgctcgcagatggggtcagtgaagctgctcagatttactgtgaattggtccgtctcggtgcccatatgcgagtcattgacattggagggggtctcggtattgattatgatggatcgaagtcgagtgagtctgatatttctgttggttatgggcttgaagagtatgctatggcagtagttcgagctgttccagcatgtatgtgatcgcaagtcagtgaaacaccctgtgatttgcagtgaaagtggccgggctttagtctctcaccattcaattttgatctttgaggctgtttcggcaagtgtacatgattcacctgctacttcactcagtttacagcgctttgtggagggactttctgaggaagcrcgtgttgattaccagaatctggctgctgctgcagttagtggcgagtatgagacttgcttgcgttttgctgatcaattgaagcaaagatgtgttgatcaattcaaggaagggtcgttaggtattgaacagcttgctgacgttgatgggctgtgtgacttggtttccaaggaggttggtgccactgatccagtgcgcacttaccatgtgaatttatcagtcttcacatgtattcctgatttctggggtattgggcagctgttccctatagtccccattcaccgactcgaccagaggcctggggcgagggggattttatcggatttgacctgtgacagtgatgggaagattgataagttcattggcggtgagtcaagcttgcctctgcatgaactagaaggttcagatgttgtttttggtggtagtgggaagtactacttggggatgttcttgggcggggcttacgaggaggcgctcggtggtttgcacaatctgtttggtggcccgagtgttgttcgggtgttgcagagcgatggacctcacagcttcgcagtgacgcgtgccatgccagggccttcctgcggagatgtgctccgagtgatgcagcatgagcctgagctcatgttcgagacgcttaagcaccgcgctgaggagtgcggtcacgaggatggtatgaccaatggttctcttgctagtggacttgccctttccttccacaagatgccctatcttgtggcgggttcttcttgctgcatgactaacagcggttactattatggcaatgaagacaactacaatcgtgctgctgattctgctgctggggatgatgaccattggtcttactgctttgct

SEQ ID NO: 9239 - DNA, 2916 bp, Datura stramonium
agcgcaattcctataacagaaacccttccccgctaggtttccgtctacttctctcatcttctccgtttcctcttatatctgtatggtgttcttcttgttcgaattttagatttgttttgccttgtgttcctgtgacctttaattttttctgtttaaagcaagaaattagcttcttctgaagtcagggtggggatttttggatcgtgtaggagtgtgttagagggtgattatcttttgattcagttctttttttgcttcttttgagggggtagccggggcctcggcctcggcgggttttaatagcccccaactattacaacattgggcaaaagatcaatctgtacaaacccttaatttagctttttttttctttctctatctgtattctttgattctttcttcttcttgagaaatcaaacagatcgggaagagatgccggccttaggttgttgtgtagacgccgctgtttcccctcctcttggctatgccttctcttgggatagctctcttcccgcgccggagttcttttcctccggcgtacctccgtcgacaaacgaaaccgccgctcacaccgccggttcccattggtctccggatctgtcctctgctttgtacagagttgatgggtggggtgctccttatttctccattaattcctccggagatatctccgtccggccacatggtacggacactcttcctcaccaggagattgaccttctcaaggtcggtaagaaagcttctgacccgaaacatttgggcggtcttgggctccagctgcctcttgttgtccgtttccctgatgttctgaagaaccgtttggaatctttgcaatcggcttttgacatggcggttcattcccagggctatgaggctcattaccaaggcgtttatcctgtgaaatgcaatcaagacaggttcgtggtggaagatatcgtgaaattcggatcgccataccgattcgggttggaggccgggtctaaaccggagctcctgctggccatgagctgtctctccaaaggtagtgccgatgcccttcttgtttgcaacggtttcaaggacaccgagtatatttcgcttgctttggttgcaagaaagctccttttgaacactgtaattgtgcttgagcaagaggaggagcttgacctggtgattgatatcagccgtaagatggctgtccggcccgtaattggacttcgcgctaaactcaggaccaagcattcgggccattttggatccacttctggagaaaaaggtaagtttgggttgaccacaactcagattcttcgggtagtgaagaagctggatgagtctggtatgctggattgtcttcagttattgcattttcacattggatctcagatcccgtcaacggacttgcttgccgatggtgttggtgaggccactcagatttactctgaattagcccgtcttggagctggtatgaaatttattgatattggaggtgggcttggaattgactatgacggtactaaatcaagcgattctgatgtctctgtcggctatggcattgaagaatatgcctccgctgttgtccaagcggtccaatatgtctgtgaccgcaagggcgtaaagcatccagtgatttgcagtgaaagtggcagggcaattgtttctcaccactcaattctgattttggaagctgtgtctgcttctactggtcatgcttctccacagctttcttccggtggactccaatccttggcggagactctcaatgaagatgcccgtgctgactaccggaacttatctgccgccgcggtccgtggagaatatgatacatgtctcctgtactctgatcagttgaaacagagatgtgtggaacagttcaaagaagggtccttggatattgaacagcttgcggcagtggatagcatctgtgacttggtgtcaaaagccattggggttgctgatcctatccgcacgtaccatgtgaacctgtcagttttcacctcaattcctgatttttgggcctttggccaattgtttccgattgttccaattcaccgtttagatgaaaagcctgtaatgcgaggaattctatcggacctgacttgtgacagtgatgggaaggtagataagttcattgggggcgaatcaagcttacccctccatgaattgggaagtgatggtgggcggtattatctggggatgtttttgggtggggcttatgaggaggcgctcggaggactccacaacctgtttggtggaccaagcgtggtgcgcgtgttgcagagcgatagccctcacagcttcgccgtgactcgctctgtccctggtccatcctgtgctgacgtgctccgggcgatgcagtttgagcctgagctcatgttcgagactctcaagcaccgtgcagaggaatacttggaacaagaagaaaaagaagaagataaaagtatgagctttgcatctttgaccagcagcttagctcagtcgttccacaacatgccttaccttgtggcgccttcatcttgctgcttcactgcagccaccggcaataatggtggctattactattacagtgaggacaaggctgcagattgtgcaacaggggaggatgacatttggtcctattgcaccgcttgaagttgtctcgtagcatcaatcatcatctccagtttgttttagtttgtcgttgttgaggtcgtctgtttttcaataatccccttagttggtgatgtcatatttctttgtttactttctcgtttttaaaaaagtagcagtagaaagcagggggactcatctctattgcagcttgtgttattttgttgtgtaaaggagagtcgtggggagtgaccgaatcaatttgatgtatggttatgtaatgtaaatctcctcctccttatgtaatgcatttttttttagtatgaatgatggctatttgtcaaaaaaaaa

SEQ ID NO: 9240 - DNA, 1868 bp, Glycine max
ggattcaccgactccggaaaacccaggggccaacaacacctccctcatttatctggggggcaatcccgtcatttcaaattcggttccttccgctagtaagagctcctttttaagacgacgaaaacaaataaatataatatatacgcaaacgctcgaaacaacaacatttgcggttctgcctgcaaattttcttcccctcaatctatattactcaggtggtgttcctgttcccctcaagcacccctgagattcattcccaaaaagcttaaaaaattctattcaattcaaattctaaatttaatttccatttcgttttcgttttctgttttgatttgatcttccaatggcgtccgatggcttcaccgacaagaacaccgtgttcagaaagctcaaggcgaagtccgaaaataagatgtgtttcgattgcaatgcgaagaaccctacctgggcgtccgtcacgtatgggatcttcctctggcatcgattgctccgccgttcaccgcagtctcggcgtgcacatcagcttcgtgaggtctacaaatttagactcatggagtcctgagcaactaaaaacgatgagctttggaggaaacaatcgtgcacatggtttctttaagcaacatggttggactgatggtggtaaaatagaggctaaatacacatctagagctgcagatttgtataggcaaattctttcaaaggaagtagcaaaaagtatggctgaggatggaggcttgccttcatcaccctgttgcttctcagcctgcccagggggttaatgggcttccagaagtcaagaccaatgaagtgccaaaagaaaacactctggagaagccagaaaagcctgagagcacttcttcaccctagagcttcacattcagtaatttcaggtactgttaagaaacctatcggtgctaaaaaagcagtgaagagtggggggcttggtgctcgtaaactcactaaaaagccaagtgagtctctctatgagcagaagcctgaggaaccccctgctccagttccatcttcaacaaacagtatgcctgctgggccatctccgacatctcggtttgaatatgtagaaaatgtccaatcatctgacttgaacactggaggttctcatgttcttagtcatgtgtctccaccaaagtcatcaagcttctttgcagactttggaatggatggtggctttccaaagaaatctgggccaagttcctccaaagtgcaaattcaggaaactgacgaagcaagaaggaagttctcaaatgctaaatctatttcttcatctcaattttttggagatcagaacaaagctgcagatgtggattctcaagctactttgtctaagttttcgggttcaagtgccatctccagcgctgatctttttggtgactcaagagacaacaacatcgatcttactgctggtgacctcatcaatcgattatctttccaggcacaacaggatctctcttcccttaagaacatcgcaggagagactggaaagaagctcagctcactggcctccacattgatgacagatcttcaggaccgaatcctctaaaatgtgtatgctctgtatttaagagaatctttggagtttgttacatatgccagccaattatgtttcaaatgtaatagaagagttcaatatacaattcttttagaaaataagatgctatattttcaggcttgtcatataggcgggtgtttctattttgtataacaggtacaattagatgttgctaatgttttagatttctttctttttttgggttagacgacaccagattgtgggtgaactcgtgaactcgagtacgtttggatagagaattttaagtgaggaaagtaatttataagaaaaaaaaaaaaaa

SEQ ID NO: 9241 - DNA, 1425 bp, Glycine max; identical to SEQ ID NO: 8268

SEQ ID NO: 9242 - DNA, 1558 bp, Vigna angularis; identical to SEQ ID NO: 8271

SEQ ID NO: 9243 - DNA, 1652 bp, Glycine max
  misc_feature (1644)..(1644): n is a, c, g, or t
ctccccgatggccttctccgccgctgccgcagccgccgacaactccggcaaggacgacgatgggccccacaaggggttcaagcagagcagacccatgaatttggtcattgctcgttcccctgtcttcactgtgccacccgggttgagcccttctgggtttcttaactcccctggcttcttttcccctcagagcccctttgggatgtcccaccaacaggctttagcgcaggttacagctcaagctgtcctagctcaatcccatatgcacatgcaagctgattatcagatgcctgcggtaacagctccaaccgaaccacctgtacggcagctgtcttttgctctaaatgaagcttcggagcagcaagtggtatcatgtgtatcatctgtatcagaacctagaaatgctcaactcgaagcaccggaactctcacaggctgataagaaatatcaaccatcatcccaggccattgacaaacctgcagatgatggctacaactggcgtaagtatgggcagaagcaggttaagggtagtgagtatccacgaagctattacaagtgcacacatctgaattgtgttgtgaagaaaaaagttgagcgtgcccctgatggtcacataactgaaattatctataaaggccagcataaccatgaaaagcctcaggcaaataggcgtgccaaagataatagtgattcaaatggaaatgtaactgttcagcccaaatctgagtcaaactcacaaggttgggttggacaattaaacaagtttagtgaaaaaattcctgattcttcagttgctaaaagtgaccagacctccaatcaaggggctcctcctaggcaactactacctgggtcaagtgagagtgaggaagtgggtgatgtagataatagggaagaggcagatgatggcgagccaaaccctaagagaaggaatactgatgttggggtttctgaagtacctctgtctcagaagactgtcacagaacccaaaatcatcgtgcaaacaagaagtgaagttgatcttttggatgatggctacaggtggcgaaaatatggtcagaaagtggtaaagggaaaccctcatccaaggagttattacaaatgcactagtgcaggatgcaacgtgcgcaagcatgttgagagagcttcaatggaccccaaagctgtcataaccacgtatgagggtaaacataatcatgatgtgcctgctgctagaaacagcagccacaacacagctagtagcaattcaatgccattaaaaccacataatgtggtgccggagaaacatcctttgctcaaggatatggattttggaagtactgaccaaagacctgtacatttgcgtttgaaagaagagcaaatcatagtataaaagtctggtgccaagctcacttattccacgtcctagtacagaatgaagttgtctagaagatgaaatggataatataatatgaaggtgtagtcactagtcatagttggcaatgtctattgttttctagtttcttttgtatgtaacaccttctttttgtacatctaaattatggaattggttgtataagatgttgtttacaggtatgaatatcatttcaactaatgtacgaacattattatataatataatttataaatactccttgtaaaaaaaanaaaaaaaa

SEQ ID NO: 9244 - DNA, 1391 bp, Glycine max
gggggtcgtcctcgtttgattggacctctctttctctggagtatcctcccctttatttcctcgtcctccaaactccaaagccgtttccaagtgtaatggattcgagttccattaacagcaacagtaaggagataaccatggagattccaagcttggttcgactttacaaggatggcaccattgaacgcctccaaaactcaccaattgtgccacccacgcttcaagatccaacttcttccaaagacgtcgtcatctctggtgaccccctcatctctgctcgtcttttccttccaaaccggattcgatcccagcaagagggtcataaagtccccatcttggtctactttcatggtggaggtttcttctttgaatctgccttcaaccaactccaccataactatttcaacaagtttgtctccgtagcagatgttttagtcgtttccgtcgagtataggttggctccagagacccttcttcctgcagcttatgatgactgctgggatgctcttaaatgggtcgccaccaacaccgaaccatggcttgtcaaacacggtgatttcaacagagtcttcattggaggtgacagcgctggtgctaatatagttcataacattgccatgcgtgctggggctgaagctttacctggtggtgtcaaactcttgggtgcttttctctctcattcctacttctacggttcaaggccaattggatcggaacctgttgcagggcaccaacagagcgtgccctatttggtatgggattttgtttatccatctgcgcctggagggattgacaaccctatgatcaatccaatggttactggggcgcctagcttggctggacttgggtgttctaagattctggtttgcgttgctgaaaaggacctgataaaggatagaggggttgcgtactatgaggctgtgaagaagagtggctggcaaggtgaagcggaactgttcgaagtggagggcgaggatcatgctttccacatccacaatccacaaacccagaatgccatgaaaatgatcaaacgcctctcggattttctcctccactaaaacacataccctgaggattctgagttttaatgtctcatggatgtaatctaatgtaatgcttcaactctgcttattattattaagcaaataaaatttggaaatcagaagccagtgtagctggcctagttcgtgtgatctaaagtctaataatattctctattatgctacgggtaagggtgtgttacaccttcaaactttcattcccacttttcaatcttctttcatgtgtatggaatggagtcattctcgttcaacagagccttggatacactatgcagcaaaatctcaaccattaaaaaaaaaaaaaaaaaaaaagaaaaaaaaaaaaaaaaa

SEQ ID NO: 9245 - DNA, 1253 bp, Glycine max
gcccagagaacacaacacggagccatgcaaagttgccgtttccagcaaacctctctggttatttgaggtaaaacgctttgcagtctcgcaaatcgcaacaaccccttcgtcttctcagtaaaaggggtcttacttacttagtgtcttcgttcgtatcttcaaccctgaattcgcttctcctcccaaagcaccaccaccacctctaattaattcctcgttcagttgggcatgtttgcgcatttctgagagagcgagaaaataaagccaatgggtcgagggaaaatcgagatcaaaagaatcgacaatgccagcagcaggcaagtcacgttctcgaagcggaggaccgggttgttcaagaaggctcaggaactttccattctctgtgacgccgaggttgccgtcatagttttctccaacaccggcaagctcttcgagttttccagttccggtatgaagcgaacactttcaagatacaacaaatgccttggttctacagatgctgctgtagcagaaattaagacacagaaggaagattctaagatggtggagattctaagagaggaaattgcaaagctagaaacaaagcaattacagctggtgggtaaggatctgacaggattgggtttaaaggaattgcagaacttagagcagcaacttaatgaggggttattgtctgtcaaggcgagaaagctagagcaatctagagttcaggaacaacgggttatgttggagaatgaaactttgcgaagacagattgaggagcttcggtgtctgtttccacaatcagaaagcatggtcccattccaataccaacatactgaaggaaagaatacttttgtagatactggtgccagatatctcaacttggccaataactgtggaaatgagaaagggagttcagacacatcatttcatttggggttgcctgctggtgttcaagaggaaggcccccaagaaagaaaccttttcaaatgactcagcctagttctctgattttcttatttcaacagggaaaatagaatttcagactaatttattgcatttgtagttatgtacaatatagattagggagaaaaggtatgaccaaaagtgattctcaagttataaattggaatttggctcttttagaatattgacaagatgcacattgaccatttttaccaaattctggcctaattaactgtgaaaggtcttatgaagacaatgtttaggtttttttttaaaaaaaaaaaaaaaaaaaaaaaaaaaaaaaa

SEQ ID NO: 9246 - DNA, 1784 bp, Glycine max
  misc_feature (1694)..(1694): n is a, c, g, or t
accaggcaagctccaacaaacagtacatggttctatggcttctgctgcctctgctacatttccagtaaccactgcctgcttcaataccaatactgttgatgccagaaaatcaagtttctttgagttcaaaccactcaatagatcgaataaggttcctgcagacttcaacaatcatgtaagtaaacagtctactcaagtagaaggtccaggaaaagctcaatcatttgcttcctcaccattagttgaaagtgagataacagttccttctaatgaattaagcctatcatcacctgtacaaatggttagttctagtgctagtgctcctgttgatgttgatttggatgaaattaaccacaaaggcaacacagctactgggcttcaagcatcacatgttgaggttagaggcagtggactttctgttgcagctgagaaaacatctgatgatggatacaattggcgaaaatacgggcaaaagcttgttaaaggaagtgaatttcctcgcagttattacaaatgtacacatcccaactgtgaagtgaaaaaactttttgagcgctctcatgatggtcaaatcactgagatagtttacaagggaacacatgatcatcctaaacctcaaccaagctgccgatactctaccggtactgttatgtctattcaaggagagagatctgataaggcttctatggctggccgagatgacaaagcaactgctatgtatggtcaggtgtctcatgctgctgagcccaacagtactccagagtcatcacctgttgcaacaaatgatgatggtttagagggtgttgccgggtttgtgtcaaataggactaatgaagaggttgataatgacgatcccttctcaaagcgaagaaaaatggaacttggaaatgttgacatcactccagtagttaagcctatccgggaaccacgggttgtcgtacaaactttgagtgaggttgacatattggatgatgggtaccgctggcgtaagtatggccaaaaggttgtgagaggcaatcctaacccaaggagctattacaaatgcacaaatgctggttgccctgtcagaaaacatgtggagagggcatctcatgatccaaaagcagtgataaccacatatgagggtaaacacaatcatgatgtaccagctgcaaggaatagcagccatgacatggcagtaccagcagctgcagcaggtggacagacaagaactaagttagaagaaagtgataccattagccttgaccttggaatgggaattagctcagctgctgaacataggtcaaatgggcaagggaaaatgctgcattcagagtttggggacacacaaactcatactagcagttccaacttcaagtttgttcatactacctcagctccagtatactttggtgttctaaataacagctcaaatccctttggttctagagacaataggagtgatggtccatctttaaaccgttcctcatatccatgcccacagagcatgggaagaatactaatgggtccatgaagttgattacaccacagatattaaataaaaaactatgagtaacaatttgctttcttttttcttatttttggcgggtatagcttcaaaggtgtaacatctcattttctgtaagaaaatgcagatagttcttttatgtttatatcactattccatagttgctgtttagtaaagttggtagcanctccatcttgacttttaaatctaattgccgtttgtaattgtataattataaattataattatatccaaattcttctgtaaaaaaaaaaaa

SEQ ID NO: 9247 - DNA, 1482 bp, Glycine max
atgcatggttctatggcctctgctgcatttccagtaaccactgcctgcttcgataccaatactgttgatgacagaaaatcaagtttctttgagttcaaaccactcagcagatctaatatggttcctgcagacttcaacaaccatgtaagtaaacaatctactcaagtagaaggtccaggaaaaactcaatcatttgcttcctcaccattagtggaaagtgagatagcagttccttctaatgaattaagcctatcatcacctgtacaaaaggttagttctagtgctagtgctcctgttgatgttgacttggatgacattaaccacaaaggcaacacagctactgggcttcaagcatcacatgttgaggttagaggcagtggactttcagttgcagctgagaaaacatctgatgatggatacaattggcgaaaatacgggcaaaagcttgttaaaggaagtgaatttcctcgcagttattacaaatgtacacatcccaactgtgaagtgaaaaaactttttgagcgctctcatgatggtcaaatcactgagatagtttacaagggaacacatgatcatcctaaacctcaaccaagctgccgatactctaccggtactgttttgtctattcaaggagagagatctgataaggcttctatggctggccgagatgacaaagcaactgctatgtatggtcaggtgtctcatgctgctgagcccaacagtactccagagtcatcacctgttgcaacaaatgatgatggtttagagggtgttgccgggtttgtgtcaaataggactaatgaagaggttgataatgacgatcccttctcaaagcgaagaaaaatggaacttggaaatgttgacatcactccagtagttaagcctatccgggaaccacgggttgtcgtacaaactttgagtgaggttgacatattggatgatgggtaccgctggcgtaagtatggccaaaaggttgtgagaggcaatcctaacccaaggagctattacaaatgcacaaatgctggttgccctgtcagaaaacatgtggagagggcatctcatgatccaaaagcagtgataaccacatatgagggtaaacacaatcatgatgtaccagctgcaaggaatagcagccatgacatggcagtaccagcagctgcagcaggtggacagacaagaactaagttagaagaaagtgataccattagccttgaccttggaatgggaattagctcagctgctgaacataggtcaaatgggcaagggaaaatgctgcattcagagtttggggacacacaaactcatactagcagttccaacttcaagtttgttcatactacctcagctccagtatactttggtgttctacataacagctcaaatccctttggttctagagacaataggagtgatggtccatctttaaaccgttcctcatatccatgcccacagagcatgggaagaatactaatgggtccatga

SEQ ID NO: 9248 - DNA, 1787 bp, Retama raetam
atggtggagccttcacctactacagggtccttttctaagcttcttcaaacagtacatggttctatgccttctgctgcgtctgctacatttcctgtaaccactgcatgcttcaataccaacactgttgaggaaagaaaatcaaacatctttgagtttaaaccacacaataaatcaaacatggttcctgcagacttcaaaaaccatgtaagtgaacaatctattcaagcagaaggtccaggaaaagctcaatcatttgcttcctcaccattaattgaatgtgagatagatgttccttcaaatgaattaagcctatcatcacctgttcaaatggttagttctggggctagcactcctgttgaagtcgattcagatgaattgaaccacaaaggcaacacaatcactgtgcttcaagcatcacaagttgaggaggttaaaggtagtggacttccagttgcacctgagagagcatctgatgatggatacaactggcgaaaatatgggcagaaacttgttaaaggaagtgaatttccgcgcagctattacaaatgtacacatcctaattgtgaagtgaagaaacttcttgaatgctctcatgatggtcaaatcacggagatagtttacaaaggaatgcatgatcatccaaaacctcaaccaagccgacgatactctgtgtctatgcaagaagagagatctggaaaggcttctttggctggccgagatgctgagcccaacagcactccagacctgtcatctgtagcaacaaatgatgatagtcgagagggtgctgacaggactaatgatgaagttgatgatgatgatcccttctcgaagcgtagaaaaatggaacttggatttgctgacataactcatgtagttaagcctatccgagagccacgggttgttgtaaaaactctgagtgaggttgatatattggatgatgggtaccgctggcgcaagtatggtcaaaaggtggtgagaggcaatcctaaccctaggagttattacaagtgcacaaatgctggttgccctgttagaaaacacgtggagagagcatcgcatgatccaaaagcagtgataaccacatatgagggtaaacacaatcatgatgtaccagctgcaagaaatagtagccatgacatggcaggaccagcaggtgtagtgggtggtcaaacaagaatcaagttagaagaaagtgatagtattagccttgaccgtggcatgggaataagctcagctgctgaaaatagatcaaatgggcaagggaaaatgctgctatctgaatttggcaacagccaaactcaaaccagcaattccaacttcaagtttgttcatactacagcaggtccggtatacttcggtgttaatccgtatggttctatagaaaataggagtgacggtccatctttaaaccatgcctcatcatatccttgctcacaaaacattggaagaatactgactggtccatgactttgtttacataacaaagattaaaataaaattcgtagtagcattttgctttcttctttttggcaggtatagcttcgaaggtaaaacatctcattttctgtaagaaaatgcagagttctttcatgtttatatcaccgattcagagctgcggttgagtagaactggtagcagctcctggttgactttgtataattatgtgcaaattattctgtacaaaaatatgaagctcatatcatatcaatgtcgcttctaaaaaaagccttgtgaaagtgcttgaattagaagctatttttaagcaaaaaaaaaaaaaaaaaaaaaaa

SEQ ID NO: 9249 - DNA, 1239 bp, Glycine max
tttttttttttttttttttttgtgtttcacatcataaatcccttgttatttactatacaccaagacatcaagctacaattaatctacacaaagtcaatgcagaataacaaataaatggttttggtttcaatcttgaattctgattcttttgaaataaaaaggagcaacatatatattacagagtctagaccatcaaatgcagattacaagcaatcctagaataccatgagctgtgcttgttggttataatgtatcactctccatctggacctttccctaacaaagtcatcaaaaaatctttgtagtaccctgaagtatccccaataacatcatcatcaagactagacttgtacacgttagcatattcaaatctgacgttcaacagatcaatttcggctcgagttacaatagctctgttgagggaatcttcatcggttccaaacccaactatagaatctcttacaacctttgcaaaatgtttctcggggcagtctatacaccatatcaccgtatgtaagaaagattccaaatcaccattaccacatttttttatgtcctgttccaatgtattcccatagaggttattgtagcatgcaaaagtttcccggagctggaaaagattcctggtgctaagtatccaaataatatgatcattgtctaattgcttgctgttgatagcttcatgtagttttgatgcctcttccttggctacctccaaatttacagccactttatcatacctgaatgagcttactaggctcactaaaagctttctgagggctggagcaacagaggctatgatgtcctcctcaagtgagcaatcaaagagagagcagtaagcctgcctcacagccaccaaatggttaggagttgatgcacatgctatttcaaccagaacctgaaggtgtttaatccccttcttagccttcaatgcatcctttgctagtctcgcatgcctttctggaggatcgtaggtccagagaattacagcatttctaaaatcaccagacaattcagaatgaagacgatcgacaagcgattcattgtaaagctgctgataagtttctccaattttcttcctttgttgagcattcctgtgtcccaataccaatatcaccgctttctcatctgtcccaaatccttggaaagcctttctgagtcgttcactgtcttgtgtgggagaaggaacaacctctggcagtttcaatgaagccattttccctgagacagtctaggtcc

SEQ ID NO: 9250 - DNA, 1482 bp, Glycine max; identical to SEQ ID NO: 9247

SEQ ID NO: 9251 - DNA, 1784 bp, Glycine max; identical to SEQ ID NO: 9246
  misc_feature (1694)..(1694): n is a, c, g, or t

SEQ ID NO: 9252 - DNA, 874 bp, Glycine max
ggaaacaagatctctctgatttggatcctccgaatctcccctcttttcattttcacattcttcttattatttattcacccttttccccttccttcaccattcattttcttttataataccattcttttttctctttatctctttcatcaatacttcatcgttttcgttaagggatggcttctgccggcgatgttttcaggcagggtttgccggaagtttgtgctgccgggaagttacacgtgcttgctgttgatgacagccacgtggaccgcaaggtcattgaacggttgctcaaaatctcgtcttgcaaagtgacggtggtggagagtggaagcagggctctgcagtatctggggttggatggagaaaaaagttccattggtcttgatagtgtgaaggttaatttgataatgacggattattccatgcccgggatgacaggatatgaattgctcaagaagataaaggagtcatctgtttttagagaggttccagtggtggttatgtcgtctgagaatatcttgaccagaattgatagttgcttggaggaaggagcagaggagtttctgttgaaacctgtcaagttgtcagatgtaaaacgcgtaacagatttcataatgagaggtgaagggatgaaaggagtaaaaatatctaaaaaaagaagccgatcagatgattgcattccatctctatcaactgcattctcatcagtttctcatccctgtgatatatcatcacctccatcgccatgtgtattgcaaccgaagaatctagattgagcatatagattgagcagtgatgtatgtctcctccattttgccaaaccattgttcatattcaaaagcctcagatgtaatttgcgtttttacactaa

SEQ ID NO: 9253 - DNA, 1149 bp, Vitis vinifera
atggaagggaactcaggcggaaatgacgtggagctgctgtgtaaaacgctacaggtggagcacaaactattctacttcgatctcaaggagaaccctcgcggtcgctatttgaagatttccgagaaaacttccgccactaggtccaccatcatcgttccctttagcggcatttcctggttcttagatctcttcaattactatgttaattccgatgaacaggacgttttcagcaaggagttgcagcttgacaccaaggtattttactttgacatcggcgagaacaggaggggtcgctttttgaaggtatctgaagcttctgttagcagaaataggagtaccattattgttcctgcaggaagcactcgagatgaagggtgggcagcattcaggaacatcttggcagagattaatgaagcatcgaggcttttcatcttgcccaatcagcaaagttctgaaccttcagaacggcttgttgggctttcagatgatgtgggtgctggcttcatatcaggccacagtactcaaccggccccagcatctgagttgaatgtggagaggtcagttgaattgcctgcacaggatgaaattggtaacttgggggtctcaaaagtgattagagctgatcaaaagaggttcttctttgatcttggtagcaacaacaggggtcatttcctgcggatatctgaggtggcaggttctgatcgttcctcaatcatccttccactgtctgggttgaaacagtttcatgaaatggtgggtcattttgtggagatcactaaagatcgaattgaaggaatgacaggtgcgaatgtccggacagtggatccccctcaaagatgaacactgaggagtcaggggtatggtgaaggacttgcaattccaatcattcaggttgttctggtgctacatataggtgtttgattaggggtgcaattgtgctctgtttgtgttatcctcttctcttctctcattcaagtctgagaataatctgatttctgtttatgaaccaaggaaattccaaggtatttgccaatcttaattttggatagggaataacagaagaacagaccagaaatcctgtaattgtcagtatggagtggcacctacttttacattttcaataataaagcattccaaatgtgttttgta

SEQ ID NO: 9254 - DNA, 1440 bp, Glycine max
gggaacaagaagaagagtcttcttcgtttaaccaccacatcggagaaacacaaacacacgcgcgcacacacacgtgcgtggtgcagactctccagtctcacacacatgtgtccgttgctgctgtaaccgtcgacgaagaagaagaagaaagaaataaaccgtttaaagtaaagcaaaattgtaaaccaaacaaacccttatgcgtggtgactagtgagtgacgactcagatctgttgcggggttatcgaaattggttattggccgagggagatggaggggaactccggtggaggaggcggcggtggcggtggaaacgacgtggaattgctctgcaagacgctgcaggtggagcacaagctcttctacttcgatctgaaggagaatcctcgcggccgctaccttaagatttccgagaagacctccgccaccaggtccaccatcatcgtccccttctctggcatttcctggttcctcgatctcttcaattactacgtcaattccgacgaccaggacctcttcagcaaggaattgcagctcgacaccaaggttttctattttgacattggcgagaatcggaggggccgttttttgaaggtgtctgaagcttctgtcagcagaaaccgtagcactataattgttccggctggaagctccagggatgaaggatgggcagcattcaggaacattttggcagagatcaatgaagcctcaaggcttttcattctgcccaatcagcaaaattctgaatcctcagagcatcttgttggactttcggatgatgttggtgctggcttcatatctggtcatagtactcaacctgccacttcttctgagttgaatgtggacaggtctgttgatttgccgcctcaggatgaaattgggaacttgggggtctcaaaagtgatcagggctgaccagaaaagattcttctttgatcttgggagcaataataggggtcatttcttaagaatatctgaggttgcgggttctgatagatcctccattattcttcccctgtcagggctcaagcagtttcatgagattgttggtcactttgtcgaaatcacaaaggaccgaattgagggaatggcggttgctaatgttcgcacaattgatccccctcaaagatgaatgctaacttgggataagaatgggtgttgtcttcgagtctgatttgtgttattttattttattttccctcagcctcctttcttcttctcatattgttcttccattaatgcttttgaaataatgcaaactctggttggtcagcagaataatttgaattgcttggcaaggttaatatgaataggaataacggaagaaaaaaaggatcagagacttgtacttgtttggatagtttggcacccaagctacaatctgtaataatgtttgattgtttattttgcgttccttgcaaaaaaaaaaaaaaaaaaaaa

SEQ ID NO: 9255 - DNA, 1497 bp, Arabidopsis thaliana
tctcacctccaccaattcctcattcttccaatcgcacttcctttaccagatcagacgtcaatttcaactcttcagtgaagagatttctttcaccgaattttctactccgatcgatcaattgaagattgaaatggaagctaattcaggcggaggaggaggagctgaaggcggaagagcggtaaccggaggaggaggaggaggaggagggagcgatgtggaattggtgagcaagacgttgcaagtggagcataagctattctattttgatcttaaggagaatcctcgtggaaggtatctaaagatatcggagaagacgtcggcgacgaggtcaaccatcattgttccttcctccggcatctcttggttccttgatctcttcaactactatgtcaattctgaggaacacgagctttttagcaaagaattgcagcttgattccaaggtgttttacttcgatatcggtgagaacagaagaggacgcttcttgaaggtgtcagaagcatcggttagtagaaatcgaagtaccattattgttccagctggaagctctcctgatgaaggatgggcagctttcaggaatatattggctgagatacatgaagcatcaggactttttgtgatgccaaatcagaaaccttctgatggacaggaacacttggttgatgatgttggagctggttttatacctggacatggtagtcagcagccatcttcttcagaacataatgtggatcgaacaattgactcgccaggccaggaagaaaccggaatgactggtgtttctaaagtaatcagagctgaccagaaacggttcttctttgatcttgggaacaataacaggggccatttcttaaggatatctgaggtggcaggttctgacaggtcttccatcattctaccgttatcgggtcttaagcagtttcacgaagtaattggtcactttgtggagatcaccaaagataaaattgaaggtatgacaggtgcaaatgtcaggacagttgatcctcctcagagataagtattgattctcttagaggatggaaattttcaatcctctaaccatttgaatctggcaacttcaagtcgactgcctgatcgcggtgtgcaatagtttcacgtaatatctctcgccccttcacatcttctaaaaataattcagcaggatcatcatttgccttaatagtagataaaacaaactttggagtctgcaactgggaataagctgaaaatcatccaccatgtgtatctctctctctctctctctctctccctccctccctcatttgcttctgttctgttttaactttttttgtttttgttcagtttgggtcattgggtgtatatctgttgacggcttgatgcatttcaattgtaaaagaatattggggtttatatgtttgggctaatgcctgttggaataaaagatgaagtgtaagttctatacatgagttacgaattctttttggttttgtctgaaaatgatttagttctactacc

SEQ ID NO: 9256 - DNA, 1500 bp, Arabidopsis thaliana
tctcacctccaccaattcctcattcttccaatcgcacttcctttaccagatcagacgtcaatttcaactcttcagtgaagagatttctttcaccgaattttctactccgatcgatcaattgaagattgaaatggaagctaattcaggcggaggaggaggagctgaaggcggaagagcggtaaccggaggaggaggaggaggaggagggagcgatgtggaattggtgagcaagacgttgcaagtggagcataagctattctattttgatcttaaggagaatcctcgtggaaggtatctaaagatatcggagaagacgtcggcgacgaggtcaaccatcattgttccttcctccggcatctcttggttccttgatctcttcaactactatgtcaattctgaggaacacgagctttttagcaaagaattgcagcttgattccaaggtgttttacttcgatatcggtgagaacagaagaggacgcttcttgaaggtgtcagaagcatcggttagtagaaatcgaagtaccattattgttccagctggaagctctcctgatgaaggatgggcagctttcaggaatatattggctgagatacatgaagcatcaggactttttgtgatgccaaatcaggtgaaaccttctgatggacaggaacacttggttgatgatgttggagctggttttatacctggacatggtagtcagcagccatcttcttcagaacataatgtggatcgaacaattgactcgccaggccaggaagaaaccggaatgactggtgtttctaaagtaatcagagctgaccagaaacggttcttctttgatcttgggaacaataacaggggccatttcttaaggatatctgaggtggcaggttctgacaggtcttccatcattctaccgttatcgggtcttaagcagtttcacgaagtaattggtcactttgtggagatcaccaaagataaaattgaaggtatgacaggtgcaaatgtcaggacagttgatcctcctcagagataagtattgattctcttagaggatggaaattttcaatcctctaaccatttgaatctggcaacttcaagtcgactgcctgatcgcggtgtgcaatagtttcacgtaatatctctcgccccttcacatcttctaaaaataattcagcaggatcatcatttgccttaatagtagataaaacaaactttggagtctgcaactgggaataagctgaaaatcatccaccatgtgtatctctctctctctctctctctctccctccctccctcatttgcttctgttctgttttaactttttttgtttttgttcagtttgggtcattgggtgtatatctgttgacggcttgatgcatttcaattgtaaaagaatattggggtttatatgtttgggctaatgcctgttggaataaaagatgaagtgtaagttctatacatgagttacgaattctttttggttttgtctgaaaatgatttagttctactacc

SEQ ID NO: 9257 - DNA, 1519 bp, Glycine max
ggaacgcaaaaccgaaacgcacaacattcacatccacattgtaaaactctttatacataccaattcccttcctttcctctctgtctcttcgcaatccctttcttcttcgctgccaggtcaccttctgtaataacagaaagtcagtggtgtaaagttatcagaaatagatgaaacagcggttataaatatataatgtctggactgattgaaagacttcctgatgctgttgcaattaggtgccttgcacgtgttcccttctactttcacccagtgttagagcttgtctctcgttcttggcaagcagctattcgtagccctgaactatttaaagctcggcaggaggttggttcaactgaggatctgttatgtgtctgtgcttttgatccagagaacttatggcagttgtatgaccctatgcgagatctctggattacactccctgttcttccctcaaagatcaggcacctttccaactttggtgctgtttccactgctggaaagttgtttgtgattggtggtggaagtgatgctgttgatcctttgactggtgaccaagatggttgttttgcaacagatgaagtttggtcatatgaccctgtagtccggcagtgggcccctcgtgcgtcaatgcttgttccccgttctatgtttgcatgctgcgttttgaatggaaaaattgttgtggctgggggcttcactagctgcagaaaatcaatatctcaagcagaaatgtatgatcctgacaaggatgtttggattccaatgcctgatcttcatcgcactcataattcagcctgttcgggggtagtgattggtgggaaggtgtatgtactgcacaaggatttgtcaacagtgcaagttttagacaatgcagggcccggttggaccgttgaggaatgcgtgtggctccaagggcagatggcagttgtcggcgatgcactttatgtaatgagccatggattaatcttcaagcaggacaaagaagagagaaaggttgtaggttcagcatccgagtttcgaaagagaattggctttgcaatgactggactaggtgatgacttatacgtgattggaggcttcattggaccagatagatggaattgggacattaagccattatccgaagttgatgttctcacacttggaagtgagagaccaacttggcgccaagcagctccgatgacacggtgtcatggtcctattcttggttgtacgctgctgagaatttaggctttagctttctaggttctagtgtaatttgtgctcgtgggatttggatcgcttcaactagacaaagaatcagttgttcaatggcttccctgttttgtatgtaagctataacatttgtccttgtttttatgtttatcacatgcggtaaagaggtgagtttccgtatttgttctgtttctagcaaaacagttaaggatcaccattaacaaggtcacaaatcggtgctattcctattcccaccttgaaaatcaatttcatttagctattcaaaaaaaaaaaaaaaaaaaaa

SEQ ID NO: 9258 - DNA, 1563 bp, Glycine max
tttttttttttttttttttgcttgaaaacattaccttatcttattaccacataatagtcaacaaaacaacaaggacaaatattatggcttacatacaacaactcaaagaagccattgaacaacctaattcttcgtctcctgttgaaggaattcacattccttagttggagcacacatatcacataagcctaaaaagtggaagcctaaattctcagctgtgtacaaccaaaaatagtaccaccacaccttgtcattggagctgcctggcgccacgtcggtctctcgctcgcaagtgtaagaacatcaacatcagacagtggcttgatgtcccaattccacctgtcagggccaatgacacctccaatcacatataattcatcacctaaaccaatcattgcaaatccaattctccttcgaaattcagaagctgaaccaactaccttcctcatttttttgtcttgcttgatgattaatccatggcttatcacataaagggcatccctgataactgccatttgaccatggagccacccatattcctctaccgtccactgacctgcattgtctaaaacttgcactgttgacatatccttgtgcaggacatgcacctttcctccaatcaccactcccgaacaggctgagttatgggtgcgatgaagatcaggcattggaatccaaacatctttctcgggatcatatatttctgcttgagatattgactttctgcagctagtgaagcccccagccacaactatttttccattcataacacagcatgcaaacatagaacgggggacgagcattgccgcacggggggaccactgccgtactactgggtcatacgaccagacttcatttgttgcaaaacaaccatcttggtcacccgtcaaaggatcaacagcatcacttccaccaccaatcacaaacaactttccagcagtggagacggcaccaaaatgtgaaaggtgcctgattcttgagggtagaacaggaagagttatccagaggtctcgctgagggtcatacagctgccataagttctctggctcaaaagcacagacacacaacagatcctccgatgaaccaagctcctgtcgagctttaaatagttcagggccacgaacaactgctcgccaagcacgagagacaagctctaactttgggtggaggtagaagggaacccatgcaaggcacctgattgcaacagcgtcaggaagtccttcaatcagtccagacataacaatcactatttcatctatgtccaacaattatccaactcctgcttaactggaaggtgcaccaacgtcaaagacatctaagtcactgaaattgtaaacggatcgcgccagcatagctttcctcgtcaagtccaaacaagagtgtgatactttgcctttctagaatataatgaatcactcaaattgaaactcggcatatattaaggagaaaaccatattaatctgaaagagaagacaagagcgaagaaggaagggatttgagaaagtgttgaagagagtaagagaaagagaaagagtaagagaaagagaaagagaaaaagaaaaa

SEQ ID NO: 9259 - DNA, 1816 bp, Vitis vinifera
tcatatagagactctcaagacgtttccgtagctctcaaaagcctctcctcatttcttcacatccaatccaacgctactctctctttttctctccctttctctggaatctgagcagcgcaaacacaaatttgttctccttggtactgggttctagggagttatagtgaaggagaaggactattttgttgtgcatcttttagaaactgattgtgtatcctatagtgtccactatagccagcaaattactattgtcattgagcaaagaatcattgaaagtggatgtaaagtatcatgtccgggttgattgaaggtcttcctgatgccgttgccctaaggtgccttgcatgggttcccttctacctacatcccaggttggagcttgtttcccgctcctggcgagatgccattcgtggtcctgaattatttaaagctcgacaggaggttggttcatcagaggatctactatgtgtatgcgcttttgaccctgaaaatttatggcaactctatgaccctcgtaaggatctttggattagccttcctgttctcccctcaagaatcaggcaccttgcccactttggtgcagtctccactgcaggaaagctatttgtacttggtggtggcagtgatgctgttgatccattgacgggtgatcaagatgggagttttgcaaccaatgaagtctggtcttatgaccccataattcggcagtgggccccacgggctcctatgcttgtaccccgagccatgtttgcgtgttgcgtgttagatggaaaaatcgttgttgcaggtggttttaccagttgccggaaatcaatttctcaagcagaaatctatgatcccgagaaggatgcctgggtttcaatacctgatctccaccgcactcacaattcagcttgctcaggagtcgtacttgatggaaaggtgcatgtcttgcacaagggtttgactactgttcaaatcttggacaaggttggccctgggtggagagtcgaggactatggttggctccagggtccaatggcaattgttcagggggcactctatgtaatgagccatggaatcattttcaagcaggagagagaagtgaagaagatggtggtatcggcatcagagttccgaaggagaattgggtttgcaatgactggattgagggatgagatatatgtgattggaggcgtgatcgggcctgataggtggaactgggacatcaagccattgtctgatgttgatgttctgaccatcggaagtgagagaccagcttggcgtcaagtgtctccaatgtcccagtgccgaggaactatttttgggtgtactcagctgagaatttaggtctccagactggtttttgttgttgctttgttgtgattgaggcactagagtttgagaagaagcaaaaaaaaaaaaaaatccagctttctgccagctacctacctttcttttgtttgtaaaccaaccttggccttgttttttactcatgatcttttctttgtagggcttgaagcattgggtggcttagcaggcattgaatatgagcttttacatgaaaattatgaaatgttgttagcatgaacagagaaaaaattctctcttttattacttcacttcaatttcccttgtatccttcagcttccttgtttagtagtagtcttctcttctgctctgcatggttggagtgagaaggattaaaatcccatgacgaactgtttgaagatccggagtcttatccgggagatgttttgttctcgtctaatgtcgtcttagaacatctgcgttaccttttgtttgcgaatagactttcgataaagttggctttcct

SEQ ID NO: 9260 - DNA, 1149 bp, Vitis vinifera; identical to SEQ ID NO: 9253

SEQ ID NO: 9261 - DNA, 1651 bp, Glycine max
gtagagatcaactaactatcccaacttgccaatataaactgtgaagagtttctataaatgcaggacttctagcatactgttgtttgattaaccaagttcttccatattggttgaggaagcctcgagtcaatatttagtttttgctaccatctgtgggtttctgatggatgatgctgggcatcgtgagaatggaagacacaaagcagcagatcaatataaatctgctcagggtcagtggttgatgcaacatcagccttccatgaagcagattatggcaatgattgctgaaagagatgcagccattcaagaaagaaatctggccatttccgagaaaaaagcagcatatgctgagcgtgacatggcatacatgcagcgagatgctgcaattgcagaacgtaataatgcaatgttggaacgagatgcaattgcaactcttcagtatcgtgaaacctccttaagtagtggcagtatgccatcatgccctccaggatgccaaatttcacgtggtgtcaagcatgtacatcatccccaacaacaggtgcaccatatacctaacatgggtgatgcctcttacaacacaagggaaatgcacacaacggaggtcctccctgcagcccccatcccttctgagactgggaagtcaaggcgggccaagcgaccaaaggaaccaaagtcagctccacctaataaaaagacttcaaaaccctcaaaaaaagtcaagaaggagagtgaagacttgaataatatgtttggcaaggcacatgagtggaagagtggtcaggaaatggtcaatggaggtgatgatcttaacaagcagttagcagtgtcgaaggctgattggaaaggtcaggacttggggttgaaccaagtggcgtatgatgagtcaaccatgccagcgccagtatgctcttgtaccggtgtcctgaggcagtgttacaaatggggtaatgggggttggcagtctgcctgttgcacaactactctgtcaatgtatccacttcctgcagtgcccaacaagagacatgctcgggtaggcggccggaagatgagtgggagtgctttcaacaagctgcttagtcgacttgcagcagaaagtcatgatctgtcaaaccctgttgacctcaaggaccattgggcaaaacatggaacgaaccgatacatcacaataaagtagagggcgagacattgtttctggggcagcattacacgaatagaaactgcttttagtgatcaattatggattctcaagtcgaatgagaaaaataatgttaagtgtaaaggccatccgggaaagctaatgatttagagtatgcccttgcttatatttaggatgcataagcctggtggaggctggctaaatttaggggttgaagaagtgactatatagtcatcctcggcatttgtcgcacttaattttcttagatagcctgatggcaccgatggcatgtataaaaagtctgcatgatggatggataaatagctgttagatagtcttggttaatgcatttagtacttaaaccctaataattgtagactcgtgtcctcagtcatcctggaaccctatctgcgttaatatgtaaaatcaactatgtatgctaattttttccctgtttcatgtttgttgtttttcctccaaaaaaaaaaaaaaaaa

SEQ ID NO: 9262 - DNA, 1680 bp, Glycine max
gggcttaggtacagatacagacacaacctggtaaaaatcccgaccccagtgccgcacaattttccttcactcgcagcggaggtttacttttgatctagtacctgctatccctatgtataagcatggacttctagcatactattgtttgattaaccaagttcttccatattggttgaggaagcctcgagtcaatatttagtttttgctgccatctgtgggtttctgatggatgatgccgggcatcgtgaaaatggaaggcacaaagcagcagatcaatataaatctgctcagagacagtggttgatgcaacatcagccttccatgaagcagattatggcaattatggctgaaagagatgcagccattcaagaaagaaatctggccatttccgagaaaaaagcagcatatgctgagcgcgatatggcattcatgcagcgagatgctgcaattgctgaacgtaataatgcaattttggaacgagataatgcaattgcaactcttcagtatcgcgaaacctctttaagtagtggcagtatgccatcatgccctccaggatgccaaatttcacgtggtgtgaagcatatacatcatccccagcaacaggtacaccatatacctaacatgggtgatgcctcttacagcacacgggaaatgcacacaaccgatgccctccctgcagcccccatcccttctgaggccgggaaaccgaggcgggccaagcgaccaaaggaaccaaagtcagcttcacctaataagaagacttccaaaccagcaaaaaaagtcaagaaggagagcgaagacttgaacaaggttatgtttggcaagtcacatgagtggaagagtggtcaggaaatggtcaatggaggtgatgatcttaacaagcagttaactgtgtcaaaggctgattggaaaggacaggacttggggttaaaccaagtggcgtatgacgagtcaaccatgccagctcctgtgtgctcttgtactggtgtcctgaggcagtgttacaaatggggtaatgggggttggcagtctgcctgttgcacaactactctgtcaatgtatccacttcctgcagtgcccaacaagagacatgcccgggtaggtggtcggaagatgagtgggagtgctttcaacaagctgcttagtcgccttgcagcagaaggtcatgatctgtcaaaccctgttgacctcaaggaccattgggcaaaacatggaacgaaccgttacatcacaataaagtagaggatgagaaattgtttgtggggcagcattacatgaatagaaacagcttttagcgatcaattatggattctcaagtcgaatgagaaaaataatgtaagtgtaaaggtcatctgggaaagctaatgattagagtatgcccttgctatatttaggatgcataagcctggtgttaaagtcatcctcgttcgtcatttgtacgcacttaattttcttagatggtctgatggcgccaatggcatgtataaaaagtctgcatgatgggatggataaataactgttagatagttttgtttaatgcatgtagtccttaaacctgaataattgtagactcgtgtcctcagtcatcctggaacctttttgcggtaatatgtaaaatcaactatgtatgttaattttttccttgtttcatgttaaaaaaaaaaaaaaaaaaaaaaaaaa

SEQ ID NO: 9263 - DNA, 1643 bp, Vitis vinifera
gaaacgagtataaacccagtgcccccttctactgtttcccctcttcaacgcacagtctcacatttcaagagctagggtttctcaattttgctgtctctgccacttctagtattttctagtttgggtgacaatttgatgttcaactgattatacctcacacttatacttgaggtttgaaagtaagaaatacgattattcccatctgcggtctcagatggatgagggtgggcatcgtgaaaatggaagacacaaagcagacccatataaagcagttcatagtcagtggttgatgcaacatcagccaacaatgaaacagataatggctatcatggctgaaagggatactgctgttcaagaaagaaatttggctctttctgagaaaaaggcagcagtagctgagcgtgatatggctttcctgcagcgagatacagcaattgcagagcggaacaatgccattatggaacgagacaatgccattgcaactcttcaatatcgcgagaactcattgaatggtggcaacatgtctccatgcccaccaggatgccaaatctcgcgtggggtgaagcatatgcaccatcctcagccacacttacatcatccaacccatctgagtgaagctgcatacagcgcaagggaaatgcatattggtgatgccctccctgtttcacctgttgcttctgaggctgcaaaatctcgacgggctaaacgaccgaaggaggccaagccaatgtcatctaataagaaggcttcaaaacctttgaagaagcctaagagagaaggtgaggacttgaacaagattgtgtttggcaagtcacgtgagtggaagggtgggcaggatatgagcagcggaggtgatgaccttaacaaacagctagttgtctcaaaatctgattggaagggtcaggacttagggctaaaccaggttacatttgatgagtcaaccatgccagcacctgtttgttcgtgcactggagtcctaaggcagtgctacaaatgggggaatgggggttggcagtcatcatgttgcacaaccaccttgtcaatgtatcccctaccagcagttcccaacaagcgtcatgctcgagttggtgggcggaagatgagtggaagtgccttcaacaagctgcttagcaggcttgccgcagaaggtcatgatctgtcaattccggttgatctcaaggaccattgggccaagcatggaacaaaccgctatatcaccatcaagtagactgactgcaaaggatctcgagtcagatggaagaaaacagcccatgctgggtcaggtattcatcctcaattcttcctttagttgcgccatgaaaaggttagatggtgaggcagtatattggtagttcttcatagttccagccattttagcttttcttgcaatcctatggactcttttttataggctgtcttttcttctttccatctttttgtgtctgtattcaagtgatgattgaaaaaagatagaagggagatctgcctctcattctcttagtttacagaattaaatgtagtgaacttgaaacgtcctttatcttgtgactgaagataattgtaaagcaaggattgcatttcatagagctttttctgtccgttttgtactaatggatagaatttatcatatagctggttatcta

SEQ ID NO: 9264 - DNA, 3538 bp, Medicago truncatula
acaacattattaatttttctgctgcgaagaattagggttttcaatcttcttcttcgtttcacttctcgtaagcttcatctcattcattctactatctttcttattgctaacttcaattattctctttcgcttgcatttttttgttttagcttactagttctaattttgtacaatgattgttcaaatttcatcgtttgttttttatatattttttgctatttttgtttttgattgatttcgaaaattggggttttgactgtgtttgagatccgtgtgtttttgttgttgtcgaaattgagaaaattgcggaaatgtgttctctattcgttgaccttcgtacttcgtagttgaaagtacacagagagagtgtgtgtaagatagtactttgaattttcaatttttattttttaatttttagaattgctctttttagtttttttttttttttggtcttaaccctctagttcaaagggaaggggagctggtaatccgaacttcggctgcgaggttagtcaaggctaatcagaaattgttacagccataattcgaactcgggttccactgaattattgctctctgtagttatgtaaggttttaaatttacagaaaatagtgttttgttcaaattctgctacacaatagtgctatagcgccactatagcaacaatttcacagtaatttgtactaagcgtatcgtggaacaataaagatttgttaaaattccattatgcaatagcgccactattgccactagttaacaacattggtttgggtgtttagatgtttttgagattagctcgttgttatgtacttcattattgccacaatttgttggttgatgtttatgagacgaagtttgttgtttttggtccttcgttgtgcgtaaaactttctaattgctaagactaggtcaactatcactgactgactcttaagctagttaacttattgaccttggatggaaaccggtaataagctgcaaaataatgtactcgactgttgaaaagaatctcagtcataaagttgtttattctcctcatttatttatgcaatgttttgctggccattttatgctatcctaatcatttttggatcaaacaaggatccccttgacctgctagcgcgattgctttttctagtatactgttatgctttctttctcccctcttccttattgtttgaacagaactttttgcatagatgtttgaatagtcaagatattgttgtgaactctatttgtctctgtcattgtgggggcagtgctgcaatcatggaaaatagcgatttgttcaaattttgatatgctttagcaccgctattggataacactttgtatttaatagcctatcacgctttgttcagattcagctatgctatatcgatatagtgcctctaatctatagccgatatttgaccatactgctaactgcgtcacttttgtgctccaacaaaagtgattgattctcgacaataattagtaattttccctgattttcaaactgcctttgtctccgtgcacagttagtggttatctctttatttcctttttgatccatgtagccgaccccagtgggataaggcttggttgttgttgttgtttctttcatttaagatagtcattaagcttttagattcgagtttttatcatagctggcattatttgtaattttagaacattgttgaccaactcgaatcaaatttttctgcagggattattttttgaagagttgatttggattcagtcactgggtgcatagcctctatgtacaagcatggtatgcaccataaccttttccacctctattctttgttaaagtcgttggtagaaaaatttcatctaccctccaggcctcaaggaacacaggaggaaagtgattctctattaagttaatataaaatataattagttctttaattgatattcaggacttttagcgaattattgcttgattaaccaagttggatgcgggcttaagaggcttatagaaaatctttagctttactaccatttgttaattctgatggacgaccgtgaaaatggaaggcacaaagcagatcaatataaatctgctcaaggacaggtatgtagaaatacgcctctgctcagaaataaattgaagtttttttttgggttgatgaaataaatttcaggttgcatgaacataacagtcaataaaagtgctgcatattaaacctaagaagggtgttttctctactaatattgttctcaaaattgctattgcagtggttgatgcaacaacatcagcatcaacatccttccatgaagcagattatgtcaatcatggccgaacgagatgcagccattcaagaaagaaatctggccctctctgagaaaaaagcagcacttgcagaacgtgacatggcattcctgcagcgagatactgcaattgcggaacggaataatgcacttatggaaagagataatgcaatagcaacccttcagtttcgagaaaatgctttggccaatggtggtatgtcatcatgccctccaggatgtcaaatctcacggggagttaagcatatacatcaccttccgcaacaggtaaaccatttgcctaatatgggtgattcttcttacggcacacgtgaattgcacacaactgatgccctcccagcagcccccgtttctttagaggttgggaaaccacctaggcgtgccaaacgaccaaaggaaagcaagtctgattcacctaacaagaagactccaaaatctagaaaagtcaagaaagagggtgacgatttaaacaagacaatgtttgccaacaacaaagaacttgaatggaagagtagtgaggaaattataaatggagatgatgatcttaacaagcagttagcaatctcaaaggctgattggaaacctcaggacttggcattgaaccaagttgcatacgatgattcaaccatgccagcaccagcatgctcttgtactggtgttctaagacagtgctacaaatggggtaatggaggttggcaatctgcttgctgtacaaccactttatcggtatatccacttcctgcagtgccaaacaaaaggcatgctcgagtaggcggtagaaaaatgagtggaagtgctttcaataaactacttagccggcttgcagccgaagggcatgatctctcacacccagttgaccttaaagaccattgggccaaacatggtacaaatcgatacatcacaataaagtagacaacagggcatttttctccggatgggcaatacatgatcaatggtcagttatgtattctaaagttgaacaaggaggaaaataaggtaatgtaaatggcatctgtgaaagattattaatgcgtcattcctataattaggatccaagtaaatggcaatgtaaaacatatttctgtcactggtaaccattttgacctgaaaaaatggtctgtggtggtggcaatcacatttaataggcttggttaatgcatcttgtggtggttaagactaaataattgtagagccttgtactttggttgaatcttgctataaaatgaactatctgattcatat

SEQ ID NO: 9265 - DNA, 1433 bp, Arabidopsis thaliana
ccatcttcctcttccccgatctgtttcttccacaaagatatttttctttattctctcgcagttcaattagggtttcaatctctctgctctgcttgtcatcaccaccaccaccaccaccgtcgtcgtctctctgtatctctccggcgggttctctctctacttcccccggaggattaaaagatggaccagtcttttattttgatattccgttagcttgttcagttattgtagaagctgtaccgtcaagacttttaatatctcaaatggatgatggtgggcatcgtgagaatggtcggcataaagcagcagttcagggccagtggttgatgcagcatcagccgtcgatgaaacaagtgatgtcgataatagcagagcgcgatgcagcgattcaggagagaaatctggcgatatcagagaaaaaagcagcagtagctgaaagggacatggcgtttcttcagagggacaccgccattgctgagcgcaacaatgcgataatggagagagacagtgctcttacagcactccaataccgtgagaactctatggttactgctcctgctgccaatatgtcagcatgtccaccaggatgtcaaatatcacgtggtgtaaaacacttgcaccatccgcacatgcatcatcatcatcaacaacatcacatacctcagttgactgaaaatgcatatgaaaccagagagatggagccaaatgatggtctcccaacatcaccacctgccggatccaccttggaatctgccaaaccaaaacgtggtaaaagagtgaacccaaaggcgacaacacaaactgctgctaataagagagggccaaaaaatcagaggaaggttaagaaagagagcgaggacgacttaaacaagataatgtttgtaaagacgacccatgactacacagacgaagattcaagtaagcatatcttaataggatcaaaatctgactggaaaagtcaagaaatggtggggctgaaccaagtggtttacgacgagacaacgatgccaccacctgtatgttcatgtacaggagttctcagacagtgctacaaatggggaaatggaggttggcaatcatcgtgttgcacaactacactatcaatgtatcctttacctgcactgcccaacaaaaggcatgctcgagttggtggacggaaaatgagcggaagcgcgttcaacaagcttctaagccggcttgctgcagaagggcatcatgatctttcaaacccggtcgatctgaaggaccattgggcaaagcacggtacaaaccgctacattacgattaaatgatatgtgcatttaggtgtgagttgttcttacgacattatctgattttaaatcatgtgtactaaattcaaataaactcgagaggaaaagaattgtatgtggagccaatgttatgttgtattatataattcgaaaatttttagt

SEQ ID NO: 9266 - DNA, 1519 bp, Glycine max; identical to SEQ ID NO: 9257

SEQ ID NO: 9267 - DNA, 1435 bp, Glycine max
gaggcataagaaacagaatgagagggaattatgcagaaagaaaaagaacgtgaaaaccatttctcttcacaattatccctttttccactctgacgccatttaattattcattcatataaattaggctctctcatcttccattccaattactattagattctgcttccgttattttttctcccttcttcacttcctctttactattcgttcgttctggattcagttgagggaaaaaaactgcgtggtttgagcaatggatgttaaagctgcacagaggttacaactttcagcggtggttcaacccgaaaggtttgggagaagaccaccattcagtacatgtcgtttgggtgtgtctcgggaaccgcagagccttcgggtttttgtttcgccaatgatgatgcggcgcagaacaaccgctttggaggtttcctcttcttacgacaacatttcagcttcaattttggaatctgggagcgttcatgctcctcttgatgaagagctgattctaaagaatagatcacaagagacccagccatatttaaatggacgctgtatttatcttgttggaatgatgggctctgggaaaacaacagtggggaagataatgtcgcaagtgcttggttattcattttgtgatagtgatgcattggtggaggaggaggttggtggaaactctgtagtcgatatatttgagcaacatggtgagactttctttcgtaataaggagactgaggtgttgcataagctatccctgctgcatcgacttgttatttctactggtggaggtgctgttatgaggcccatcaattggaaatatatgcacaagggggttagtgtttggttggatgtaccagtggaagccttggcacagagaattgcagctgtaggaactaattctcgtccccttctaaactatgaagcaggggatccttacacacgggcttttatgcgtttgtctgctattttgaagagagaggtgaagcatatgccaatgccaatgccagggtctcattaaaaaagatagcaataaaactgagcaaaagagatgtgtccgaattgtctccaactgatattgcaattgaggcgctagaacaaattgacaactttttgaagggtgaaggaggcggttatgcagaatgctagtacaagctttggtcacaagcttctttttgattgttcatatttttttatgcaattgcaattaaggtcatgctgttgacctctctttggtaaaaaaaaagggggtagtaatgcaacatggcacttgtttatgcataatttgtgttggcaaattagcacaatccgacagccaatagcaacaacatttaatttatgttctgtttattgtttaatgttgatgtatatagacatagacactggtgaacgaggtgttgtaatccgagttcggttgatcaatttatgtatgccttcctct

SEQ ID NO: 9268 - DNA, 885 bp, Vitis vinifera
tcaaagattgcctaacacactgaatcttgagggccgggtttagtgccctgggcccagttttattcgaattcggctcaattactggataatcgctcgtttccatttctcttgccccctctctctctcttgttgagcaactgctgatgatgattggaggcgcccgggtccggcttaatgggtggcagcaggctgctgttgctatgggttcggcaattggcgcattaatggacccgcgccgagccgatttgattgcggctcttggcgagactactgggaagcctgcttttgaaagggttctggaaagaatgaagaagagcccggaaggccaggctatactcttggacagaccacgtgtcgtatctgcaagagtgggtcatgcatgggatatgcctgcaaacacatttggtgctgcctatgcaaagttcatgggatccagaaacttttccccagatgatcggccaccagtgcggttcatggagacagatgagctggcatatgtcgccatgcgtgcccgtgaggtgcatgacttctggcacaccctctttagcctccccactaacctaattggtgagtcggcactcaaggtaatagagtttgagcaaatgttccttccaatgtgccttctatctgtcatagggggtacggcaagatttagcgagaagcaaagagcattgttcttccagcattacttcccttgggccacccgtgctggtatgcagtgcacagatctcatgtgcatatactatgagcagcattttcatgaggatttggacgatgttaggaggaaatgggggatagttcctgctcctcctcctccacgtcaataagctgtctgatcagcagctgccatacatggttggatggacaggagcagtgtaagagtta

SEQ ID NO: 9269 - DNA, 1063 bp, Arabidopsis thaliana
aaaaactttcagtcaaatcttgagaacagaaagaaagtccacgcgaggacataagcgcgtgtgatttaaaatcgtcgtcgtcgtcttccacaccgactttaatctgattcttagaatcgccgtttggtttttaaccagagagattatctaccaaggaacgatgattattgaaagagctcgagttccgttgagccgatggcaacaagcggccgtggcgatgggatctgctctcggtgcgttggttgatcctcgtagagcggatctaatcgctgctctcggcgaaactaccggtaaaccagcttttgaaatggttcttgagagaatgaagaagagcgaagaaggaagagctatattattggagcgtcctcgagttgtgtcagagcaagtaggtcatgcttgggatctaccagaaaacacatttggagctgcatatgctaaattcatgggatctagaaacttctctcccgatgatcgtccgcccgtaagattcatggagacggatgaattggcttacgtagcgacacgggcacgcgaagttcacgacttatggcacactctgtttggccttcctacgaatcttatcggcgagtcgtctttgaaagttatcgagtttgagcaaatgtatcttccgatgtgtatgctctctgtgattggaggtactgtgaggttcaacgagaagcaaagatcaatgttcttgaagcattaccttccttgggctgttcgtgctggaagacaatgcactgacctcatgtgtgtgtactatgagcgtcactttagtgaagacttggagcaagttcgtagaaaatggggaatcatccctgctcctcaacatcctaaatgacggttctagtttaatctgttttcgaatcacttagttatgccaaatctcttataaatgtgtagtggattggattaaaagttgtactcgcatttgatggttaataagagacaagttgggaagtttttgattcaaacattttttcagcaaaatattacagataagagttgagacaagaaaccgacttcttatcatttaaaggctcacatcaaacagtttcatagt

SEQ ID NO: 9270 - DNA, 1104 bp, Zea mays
cccgaaacccctatacgtaaataaaaaaaatccataacgcaatcgcaaggcgctgcctccaccgccgccacctgcacatccatcgtcgccgttcgcgtctccggatcccgcgaccggagtccggaccctcatcccgcggccgcatattctcccgtccgtgccctcgcgtgcgctctgcccctccggcgtccgccgccgccgtcgccctatcccaggtgccgtggtctccatctcccggagcttcgccggcgacgagaatcctccagagccatgctgggcgcgcgtgtgcagctgaaggggtggcaacaggcagctgttgcatttggttctgcgtttggggccttgcttgaccctaggagggctgatcttatagctgctcttggagagactactgggaaaccagcgtttgagcgtgtgctgcaacgaatgaagaacagtgcagaaggcagggaagttctttcggagcgtcctcgcgtggtatcctcgcaggtttcccatgcctgggacatgcctcagaacacatttggcgcggcgtatgctcagttcatgggatcaaggaacttctcaccagacgatcgcccgcctgtccgtttcatggacaccgatgagctcgcctacgtcgcgacacgtgctcgcgaggtgcacgacttttggcacgtgctgtttggtcttccgacgaacctgattggggagaccgccctcaaggtgatagagtttgaacagatgttcctcccaatgtgcatgctgtcggtcgtcggtggctctgcgaggttcagtgacaaacaaagggcgctgtttttccagcactacttcccatgggcaacaaaagctggtctcaagtgtactgatctgatgtctgtatattacgagaagcactttcacgaagacctggaggaagtgagaaggaactggggaatccttccttgccccagtcccaaaaagagcagtgtataggccggcattttctgcgtgaactttctatctgtttcttctttggtttctgttagttgctcagttctttttggaataaaatcatgagctaatgttgatgaatactgatacgttaccgagttcgaagtatggttaacaaaaaaaaaaaaaaaa

SEQ ID NO: 9271 - DNA, 1183 bp, Oryza sativa Japonica Group
ggacctgtggctatcgcggaagggagcggcggcgaacccagctcggtgagtcgtcgtcggcggcggcggcgacggcgacggctaggaccacgtgacgcggatcagctcggaggcagcgacgacccatctctgatctccctcacgttcagaggcgcgaccaagcgtcgagggggagcgctcgacggcgagagtcatgcagggggcgcgtgttaatctgaaggggtggcaacaggctgctgttgcattcggttctgcatttggggccttgcttgaccctagaagagctgatctgatagctgctcttggggagactactgggaagccagcatttcagcgtgtgcttcagcggatgaggaacagtgctgaaggcagggatgttctcctggagcgtcctcgagttatatccacacaagtttctcatgcctgggacatgcctcagaacacatttggtgcagcatatgctcagttcatgggatcaaggaacttctcaccggatgaccgcccacctgtccgtttcatggatacagatgagcttgcgtatgttgcgacccgcgcccgtgaagtccatgacttttggcatgtgctgttcggccttcctacgaacctgattggagagactgcccttaaggtcattgagtttgaacagatgttccttccaatgtgcatgctttcagtcgttgggggctctgcgaggttcaatgagaaacaaaggacactgttttttcagcattatttcccatgggcttcaaaagcaggtcttaagtgcacagatcttatgtctgtgtactatgagaagcattttcatgaagatttggatgaagtgaggaggaactggggaattataccatgccctgatcccaaaaggagcagtgtttagacttttagatcggtacattttgcatgaaagatgtctgaacttggttttcactttgtctacgttagtattagctcttccctttcaagaataatagcaagagttatgctattgatacctaaaaaaactagtaattctctttaacttagcatagcaactaagcttgcaatgttgatgttccctttaacaatagtgtagatgagttaattacatttttatgtgtaatactagctgaatgccggtacttcgctatggacagaagaaaacatatcataatattgtctgaaataaataaaattatattttccg

SEQ ID NO: 9272 - DNA, 1231 bp, Oryza sativa Indica Group
agggggcgcgtgttaatctgaaggggtggcaacaggctgctgttgcattcggttctgcatttggggccttgcttgaccctagaagagctgatctgatagctgttcttggggagactactgggaagccagcatttcagcgtgtgcttcagcggatgaggaacagtgctgaaggcagggtaaactcatgctaccctatatcccctaaaagtgcaggacgttatgtcgatgcatccatttgttgtgcttgaccatctctttatatatagcctttattactagcatattctgtaaatagtatacatatatactcagcttctgaaacagtaacaatttctctgccaacaaatgctaaggagcatatgatgattatacaccaatactacgaagtagatttttttgtgtgaagtagcattatcctttttacttggttgtttcagggagcaatgttatactgaaaaatggaatagtgtaggtcttttcataagctgtccattttttttgttgttcatttgttatttatgcatttaactctccaaaatatcttccttgtttggctgcagtctagacttacccattcaataaatttaaacctgcaattgctatactttgatgattttttccttcttgttacatcactgccatgcaatagcaacacatgccagctgaaaatgtgtactcaacactgtggacttctttcccaattgacttaactaagatactattcctacaggatgttctcctggagcgtcctcgagttatatccacacaagtttctcatgcctgggacatgcctcagaacacatttggtgcagcatatgctcagttcatgggatcaaggaacttctcaccggatgaccgcccacctgtccgtttcatggatacagatgagcttgcgtatgttgcgacccgcgcccgtgaagtccatgacttttggcatgtgctgttcggccttcctacgaacctgattggagagactgcccttaaggtcattgagtttgaacagatgttccttccaatgtgcatgctttcagtcgttgggggctctgcgaggttcaatgagaaacaaaggacactgttttttcagcattatttcccatgggcttcaaaagcaggtcttaagtgcacagatcttatgtctgtgtactatgagaagcattttcatgaagatttggatgaagtgaggaggaactggggaattataccatgccctgatcccaaaaggagcagtgtt

SEQ ID NO: 9273 - DNA, 713 bp, Glycine max
ggatcccaagctcacacaccaaaccaaagcaagaatagtgttctaagagtgagcaacaacttcaaacaccattgtgagaaatggcttccaagggtgcacttctcttgtgtctcaacattctcttcttcactgtggtaagctccacatatgtcccatgcaacccaccccctaaaactcctaaacacacacctgtcccaaagccaccttccccaaagcaaccaagttgccccaaagacaccattaagtttggtgtgtgtgctgatgtgttaggtttgattaacgtgcaacttgggaagccaccaaagaccccatgctgcaacctcattcagggtcttgctgatcttgaagctgcggtgtgcctttgcaccgctctcaaagctaatgtgttgggcatcaaccttaatgtcccagtcaagttgagcttgcttctcaactactgtggaaagggtgttcccaagggattcgtctgcgcttaaatcaacacttcatataacttgtttcctaaaattaattagtatgcttaaggttctatattttgctatattggttatttattcataatattctgtgtattttggtattctgtttggcacgtgccatttaatctgtgcttgtttttctgttgagcaagcttcaaatgttcgttcaacgaaaagtaacacgtattcttagcactcttagaaacgaacatttcgtcgtactagctggtcatt

SEQ ID NO: 9274 - DNA, 396 bp, Glycine max
atggcttccaaggctgcacttctcttgtgtttcaatgttctcttcttcaccgtggttagctccacatatgtgccgtgcaacccaccccccaaaactccaaaacacccacctgtcccaaagccaccttccccaaagcaagcaagttgccccaaagacactattaagtttggtgtgtgtgctgatgtgttaggtttgatcaacgtgcaacttgggaagccaccaaagaccccatgctgcaacctcattgagggtctcgctgatcttgaagctgcagtgtgcctctgcactgctctcaaagctaatgtgttgggcatcaacctcaatgttccagtgaacttgagcttgctactcaactactgtggaaagggtgttcccaagggtttcgtctgctattaa

SEQ ID NO: 9275 - DNA, 621 bp, Glycine max
ggatcccaagctcacacacactaaaccaaagtaagaggtatagtgttctaagagtgagcaacttgtgagaaatggcttccaaggctgcacttctcttgtgtctcaatgttctctttttcactgtggttagttccacatatgtgccatgtaatccaccccccaaaactcccaaacgcccacctgtcccaaagccaccatccccaaagctagcaagctgccccaaagacactattaagttcggtgtgtgtgctgatgtgttaggtttgattaatgtgcaacttgggaagccaccaaagaccccatgctgcaacctaattcagggtcttgctgatcttgaagccgcagtgtgcctttgcactgctctcaaggctaatgtgttgggcatcaacctcaatgttccagtgaacttgagcttgcttctaaactactgtggaaagggtgttcccaagggattcgtctgctattaaatcaaacacttataatgtgtagcttcctattgctatattcgtcattcatcattattctgtgtatttcagtatttgtgcccggcacgtgccaattagccaacgaacatttcgttcatacttggttactattactgttgtgatgcgctgaaacttg

SEQ ID NO: 9276 - DNA, 721 bp, Glycine max
ggatacaccaaaccaaagtaagtgttctaagagtgagcaacttcaaaacaccatagtgagaaatgacttccaagggtgcaattctcttgtgtctcaatgttctcttcttcactgtggttagttccacatatgttccatgcaacccaccccccaaaactcccaaacacccacctgtcccaaagccaccttccccaaagcaagtttcttgccccaaggacactgttaagtttggtgtgtgtgctgatgtgttaggtttgattaacgtgcaactagggaagccaccaaaaaccccatgctgcagcctcattcagggtcttgctgatcttgaagctgcagtgtgcctttgcactgctctcaaggctaatgtgttgggcatcaacctcaatgttccagtgaacttgagcttgcttctcaactactgtggaaagggtgttcccaagggattcgtctgctactaaatcaacacttctaatgtgtagtttcttaatgttaagtatgtcttaaggttctatattttgctatattcgtcattcatcaatctatgaactttgttgttttgtttttccgtctggcacgtgccatttatagccaacgaacatttcgttcgcaattggttattattattattattattattattgtgatggttgaaacttgaaagtcttctcgtggtctttcttgtagcctcgctcacactactccctttgtattctaagtgaaa

SEQ ID NO: 9277 - DNA, 396 bp, Cajanus cajan
atggcttccaaggctgcactcctcttatcccttaacattctcttcttcactgtgtttagctcatcatacgtcccatgcagcccacccccaaaagttccaaaacacccaccagtcccaaagccaccttccacaaagtctggtacttgtcccaaagacacccttaagtttggtgtgtgtgctaatctgctaggtttggtaaacgtgaatcttgggaagccaccaaaaaccccatgctgctctctcattgagggtcttgctgatcttgaagctgcagtgtgcctttgcaccgctctcaaagctaatgtgttgggcatcaacctcaatgtccccgtcaagttgagcttgttactcaacgtctgtggaaagaagactcctaaggatttcatctgcgcttaa

SEQ ID NO: 9278 - DNA, 677 bp, Phaseolus vulgaris
gctttaatctgcagatatgcaaatggctccccaagccaacatcctgtttttcactgtggttagctccacatatgtgccatgcaatccacccccaaaaactcccaaacacccacctgtcccaaagccaccttccacaaagtctggcagttgccctgagaacacccttaagtttggtgtgtgtgctgatgtgttaggtttgatcggcgttgagcttgggaagccaccaaagaccccatgctgcaacctcatccagggtctggctgatcttgaagccgccgtctgcctttgcactgctctcagagctaatgtgttaggcatcaacctcaatgtccccatcaagttgaacttgctcctcaactactgtggaaagaaaactcctaaggatttcgtctgctattaaataaacacttcctataaccactttcataaacttaattaccatttcctaagcttctctattttcctatattccttattcatcattattctctgtactttggagttctgtctgctgtttgccatttagccaacgaacatttcgttcgtactattacctttggttattattatgttgatggttcaaatttgaaaggctccttggtctttctttgtcagcctcaccagtcctttgtattctaagtgatacttctaccaataaaagttctacatttaagctt

SEQ ID NO: 9279 - DNA, 738 bp, Glycine max
gggcaaaccattcattcattcagttcagtaactcacctcaccatggccgcatccattacattgtccaggctcgtctcttccaccctcaccactgcctctttcttcccacccataaccctgccttccaaactctcctctctccgactccccacccgccgccaccccaagccactcagattctcctcctccaccatcaccgccaccatctccgtcggcgacaagctcccggaggccaccttctcctacctggactcgtccggcgaggtgcagacgacgacggtgtcggaactgacgaaggggaagaaggcggtgctgttcgcggtccccggcgctttcacccccacgtgctcgcagaagcacgtgccgggcttcgtggagaaatcgggggagctgagggcgaaggggatcgacacaatcgcatgcatttcggtcaacgacgccttcgtcatgaaggcatggaaggaggacctcaaggtcaacgaggaagtcctcctgttatctgacggtaacggaaccttcaccaaagccattggggtcgaacttgatctcagcgacaagcccgttggtttgggcgttaggtctaggcgttacgcgcttttggccgaggatggggttgtcaagctcttcaatttggaggaagggggtgccttcactttcagcggcgctcagacatccttgatgttctttgaattattcttcctctttcgttattccacactccagttactactcttttca

SEQ ID NO: 9280 - DNA, 590 bp, Glycine max
ggatcgcagcacgctctatcatctctctcagtaatggcaaccacattcacgtttttccgaccaaccatgatccgggcctccgctggatctccgggcaggcccgacccgagcaacaggaagcccgtttcctccaattggtgggctccgccgttcggatggcccgcggatccggactacatcggcccatcgcagaagacgagttatcaatcggatccggagcgggaagtgggcccgggccggcccagatccaaattcgcagcggggtgcttcacggggaagaaggcaaaagagctgcggaagaagaccgtggaaacgtcgacgtttcacgacatcatgtaccactccgctattgcgtccaggctcgcgtccgatgtttctaaagggtacgagaaataaatgtttgttttctaattaatgttttctaccctcagactcactcatcgttgaatttcgttttaatttctttcaactatgaactaatggcctattcatgatttgggacacactgtaattaacctatgtgcgtgatttgtctccttatgttctattagtgtggttctctcttccttttaaaaaaaaaaaaaaaaaaa

SEQ ID NO: 9281 - DNA, 1162 bp, Glycine max
tttttttttttttttttttttagaaacaatgattcgcataatttgaaataaatattatctatgtaaactgataaaagaatgcaaggtagcatcctcttagaaagaaagtcaaaatgaagaaattcactaaattacagccaaacaccatgcaaatctcaactccagtctccagtaacagaaagcacacgcatagaataaaaggctcacaaagccttatggtgattttctagagaccaattccatgttctattacaacatcctaatggtaaactatcaagagagagactagccttctcgtatgcactccacaaattccttggccaatacctgcttcactatgcatcgtcacctccagcagctcgggcagaatccaccttttgttcctctccatcttcagggatgtcagaagtccacagggtgagattgtccctcaaaagctgcataattagggtgctgtctttgtaagactcctcgctcagagtatccaactcagaaattgcttcatcaaatgcctgcttagcaaggtgacaggccctttcaggagagttcaaaatttcataataaaagacagagaagttcaaagccaggcccaaacggatgggatgtgtggatgctaactcagcctcggcagtagtggaagccaactgatacgctttcatggaatgatcagcagcctcttttctctcatcaccggacttgaactctgcgaggtaccggtaatagtcccccttcattttgtagaaaaagacactaggttcaccagatgagctagagggaataaggtattcatcaataacagtcatgatatcactgcagatattggacaactcagactccaccttcagcctatactcctttatcctcttcacgctcacatcgttccctttagcttcttctttctgttcaatcgaggaaagaatcctccacgaagccctacgagcacccaccacgttcttgtacccaaccgacagaaggttccgctcctctaccgtcaattccacgtttagcttcgccacattcttcattgcttccaccatttcttcatagcgttcggcttgttcggcgagcttggcgacgtagacgaagttttcacgttccttggtggaggccatggaggatctgctactttctctctcctctcactttctcgctctagaaaaaa

SEQ ID NO: 9282 - DNA, 780 bp, Glycine max
atggcctccaccaaggaacgtgaaaacttcgtctacgtcgccaagctcgccgaacaagccgaacgctatgaagaaatggtggaagcaatgaagaatgtggcgaagctaaacgtggaattgacggtagaggagcggaaccttctgtcggttgggtacaagaacgtggtgggtgctcgtagggcttcgtggaggattctttcctcgattgaacagaaagaagaagctaaagggaacgatgtgagcgtgaagaggataaaggagtataggctgaaggtggagtctgagttgtccaatatctgcagtgatatcatgactgttattgatgaataccttattccctctagctcatctggtgaacctagtgtctttttctacaaaatgaagggggactattaccggtacctcgcagagttcaagtccggtgatgagagaaaagaggctgctgatcattccatgaaagcgtatcagttggcttccactactgccgaggctgagttagcatccacacatcccatccgtttgggcctggctttgaacttctctgtcttttattatgaaattttgaactctcctgaaagggcctgtcaccttgctaagcaggcatttgatgaagcaatctctgagttggatactctgagcgaggagtcttacaaagacagcaccctaattatgcagcttctgagggacaatctcaccctgtggacttctgacatccctgaagatggagcagaggaacaaaaggtggattctgcccgagctgctggaggtgacgatgcatag

SEQ ID NO: 9283 - DNA, 1098 bp, Glycine max
ttttttttttttttttttttttttttttcaaaatgaaaaaattcactgaatcacaggcaaacaacatacaaatctcaactccagtctccatccagtaacaaaaagcacacccataaaataaaaggctcacaaagccctatggtgattttctaaaaaccaactccatgttctattactacatcctaatggtaaattatcaaaaaaaagactagccttctcgtatgacaccacaaattcctagccaatacctatgcattgtcacctccagcagctctggcaaaatccaccttttgttcctcacctccttcttcagggatgtcaaaagtccacagggtgagattgtccctcaaaagctgcataattagggtgctgtctttgtaaaactcctcgctcaaagtatccaactcaaaaatggcttcatcaaatgcctgcttagcaaggtgacaggccctttcaggagagttcaaaatttcataataaaagacagagaagttcaaagccaggcccaaacggatgggatgtgtgggtggtaactcagcctctgcagtagtggaagccgactgatacgccttcatggaacgatcagcagcctcttttctctcatcaccggacttgaactccgcgaggtaccggtaatagtcccccttcattttgtagaaaaagacactaggttcaccagcagagctagagggaataaggtgttcatcaataacagtcatgatatcactgcagatattggacaactcagactccaccttctgcctatactcctttatcctcttcacactcacatcgttccctttagcttcttctttctgttcaatcgacgatagaatcctccacgaagccctacgagcacccaccacgttcttgtaccctaccgacagaaggttccgctcctcgaccgtcaattccacgttcagcttcgccacattcttcattgcttccaccatttcttcatagcgttcggcttgttcggcgagcttggcggtgtagacaaagttttcgcgttccttggtggaggccatggaggatcagctactttctctctcctctcactttctcgctctagaaattttttgtgtgtttgtgcgttcc

SEQ ID NO: 9284 - DNA, 803 bp, Glycine max
ttttttctagagcgagaaagtgagaggagagagaaagtagcagatcctccatggcctccaccaaggaacgtgaaaacttcgtctacgtcgccaagctcgccgaacaagccgaacgctatgaagaaatggtggaagcaatgaagaatgtggcgaagctaaacgtggaattgacggtagaggagcggaaccttctgtcggttgggtacaagaacgtggtgggtgctcgtagggcttcgtggaggattctttcctcgattgaacagaaagaagaagctgaagggaacgatgtgagcgtgaagaggataaaggagtataggctgaaggtggagtctgagttgtccaatatctgcagtgatatcatgactgttattgatgaataccttattccctctagctcatctggtgaacctagtgtctttttctacaaaatgaagggggactattaccggtacctcgcagagttcaagtccggtgatgagagaaaagaggctgctgatcattccatgaaagcgtatcagttggcttccactactgccgaggctgagttagcatccacacatcccatccgtttgggcctggctttgaacttctctgtcttttattatgaaattttgaactctcctgaaagggcctgtcaccttgctaagcacgcatttgatgaagcaatctctgagttggatactctgagcgaggagtcttacaaagacagcaccctaattatgcagcttctgaggacatctcacctgtggactctgacatccctgagtgagagacaaagtggatctgccgagctgctgagtgac

SEQ ID NO: 9285 - DNA, 795 bp, Cicer arietinum
atggcttcttctaaggatcgtgaaaacttcgtctacatcgccaagctcgccgagcaagctgagcgatacgaagagatggtggattcaatgaagagtgttgcaaatctagatgttgaactgactgttgaagaaaggaatttgctttctgttggttataagaatgtgattggtgctcgcagagcatcgtggaggattctgtcttccattgagcaaaaggaagagacaaagggaaacgatgtaaatgcaaaacggattaaggagtataggcataaggttgaatcagagctttcaaacatctgtaatgatgttatgagagtgattgatgaacaccttataccttcagctgcagctggtgaatcaactgtcttttactataagatgaaaggagattattatcgttaccttgcggaatttaagacaggcaatgagaagaaggaggctgctgatcagtcgatgaaagcatatgagtctgctaccactgcagcagaggctgaattacctcccactcatcccattcgattggggttggctttgaatttctcagttttctattatgagatcttaaactcaccagaaagagcttgccatcttgcaaagcaagcttttgatgaagctatttcagagcttgacaccctgaatgaggagtcctacaaagatagtacattgatcatgcaacttctcagggacaacctgactctttggacttctgacatccccgaagatggagaagattctcagaaagtgaatggcactgccaaacttggtggaggtgatgatgcagagtgagtctgatgg

SEQ ID NO: 9286 - DNA, 1363 bp, Vitis vinifera
actccaccattttctctctcaattttcccgagaaaactagagagagaaagtagggatcagtaatggctcgcgagaacttcgtctacatagctaagctcgctgagcaagccgagagatacgatgaaatggtggatgcgatgaagaaagtggcgaagctggatgtggatttgactgtggaagagcggaatttgctttcggttgggtacaagaacgtgatcggagcgcgaagggcttcctggaggatcctatcgtcgatcgagcagaaggaggaggtgagagggaatgagcagaacgcaaagcggatcaaggagtataggcagaaggtggaatctgagctgtcgggtatttgtagcgatattatgactgtgattgatgagcatctgattccggcttctacggctggtgaatccactgttttttactataaaatgaaaggggattattatcggtacctggcggagttcaagaccggcaatgagaggaaagaggcggctgatcagtctcttaaggcataccagacggcttctactactgcagagagcgatttatcccccactcatcccatccgattgggtttggctttaaatttttctgtcttctattatgagattatgaattcacctgaaagggcttgccaccttgcaaagcaagcttttgatgaagctatttcagagttggacacccttagcgaggaatcttacaaagacagcactttaattatgcagctcttaagggataaccttactttgtggacttctgacatccctgaggatggagaagaccagaagatggaaagctctgccaaagctggtggagacgatgagtgaagctgaggagaggagagcctcacagccctttattgtgtgaacagggataaaggatgattcctctaggctctctggtgttttctgaattacagaggatttcaaaattctctcctttgttgtaccttattgttgtctggtattgttcttaatattctgtagatgtcgggacaattatcagagtttcatttgcatccccctagcttttctcctctccgccactctcggacggaaattagaaggattggcgtggttgcttttaggttgctttcatttcatttctttttctttttccctttttttgtatttcctttttctctttttctgcccccctttttttcaaccttaaaatgcagcatagttcaaatgagactcttatgatttggcttgtctccattttttctacttcaatgctcgtcttttcactgcatttgtgggcttacagaacttaaacatgagatctgtaatagatatgagcttctcaattcttggtaggggtgatcactctggttaaaatgatgatttgatgatccgataat

SEQ ID NO: 9287 - DNA, 1358 bp, Glycine max
tttttttttttttttttttccaataaatatcttccagatcaaatattattcagttttgttgataagaaaactatttcttttttcttttctcttttccagtagatacaagcatgggaaaaggaatttcaagtattgaacaacagacccctgcccctaaaaactcagtccaactatcagaggcagtaagctagtaactattggatcagaaaaatgatttattgcagaagtttggttcaaagagaagtaacacatttcttaactatatatccaagattctaccccgaatcatggcctcggctttcctcacctccttcaccggtccgatgatgaaaaccttgtcaggtgggcccttgggacctcccgtgagaatttcggcattgcaagaccgcttaattgacaaaattgttgcccctcttttcccaataacaagtcccatctttccttggggaatatcaagaactgaaagaatttcttcctcgagatcatttccatcagcattcaggttatctactggaattgaaggtagagatggccaatcagcaaaattgttactattcaaacagaaacatcggcaatacaaggcaccatggactgcaagataccataaagaccgctcatttaatttctccatcatttggcgataaatatagagaagaaaacgaacatcatcagcagcagcacggatcatttgttcagataatggtctgtgtgtccaaaacttggggtcctgtcgaagaaggacacgaacttcttccttctcatcatatgatatgccacaataacgtggatctgcgaggaggccaacaaatgaaatgtagtcatctcgcaatctctttcgtccttcttgctcctctataagtgaataagcaatctgggtatccactgcgttgttcaacttgatgccaaactgaaagtataatgcctcactgtcccgtttgcaatcatgaatcacttttgtgatgtaattagactcaagtgcaggcttacacgctatgataagctcctctcccccttcaatcgcatcaaccaagtacacagcatccggaaatgcaagctgcattacgcagagagtgcctttgcgacacaggtcaacgccctcgcagtcaaagccgatgacgagcttggattgaggcgagggttccagaaattcgacgggaagttgcgtcgccgcggtcacgatgtgaatcggaacgcgcgattcatcgtcctccacgcgcttctcactctcaccttggtgagagggatgaagaggaaggtgtgtgagataagatggaggagaaggagaagaagaagccatgtgattgggactgaatgtccaaccacatcacacactttgctcttctaagcttgcgctgccc

SEQ ID NO: 9288 - DNA, 872 bp, Glycine max
gggacattcattcagttcagtctcaatcacatggcttcttcttctccctctcactcatatctcacacatcttcctcttcatccctctcaccaaggtgatagtgagaagcgcgtggaggacgatgaatcgcgcgttccgattcacatcgtgacggcggcgtcgcaacttcccgtcgaatttctggaaccctcgcctcaatcgaagctcgtcatcggctttgactgcgagggcgttgacttgtgccgcaaaggcactctctgcgtaatgcagcttgcgtttccggatgctgtctacctggttgatgcgattgaagggggagaggagcttatcatagcgtgtaagcctgcacttgagtctaattacatcacaaaagtgattcatgattgcaaacgggacagtgaggcattgtactttcagtttggcatcaagttgaacaacgtagtggatacccagattgcttattcacttatagaggagcaagaaggacgaaagagattgcgagatgactacatttcatttgttggcctccttgcagatccacgttattgtggcaaatcatatgatgagaaggaagaagttcgtgtcctccttcgacaggaccccaagttttggagacacagaccattatctgaacaaatggtccgtgctgctgctgatgatgttcgttttcttctctacatttatcaccaaatgatggagaaattaaatgagcggtctttatggtatctcgcagttcgtggtgtcttgtattgccgatgtttctgtttgaacagtaacaattttgctgattggccatctctacctccgattccagataacctgaatgctgatggaagtgatcccaaggaagaaattctttcagtctgatatcc

SEQ ID NO: 9289 - DNA, 1462 bp, Vitis vinifera
aacacgcccctaaatgaaaatacatatgcccaaaagggggttcagaagaaaattggtctgtttggatggtccgatcacatggcttcaccttctccgtctcaacctacatacattcctatgccatcagacccaggtggcaaacccatagatcatgaaggtctcttgccactggtccctatccacattgtcacccttccatctcaacttccaattgaattcctggagccctctcctgaaaggaaattggtcattggttttgattgtgaaggtgttgacctatgtcgccatggaacactttgtatcatgcagattgcttttccagatgctatttatctggttgatgctattcaggggggagagatgcttatgaaagcctgtaagcctgcacttgaatctagttacatcacaaaagttattcacgattgcaaacgagatagcgaggcattgtattttcaatttggcatcaagctgcacaatgttgtggatacccaaattgcctattctctaatagaggagcaggaaggacggaaaagattggtggatgactacatatcatttgttggcctcctagcagatccacgctattgtggtgtatcctatcttgagaagcaagaagttcgtgacctcttaaggcagaaccctgatttttggacgcacagacccttatctgacctgatggtccgggcagctgcagacgatgtacgtttccttctttacatctatcacaagatgatggaaaaattgaatgaacgatccttatggtatcttgctgttcgtggtgcactgtattgccgatgtttctgcatcaatgataatgattatgctgattggccacctctccctcccattccagataacctgattgtagaaggaaatgctccagaggaagaaatcctctcggttcttcatgttccccctggaaaaatgggtcgtgttattggaagacgaggagcttccattttgtcagtcaaggaatcttgcaatgcggagattctcattggaggtgccaagggcccacctgacaaggtgttcatcatcggaccggtgaagcaggtgaggaaagcagaagccatattaaggggacgaatgctggaaatgtattgaggaaaaacttgtagtgcttgtgtcttaaattataacactctaaaaataataaacagaaagacttgacaaatagccagctgtgcaaacttccctgccatcatttactatccatttgtacagaaatgatgaaccagtcaggttgatgagctgctacttcgtatccctgttacctaccattacgtttctattgaaggttgatgacttgaaatctttggaaaacactccaaaccaactctagcataagaggtcttgagccttttggcttactctgaaacttgaaagagaccttcatggatcgatcatcatctacctacctgtaaatccatttggtttcaatataagactgaatttatgcatt

SEQ ID NO: 9290 - DNA, 1419 bp, Arabidopsis thaliana
atccgttggtgaatctggacagtcccctcaaataaaagttgtgagagctgtttcgtcgctttgatcgaaatggcgtcgtcttctccaactcagctagctcacgtcccgattcctccagaaccaggaggaaggtcgccgacacaagaagctaatgagccaccagttccgatttacattgtgacggatccgtttcaacttcctgctgatttcctaaacccttctcctgaaaagaaattggttatcggttttgactgtgagggtgttgacctctgccgacatgggaaactttgtatcatgcagattgcattctctaatgcaatatacttggttgatgtcatcgaaggtggagaggtgattatgaaagcgtgtaagcctgcactcgagtctaattacatcacgaaagttattcacgattgcaagcgtgacagtgaggctctatacttccagtttgggataagattgcacaatgttgtggacactcagattgcttattctctgattgaagaacaagaagggcggaggagacctctagatgattacatatcgtttgtttcactccttgctgatccacgttactgcggtatatcctatgaagagaaagaagaagttcgagttctcatgcgccaggacccaaagttttggacatacaggcctatgactgagctcatgatccgcgcagctgctgatgatgtccgcttccttctgtatctctatcacaaaatgatgggaaagctaaatcagcggtcactatggcatcttgcagttcgtggtgctttgtactgtcggtgtctctgctgcatgaatgatgctgattttgctgattggccaaccgttcctccaattccagataacctgaagtcagaagatcaatgtcttgaagaagagatcctgtcagtgcttgatgttccaccaggaaagatgggacgtgtgattggaaggaaaggagcatcgatcctcgccattaaggaagcttgcaacgcggaaattctaattggaggggcaaagggtccacctgataagatatttgtgattggaccggtgagagaagtgcgtaaggcggaggctatactgagaggaagaatgatagactattgaaggaaatgagggtcctttgtaatctgtctcattgcccctataaaaaaaaatactaaaaccctcttaaaacttggaaactccatggttcagtacggacccgagagagtcgtcccctcttcaataaaagttacatcattaacttccgtttatactgtggaacttaccattccatttcccgcaagggacttcatagtttgatgaaacaaaaagaccatatcaagtatggtttattggcaaatgcaagagtagtttatctgattgaccgttaagattgattttatttactttgcgactcaaattgagagtctgaaacccaacggtctt

SEQ ID NO: 9291 - DNA, 1488 bp, Vitis vinifera
aaacgctctataaatacagaggaaaaagcgcgagaaagtagaggcatggcctgagaaagaaccagaccgtgtggggggttttggtctcatggcgtttgcttcaccccatcagacgtacattcctctgccgtctgactcgggtggccaacacccagatcatgcagctcttttatcactagttccaatatatatagttacccatgcatctcagctgccgaaagactttcttgttccatcccctgtaaggcaattggttattggatttgattgtgagggtgttgacctttgtcgtcatggaagtctttgcatcatgcagcttgcctttccagatgctatatatttggttgatgctattcagggaggggagaagctaatgaaagcttgtaagcctgctctagagtccagctatataactaaagttattcatgactgcaaacgagatagtgaggcactgtattttcagtttggcatcaagttgcataatgttgtggattctcagatagcatattctctaatagaggaacaacaaggacgaagaagatcacctgacgactacatttcttttgttggcctccttgcagatccacgctattgtggtatctcctaccttgagaagaaggaagtccgtgtccttctgaaacaggatccaaaattttggacataccggcccttgtcagaattaatggtccgtgctgcagctgatgatgtccgctttctcccatacatctactacaaaatgatggaggaactcaatgaacactccttatggaaacttgcagttcgtggggcgctgtattgtagatgtttctgcgtgaatgacaacgaatatgcagattggccatctcttcccaatatgccagaaaatctaatggtggatggaaaggctcctgaggaggagatactatcagtgctggagattcctcaggggaaaatgggatgtgtgattgggaggaaaggggcttccatcctttccataaaacaatgttgcaaagctgagatccttattggaggagccaagggaccacctgacatggtgtttataattggaccggtgaaggaagtgaggaaggcggaggccattctgagggggaggatatagcagagagctctttgctgaagatggcgctaacttatcccaaaagcatgcatgagtttggcctttctctaagtatttaccatcttatgtaatgaacttaaacccccccacctacccatctttgatgtacaaagatgatgggttagttaataaaacgccatccttgtgccaaaatctctttgttgtttcaaaaccttgctgcccacatcccacattggcctcccagtgagcctggctctcctgggttttcctttagaaggtagagcaaatgcatgggctgcttcttgaggtgctcggctttgaataacggtattagtcccggcccctgggcgcatctgggttgttgatagagatgacaaagtttgatataattagccaatacgattcaagat

SEQ ID NO: 9292 - DNA, 1249 bp, Solanum tuberosum
cttggatgctccgatcacatggcgttactcaacaaactttgcctcctgaccctggtgaaaaaatccaaggggaagaggcacaattttctacagtgccaatccatgttgtcactaatccatctgaactacctgttgaattcttggaaccttctgctgagacacaactggtgattggttttgattgtgagggtgttgatctttgtcgccatgggactctctgtattatgcagcttgcgtttccggacgcaatatatttggttgatgctgttcaaggtggggaggctgttgtccaagcttgtaagcctgcactcgagtctaactacatcacaaaagttattcatgattgcaaacgagatagtgaggcattgtattttcagtttggcataaagttgcacaatgttgtggatacacagattgcatattctttgatcaatgaacaagaaggacatgcacgggtcccagattgtcacatatcatttgttggtctacttgctgacccacgttattgtggagtatcttatgatgagaaagaagaagtcagagttcttctaagacaggaccccaagtattggacatataggccattgtctgaacagatgatccgtgctgctgcagatgacgtccgatttcttctccatatataccataagatggtgcaaaagctgaatgacaagtccttatggaacctagctgtccgtggtgccctctattgtcgctgtttctgcatcaatgacaatcattttgcagactggccgcctctacctccaattccagaaaatattgttgctgacggaagtatccctgaggaagaagttttgtctgttgttgatgttcccccggggaaaatgggacgtgttattggcagaaggggagcttctatattgtcgataaagcagtcatgcgatgctgagatattcataggaggtgctaaaggtcctcctgataaggttttcatcattggaccagaaaagcaagccagaaaagcccaagccattctaatggggaaactgctagatttctgatcagggagttcttgcaggacttatattgtatctttagatcaagaaaaagaaaaggcaatacataaacagaccctcattgtatcataaataagaagtttggtgttggctacaatgtaaaacttgatttgcttcaccagtgacattgtttcagctactggactgaaaataatgagggaatgggaaggatgataagcaatttcaaaaaaaaaaaaaaaaaaaaaaaaaaa

SEQ ID NO: 9293 - DNA, 868 bp, Glycine max
ggataccaaaaacacattctctctctctctctctgtaaatactaaaaaagaaaagaagaaaaacaaataaacagtgatggaaattgaggcaagcaggccggtggtggcaaagaaggtatggaacatggtacgcgtgttgttcttcatgctgagaaagggcatagccaagagcaaaataatggtggagttccatctcatgctcaaacgtgggaaacttgcacttaacaacctcatcctcaaccatcactactacaacatgcagacctccttcttcacatgccgatcccaccaccacagcaccttcatctccccaagcgactacgagttcagctgcagcaacagccctgccatcctcaccaaacgcaccaaccgcttttccaccaaatccctctcctcagttcagaaggttctggagatcctcaacaacgaaaacaatgttaattctccctttcctggcttcggaaagagccctgcttctgtcagacagctaagagtcaccgactcacccttccctctcaaggacgaagaggatagccaagtcgacgtggcagccgaagaattcattaagaacttctataaggacctcaacttgcaaaaaaaaatggcatatcttgactccccctatcatatttcctggaacagatgatccatcaatattactactgttttcaacttcagtattccagggagaactttgtgcccgcattcgacttaaaatctcacatgaaccaaaccttctgcatatttttggctgctatatatatatcatcaaagttgcatgatcatatttgcacgctgacatggatgactactcaagtcacgtgaccgacttgttgctttcgttttatgcagcagcttctttgttttt

SEQ ID NO: 9294 - DNA, 872 bp, Glycine max; identical to SEQ ID NO: 9288

SEQ ID NO: 9295 - DNA, 1358 bp, Glycine max; identical to SEQ ID NO: 9287

SEQ ID NO: 9296 - DNA, 1422 bp, Arabidopsis thaliana
atccgttggtgaatctggacagtcccctcaaataaaagttgtgagagctgtttcgtcgctttgatcgaaatggcgtcgtcttctccaactcagctagctcacgtcccgattcctccagaaccaggaggaaggtcgccgacacaagaagctaatgagccaccagttccgatttacattgtgacggatccgtttcaacttcctgctgatttcctaaacccttctcctgaaaagaaattggttatcggttttgactgtgagggtgttgacctctgccgacatgggaaactttgtatcatgcagattgcattctctaatgcaatatacttggttgatgtcatcgaaggtggagaggtgattatgaaagcgtgtaagcctgcactcgagtctaattacatcacgaaagttattcacgattgcaagcgtgacagtgaggctctatacttccagtttgggataagattgcacaatgttgtggacactcagattgcttattctctgattgaagaacaagaagggcggaggagacctctagatgattacatatcgtttgtttcactccttgctgatccacgttactgcggtatatcctatgaagagaaagaagaagttcgagttctcatgcgccaggacccaaagttttggacatacaggcctatgactgagctcatgatccgcgcagctgctgatgatgtccgcttccttctgtatctctatcacaaaatgatgggaaagctaaatcagcggtcactatggcatcttgcagttcgtggtgctttgtactgtcggtgtctctgctgcatgaatgatgctgattttgctgattggccaaccgttcctccaattccagataacctgaagtcagaagatcaatgtcttgaagaagagatcctgtcagtgcttgatgttccaccaggaaagatgggacgtgtgattggaaggaaaggagcatcgatcctcgccattaaggaagcttgcaacagcgcggaaattctaattggaggggcaaagggtccacctgataagatatttgtgattggaccggtgagagaagtgcgtaaggcggaggctatactgagaggaagaatgatagactattgaaggaaatgagggtcctttgtaatctgtctcattgcccctataaaaaaaaatactaaaaccctcttaaaacttggaaactccatggttcagtacggacccgagagagtcgtcccctcttcaataaaagttacatcattaacttccgtttatactgtggaacttaccattccatttcccgcaagggacttcatagtttgatgaaacaaaaagaccatatcaagtatggtttattggcaaatgcaagagtagtttatctgattgaccgttaagattgattttatttactttgcgactcaaattgagagtctgaaacccaacggtctt

SEQ ID NO: 9297 - DNA, 1511 bp, Glycine max
gggctttgtgtgagatctgaagaagagaggtatggcaaaaagggtcttcttgtacaaggatttggttccttttggggccatggtgaccatggaatgcctcaacgtagccttgaatactctgttcaaagcagctaccttgagagggatgagttaccatgtctttgttgtttatgcttatgctgttgctgctattgttctcattcctggaccctttatctcccaaaggtgcagatcaagagtgcttcctccgctcagtttccccctactacgcaaaattggtcttctcgggctaatagggtgtgcttctcagatcgtgggatacacaggcatcagtttcagttcccccactctctcctcggcgataagcaacttggtgcccgcttttacttttttgcttgccatcattttcaggatggaaaaggtgattgtaagaaatacaacttgtcaagccaaggtattgggtaccatagtatcaataactggagcattcgtagtgaccttctacaaaggaccaccaatcatcattgttcatacaccttccttgtcacttcatcaaccaattaacactctgaattcggtagatcgaagttgggcaattggtggccttctactgacagcagagtatattctggttccattatggtacattgtacaggtgcaaatcatgaaggtgtaccccaatgaactaactgtgatcttcttttacaatttatgtgtaagcatcatggctgcaattgtagctatatttacagagacaaatgcaggagcttggaaaataggactagatacagcattggcttcaatagtttgctctggaatttttggttcatttgtgaacaacgcagttcacacatgggtactacgtataaagggtcctgtctatgtggcaatgttcaagccactctcaattgccatagctgttgccttgggagtcatgttcctgggtgatacactccaccttggaagtctagtgggagccacagtaatatcgatcggattttatacagtaatgtggggaaaagcaaccgaagagaatgtggacgaagatgtccctggccagcaatcaccaccaaccacagagaatgttcctctcttgcaaagctataaaactgatacagctgaaaagaaaatgcatggaagtgtataaatgacaaacaaaactgttgataaatcttaacattattgaaattacacgaatagcaaagcaaatacatggttttgttttcgcccaagctaaccctgtaacgccaatagcaattagcaaagtaggtacccacgcctttagagtgtagaggacatcatatgtaagaaatagttcaagggttcaactgatctcctttcgccaaggaacataaacgaatctttatacaaattagggagcaacctatctacaagtttgtgtacgaacactcacagatgaaaacggagcaacttcgttatctgtcttcccttttcctgtctcttgtaacaagtcatccatattatgatttaaaaaaaaaaaaaaaaaaaaa

SEQ ID NO: 9298 - DNA, 755 bp, Glycine max
ggaggtcaacatggaagtcctcagcagccacagtccctcttcgaacgaccccttcgatttcaatcgtgcaaggatttccccctatctcagcgctccttcttctcccaagcgttttggccaattttattacctaagcgccccctcaagcccttctaaagattttgatcttgcggctcacgatgatgatgccttcgcctttttcgttactggggaatccaagagccctcgatccgcggcagagcttttcgacggcggcaaaatcaagccgctgagcgaggatgattcctcggagtctgctaaaagcccacttctccctgccaaacgatcttccatagcccaaggcaagaaggccattcgcgaagccttctcgacgagaaagaagaaagaagagggagatttaagtgaagaagaacaagagacacgagggagagataggactgcgagttctagtagggtcacgcgttctctctctccttgtaacagaatatctcactacacgtgggacgaggaacgcaaccaatcgcagagcaacaaagccgactcgctttctaagacttccaggagatggaggctcactgactttttgctgttccgcagcgcctccgaaggaagaggttccagcaaggaccccttgagaaagttccccactttctacaagaagcccgaagacccaaaagcttccaacccaggcccaaagactaggagaaaggaacccctctccgcgcatgaattgcactacgccagaaagaaagcgg

SEQ ID NO: 9299 - DNA, 762 bp, Phaseolus vulgaris var. nanus
atgggcagaaaattcttcgtcggtggaaactggaaatgcaatggaaccactgaggaggtgaagaagattgttactactctgaatgaagctaaagtccctggagaagatgttgtggaagttgttgtgagtccaccttttgtgttcattcctactgtaaaaactttactgcgccctgatttccatgtcgcggcacagaactgttgggttcgcaaaggtggtgcttatactggagaagttagtgctgaaatgcttgttaatttgggagttccttgggttatcattggtcactctgaacggaggcagatattacaagaaacaaatgagtttgtgggagataaagttgcatatgcactttcacaaggtctgaaagttattgcttgcattggagagactcttgaacagcgtgaagctggtacaacagcagctgttgttgccgagcaaacaaaagcaattgcagctaaagtatcaaactgggacaatgttgttttggcctacgagccagtttgggccatcggaacaggaaaggttgcaactcctgctcaggctcaagaggttcatgttgatttgaggaaatgggttcatgataatgtgagtgccgaagttgctgcatctgtaagaattatctatggaggttctgtaaatggaggaaactgcaaagaattggcaggacaggccgatgttgatggatttttggttggtggtgcctccctcaaggcggagttcgtggacatcataaactctgccaccgtgaagaagaattga

SEQ ID NO: 9300 - DNA, 1042 bp, Glycine max
atgggcagaaagttcttcgttggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctgatttccatgtctcggcccaaaattgttgggttcgcaaaggtggtgcttatactggagaggttagtgctgaaatgcttgttaatttgggaattccttgggttattattggtcactctgaacggaggcagcttttgaatgaatcaaatgagtttgtgggagataaagttgcctatgcacttcaacaaggtctgaaagttatagcatgcattggggaaactcttgaacagcgtgaagctggtacaacaacggctgttgttgctgagcaaacaaaagcaattgcagctaaaatatcaaattgggacaatgtcgttttggcctatgagccagtttgggccattggaacaggaaaggttgcaactcctgctcaggctcaagaggttcatgctgatttaaggaaatgggttcatgacaatgtgagtgctgaagttgctgcatctgtaagaattatctatggaggctctgtaaatggaggaaactgcaaagaattggcagcacagcccgatgttgatggatttttggttggtggtgcatccctcaaggcggaatttgtggacatcataaacgctgccactgtgaagaagaattgaaattcgtagttaggaactgatataatgctgcctttcaagctgcttcggaaattgctgtttttgagttttggatctgtgctttgtggccaatgttttgaactctgtttagtactgaataaacacgctttcctttgagatttcatccataggcgatcaattggattttgattaaatttttgaatgcaaaaatagtgtaactaccataacatttggtgggtaaataatgttgaacgcctagttgactgtacataaaaaaaaaaaaaaaaaaaaaaaaaaaaaa

SEQ ID NO: 9301 - DNA, 1108 bp, Glycine max
ggcacgagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctgatttccatgtctcggcccaaaattgttgggttcgcaaaggtggtgcttatactggagaggttagtgctgaaatgcttgttaatttgggaattccttgggttattattggtcactctgaacggaggcagcttttgaatgaattaaatgagtttgtgggagataaagttgcctatgcacttcaacaaggtctgaaagttatagcatgcattggggaaactcttgaacagcgtgaagctggtacaacaacggctgttgttgctgagcaaacaaaagcaattgcagctaaaatatcaaattgggacaatgtcgttttggcctatgagccagtttgggccattggaacaggaaaggttgcaactcctgctcaggctcaagaggttcatgctgatttaaggaaatgggttcatgacaatgtgagtgctgaagttgctgcatctgtaagaattatctatggaggctctgtaaatggaggaaactgcaaagaattggcagcacagcccgatgttgatggatttttggttggtggtgcatccctcaaggcggaatttgtggacatcataaacgctgctactgtgaagaagaattgaaattcgtagttaggaactgataatgctgcctttcaagctgcttcggaaattgctgtttttgagttttggttctgtgctttgtggccaatgtattgaactctgtttagtacctgaataaacatgcttttctttgatctcatccataggcgatcaattggattttgattaaatttctgattgcaaaaatagtgtaactaccataacatttggtgggtaaaaaaaaaaaaaaaaaaaaaaaaaaaaaaaaaaaaaaaaaaaaaaaaaaaaaaaaaaaaa

SEQ ID NO: 9302 - DNA, 1107 bp, Glycine max
tttttttttttttttttcttttttttaagtacagtcaactaggcgttcaacattatttacccaccaaatgttatggtagctacactatttttgcattcagaaatttaatcaaaatccaattgatcgcctatggatgagatctcaaaggaaagcgtgtttattcagtactaaacagagttcaaaacattggccacaaagcacagatccaaaactcaaaaacagcaatttccgaagcagcttgaaaggcagcattatatcagttcctaactacgaatttcaattcttcttcacagtggcagcatttatgatgtccacgaactccggcttcagggaggcaccaccaaccaaaaatccatcaacatcgggctgtgcggccaattctttgcagtttcctccatttacagaacctccatagataattcttacagatgcagcaacttcagcactcacattgtcatgaacccatttcctcaaatcagcatggacctcttgagcctgagcaggagtagcaacctttcctgttccaatggcccaaactggctcgtaggccaaaacgacattgtcccaatttgatattttagctgcaattgcttttgtttgctcagaaacaacagcccttgtaccagcttcacgctgttcgagagtctccccaatgcatgcaataacttttagaccttgttgaagtgcataggcaactttatctcccacaaactcatttgattcatttaaaagctgcctccgttcagagtgaccaataataacccaaggaattcccgaattaacaagcatttcagcactaacctcaccggtataagcaccacctttgcgaacccaacagttttgtgccgaaacatggaaatcagggcgcagcaaactttttacaacaggaaggaacacaaaaggagggctcacaacaacttctacgacatcttctccagggactttagcctcattcaaagtagtaacaatcttctttacctcctcagtggtcccattgcatttccagttgccaccaacgaagaattttctgcccatgattttgttttggtttcgattgaaacgagagaaagtgaagaagcagacagagaaacccttgttcaacaatcc

SEQ ID NO: 9303 - DNA, 1108 bp, Vitis vinifera
ctcaactctctgctttatctgtcggtgggctgtggacctgtggtttcggtatttcatcgttagcggtttgaaaaatggggagaaagtttttcatcggcggcaactggaaatgcaatggaacagttgaggaggtgaagaagattgttactgttttgaatgaggctgaagttccgtccgaagacattgtggaggttgtggtaagtcctccatttgtgtttcttcctttggtaaaaagtttattaaggtctgatttccaagttgcggcacaaaactgttggattcggagaggaggtgctttcactggtgagatcagtgctgagatgcttgtcaatttgggcattccttgggttattcttggtcattctgaaagaagaagtcttttagctgaatcaaatgagtttgttggagataaagttgcatatgcactttcccaaggcttgaaagtgattgcttgtgttggggagactcttgagcagcgagaatcgggatctacaatggctgttgttgctgcacaaactaaagcgattgcagaaaaagtgtcaagctgggataatattgttttggcttatgaacctgtttgggccattggcactggaaaggttgcaacccctgctcaggcacaggaagtccattgtgaattgaggaaatggcttcatgataatgctggagatgaagttgctgcatcaactagaattatttacggaggttctgtaaatggagcaaactgcaaagaattgacaacgcaactagatgtggatggttttttggttggtggagcttccttaaagccggagttcatcgacatcatcaagtctgccactgtaaagaagagtgcttaaagtctggacggtccctctactgtccttcaaaaatgctggctgagcaacttaagctgtaattttgtagtcttggtgtcctggaactagaggttagctggacgtctcccagtattataatcttccctttttcatgtctgttgaggtgaggacccatctttgttttcaactcaaataaagatcggacacgagtctgcttcttttttgtggaaccgtatcataacatcttaaaaatcttataataaaaccagactattattgccacaaataaa

SEQ ID NO: 9304 - DNA, 1096 bp, Gossypium hirsutum
ggcacgaggttcgagctttgttgcgactttaaactgagctttgctgaattttcgtgatcgtcgagaaagaaaattatgggaaggaaattcttcgttggcggcaattggaaatgcaatggaaccactgaggaagtgaataagattgtgagtactttgaatgctggagaggtgccttctcaggatgttgttgaggttgtggttagccctccatttgtgttccttcctttggtcaaaacttcactgagacccgatttccatgtcgctgcacaaaattgttgggtcaagaaaggaggtgctttcactggtgaagttagtgcagagatgcttgtcaatttgagcattccttgggttattattggtcattctgagaggagacttattttgaaggagtcaaatgagttcgttgcggataaggttgcttatgcacttgctcaaggcttgaaggtgatagcttgtattggggaaacacttgagcaacgtgaagcaggatctactgtggcggttgttgctgaacaaactaaagcaattgcagcaaaaatatcaaactggactgatgtcgttttggcatatgagcctgtgtgggctattggaaccgggaaggttgctactccagctcaagctcaggaagtacattgtgagttgaggaaatggcttcaggctaatgttagtcccgaagttgctgcatcaacccggattatttatggagggtccgtcactgctgcaaactgcaaggaactagcagctcagcctgatgttgatggtttcttggtcggtggagcttcacttaagccggagttcattgatatcataaaatctgctgaggtgaagaagaatgcctaaggttttcggttggaagctttgagagtacttgcagtagctgttgcttgggaatggaaggtttaggatctgttgcataataagagttttataaagaaaataaaatactaattttcaaggaataattcatgatttgattcacaccagtaccttaaactggattttctgtactattaacatgttttactgtttcccgagaaatgcatttttcatttcaataaaaaaaaaaaaaaaaaaaaaaaaaaaaaaaaaaaaaaaa

SEQ ID NO: 9305 - DNA, 955 bp, Solanum tuberosum
cacacacacccttctacttcttctcaacccaactcaaagaaaacaatggccagaaagttcttcgtcggcggcaactggaaatgcaatggaaccgtggaggaagtgaaaaaaattgtgaccacattgagtgaagcggaagttccatctgaggatgttgttgaggttgtcattagtcctccatttgtatttcttcccttggtcaaaaccttattgcgtcgtgatttctccattgctgcacaaaactgttgggtaaggaaaggaggtgcgtttactggcgaggttagtgctgagatgctggtcaatttgggcattccctgggtcatccttggtcactctgagagaaggcttttattgaatgaatcaaatgacttcgtggctgataaagttgcatatgcactttcgcaaggcctaaaagtgattgcctgtgttggggagactcttgagcagcgagaatctggatctacaatggctgtagttgcagcgcaaacaaaagcaattgcagaacaagtcatgcactggtccaatgttgttttggcttatgaaccagtatgggccattggaacaggaaaggttgctactccagctcaagctcaagaagttcattttgaattaaggaaatggcttcatgtgaatgttggtgcagaagttgctgcttcaactagaatcatctatggtggctctgtgaatggagctaactgcaaagagttggcagcacaacctgatgtagatggttttttggttggtggtgcttcactaaagcctgaatttattgatatcatcaagtccgcgactgtgaaaacaactgctaagtcggaataagtgttgctacaaggaaccatcttttctcagaatcccttgtatgtttgttgtaaatcagcttcaataatacatgttaggcacaaggattttatttaaaataaagaaaggttatctttgcaaaaaaaaaaaaaaaaaa

SEQ ID NO: 9306 - DNA, 624 bp, Glycine max
ggactcgcagttgtattgttgaacaagggtttctctgtctgcttcttcactttctctcgtttcaatcgaaaccaaaacaaaatcatgggcagaaaattcttcgttggtggcaactggaaatgcaatgggaccactgaggaggtaaagaagattgttactactttgaatgaggctaaagtccttggagaagatgtcgtagaagttgttgtgagccctccttttgtgttccttcctgttgtaaaaagtttgctgcgccctgatttccatgtttcggcacaaaactgttgggttcgcaaaggtggtgcttataccggtgaggttagtgctgaaatgcttgttaatttgggaattccttgggttattattggtcactctgaacggaggcagcttttaaatgaatcaaatgagtttgtgggagataaagttgcctatgcacttcaacaaggtctaaaagttattgcatgcattggggagactctcgaacagcgtgaagctggtacaacaacggctgttgtttctgagcaaacaaaagcaattgcagctaaaatatcaaattgggacaatgtcgttttggcctacgagccagtttgggccattggaacaggaaaggttgctactcctgct

SEQ ID NO: 9307 - DNA, 1042 bp, Glycine max; identical to SEQ ID NO: 9300

SEQ ID NO: 9308 - DNA, 762 bp, Phaseolus vulgaris var. nanus; identical to SEQ ID NO: 9299

SEQ ID NO: 9309 - DNA, 1365 bp, Vitis vinifera
ttgtccataaattttattattttcaagagactcccacaaaatccatagatatcagcgtagtgaagcagctgttaagacttttttttctgcttcgttgtttggcttcgtgattatcgtcagagatgggcagaaaattcttcgtcggcggcaactggaaatgcaatggaaccggggaagaggtcaagaagatagtgtctactcttaatgcaggcgaagtgccgtcaggggatgttgttgaggttgtcgtgagccctccatttgtgtttcttccattggtgaaaagcaccttgaggcctgattttcatgttgcggcacaaaattgttgggtcaagaagggaggtgctttcaccggtgagattagtgctgagatgcttgtcaatttgggcataccatgggtcattattggtcattctgaaagaagacttctgttgaatgaatcaaatgagtttgtgggagagaaagttgcctatgcactttctaaaggccttaaggtgatagcttgtgttggagagactcttgagcagcgagaatctggatcaactatggaagttgttgctgcacaaacaaaagcaattgcagataaggtatcaaattgggctaatgttgtcttagcctatgagcctgtgtgggctattggaactgggaaggttgctactccagctcaggctcaagaagtacattctgaattgaggaactggtttcaagcaaacgccagtcctgaggttgctgcaacaatccgaattatctatggaggttccgtcagtggtgcaaactgcaaggaattggcagccaaacctgatgttgacggctttttggttggtggagcttctctaaagcctgagtttattgacattatcaagtccgccgaggtgaagaaaaattgctaagcttggtacgacgaatgagtagctgagtgagactttgaagctgtgggttcaaaagctaaagagtccttttgataaatatttgaaaaatactctttttgagggaataagttatgcgttttgtttcttgaccagtggctcagaactggatatgttgtgtgaattgtttaataatctaacaaacacgcccttgagttcagtagcttgacttgtctaaatttgtggtgtcatgtcttgttcattttttggaggaagtggttaatactagagtaagtagaggaaagaaggattttcctttgggtttacattatggtaatctgtcacagcttaagggggttcactctcctcaaccaggagaacgaggaaggaatgaatctccaataaagaggtagcacatgcttttccatcttttccaaggatatggttctacctcttcctacacccaattagattaattccacgtatgtgtatcgtcatatgt

SEQ ID NO: 9310 - DNA, 1157 bp, Phaseolus vulgaris
tctcattaccaaggtgtttatccggtgaaatgcaaccaggaccgattcgtggtagaggacatcgtcaaattcggttcgcccttccggttcggtctggaggcaggttccaaaccggaactccttctggctatgagctgtttgtgcaaaggcaaccctgacgcgttgttgatatgtaacggcttcaaagacgcggagtacatttctctggccctggtcgccaacaagctcgccctcaacaccgtgattgttctggagcaagaggaggaggttgatttaatcattgaattgagtaagaagctttgcattaagcctgtgattgggctgcgtgcgaagctccgaaccaagcattctggccattttggtgggtacttcaggcgagaaagcaagtttggtctgaccaccgctcagattctgagggttgtgaaaaagctggacctcgctggcatgctggattgcttgcaactgctgcattttcatattggttctcagattccctcgacagcgttgcttgcagatggcgtgggagaggctgcacagatttattgtgaactggttcggctcggggcgaacatgcgggtcatcgatattggaggtggactgggcattgattacgacggttccaagtcgtgtgactctgatatatcagtcgggtatagtctggaggagtatgcttccgcggttgtgcacgcgattcagtgtgtgtgcgatcgaaggtccgttaagaaccctgttatctgtagcgagagtggaagggccattgtgtctcatcagtcgatcttggtttttgaggcggtcggaacgagcactaccgtcggcggagtctcttcggcattttctgccccatatgtggctggggatttgtcggaggactatcgttttctgtcggaggcggcgtttggaggggactatgaaagctgtttggcgtacacggaggagctgaaggagcggtgtgtggagcagttcaaacagggggcggtgtgtatggaacagctggcagcggtggatgggttgtgtgagttggttaggaaggcagttggggctggggaacctgttcggagataccatgtgaacctgtctgttttcacttccattcctgatgcgtggggcattgaacaggtgtttccgatcatccccattcaccgtttggacgagaagcc

SEQ ID NO: 9311 - DNA, 1211 bp, Prunus persica
taccagggtgtatatccggtgaaatgcaaccaggaccggttcgttgtggaggacattgtccggttcggctcgccgttccggttcggattggaagctgggtcgaagccggagcttctcttggccatgagctgcttgtgcaaaggtaacccagaagcccttctcatctgcaatggattcaaagacttcgagtacatctctctggctctgtttgctcgcaagctcgccttaaacacagtgattgttcttgagcaagaggaagagctcgatgtggttatcgatttgagcaagaagctaggtgttcgacccgtgattggggcccgagccaagctcaaaaccaagcattcgggtcatttcgggtcgacttcgggcgagaaagggaagttcgggctcactaccactcagattttacgggttgttaagaaacttgatcaattgggtctgcttgattgctttcagttgttgcatttccatattgggtctcagatcccttcgactgctctgctcgccgatggcgtatccgaagctgctcagatctactgtgaattggtccgcctcggtgcccacatgaagttcatagacattggaggcggtctgggtatcgattacgatggatccaaatccagtgactctgagatttcagtcagctatagcctcgaagagtatgctgccgctgttgtccgagcagtcctgaacgtttgtgaccggaagtcggtgaagcacccggtgatttgcagcgaaagtggccgagccctcgtgtctcaccactcggttatgatatttgaggccatttcttccagcgcctgtgatgatgttcctcccatgtctgcgtttgcgcttcagtatttcatcgaggggctcacagaggaagctcgtgccgattaccgaaacctctcggctgcggcaatcagaggtgagtatgaggcttgcttgacatatgctgatcagttgaaacaacgctgtattgatcagttcaaagaagggtctctgggcattgagcaattagccactgttgatgggctttgtgatatggtttcgaaagcaatcggggcatctgaccctgtccgtacgtaccatgtgaatctctcggtttttacttcaattccagacttctggggcattgggcagacgttcccaatagtcccgattcaccgcctcgatcagcggccggcggtgagggggatattgtcggacttaacatgtgacagcgacgg

SEQ ID NO: 9312 - DNA, 1444 bp, Glycine max
gggtaggaaactacattggttttacgacacgacttgaatcacaaactaattttatctgaaatatctctttcatagaacggagaaagacacgatgcaggaagcgacgaaggtgataataatcggtgccggaacttctggtatcgccaccgccggttgcttaacgaagcaatcaataccttacataatgctcgagagagaagactgtttcgcttcgctgtggcagaaatacacctacgatcgtctccaccttcatttgaggaagcaagtttgcgagttaccgcacttaccgtttcccaagtcttaccctcactacgtgcctcggaagcagttcatagactacttgggaaactacgttaaccactttgagatcaagcctctgtaccagcgtgcagtggagttggtggagtatgatggatggaaagggatttggagagtgaaggctcagaatagaagatctggtgagcttgaggaatacgctggaaagtacctggtcgtggccagtggcgaaaccgccgagcctcgtctgcctcagattcaaggcttggagagtttcaatggaaaagtgattcactcaactgcctacaaaaacgggaacgagtttaagaataaacatgttctggttgtcggatctggcaattccggcatggagattgcgctagacttgtccaattttggtgccaaaccttccatcattgttcgcagcccggttcattttctttcgagggatatgatgtattatgcgtcgcttatgctgaattacttgtcgctgagtacggtggagaaggtgttggtgatggttagcaaggttgtgtatggagatctgagtgagtatgggataccgtatccgagtgaggggcctttcaccatgaagatgaagtatgccaagttcccaatcatcgatgtaggaactgtcaagaaaattaaatctcgagagatacaggtgttgccagctgaaataaagagtataagaggtaatgaagttttgttccaggatggcaaatcgtacacattcgactcaattgttttctgtacaggcttcaagagatcaactcaaaagtggcttaaggggggtgatgatcttctaaatgaggatggctttccaaaaaacagtttcccaaatcattggaaaggtcgaaatggtttgtattgtgttgggctgtcaagaaggggtttctttggagctaacatggatgcccaattagtagcaaatgatattgcctcgttaattcctcaagaagaaagagaaggaatttgtgtcatgtaatgatctattatctattattggttgcagaaacagtatgtacatgacactttcttcttttggggatatgaattaagtatgttgttttaaattacttgttgtgattctcgtaatgtgatattattatggtaagaaattcatatataattttgtttcaataataaattttttactattgtagaa

SEQ ID NO: 9313 - DNA, 1842 bp, Glycine max
atgggagaatccaagtttgtgtccttggcatttctactggtttgtttagtggtccaaagggtgtggtcacatggatatcatcctctttcaaaagttgctgttcataaggcaacagtatcacttcttgaccttgcttacatcaaagcatctccagcagttcttggactacaagagcaaactgctgaatgggtaactctggagtacagttctccaattccatcaattggtgattggattggagtattctctcctgcaaactttagtgcttccacatgtccaaaagaaaaccgtagagtctacccaccactattgtgttctgcacccattaagtatcaatatgcaaattactcaagtcccctctacaaagaaactggaaaagggtttctgaagcttctgctgattaaccagagatcagatttctcatttgcactattttctggtggcttgtcaaacccaaagctagtagcagtatcagataaaatagcttttgccaatccaaatgcaccgctttaccctcgcctggcactaggaaagtcatggaatgagatgactgtaacatggacaagtggatatgggatcaatgatgctgaaccttttgttcaatggggtccaaaagaaggggatcgtatgcattcacctgctgagacactgactttcactcgtgatagcatgtgtggtgcaccagcaagaacagtgggatggcgtgaccctggatacatacacaccagtcatctgaaagaactgtggcccaacaaaatatatgagtacaggataggacacaaattaaacaatgttacatatatctggagtggaaactatcagttcaccgcacctccttgtcctggacaaaagtccttacaacgtgtagtcatatttggagatatgggaaagggggaagttgatggttccaatgaatacaacaatttccagcatggctcaattaacactactcagcagcttatccaggacttggaagacattgacattgttttccatattggagatatatgttatgcaaatggataccttcctcagtgggaccaattcacagcacaggtggagccaattgcatcagctgtgccttacatgatcgcaagtgggaaccatgagcgagattggcctggaacaggatccttttatgagaacatggattctgggggagaatgtggtgtgttggcacagactatgttctacacccctgcttctaacagggctaagctttggtattcaattgactatggcatgttccgcttctgtattgctgacactgaacatgattggagagaaggcacagaacaatacaagttcattgagcattgtttggcatcagttgacagacaaaaacagccatggataattttccttgcacatcgcgtacttggatattcttcttgtatctgttatgcagaagagggatcatttgctgaaccaatggggagagagagttttcaaaagctctggcagaaatacaaggtggacattgccatctatggccatgtgcacaattatgagaggacatgccccatatatcagaatatctgcactaatgaagagaaacaccactataagggaagaaccttaaatgggaccatacatgttgtagctggtggtggtggagcaagcctttcagcatttacttccctcaaaaccaaatggagcatctttaaagactatgactatgggtttgtaaaactaactgcttttgatcattcaaatttgttgtttgagtacaagaagagcagagatggaaaggtttatgactccttcaaaatatcacgggattatagagacatcttggcctgcaccatggatagttgcccaagtataacaatggcatcttga

SEQ ID NO: 9314 - DNA, 2120 bp, Lupinus luteus
atcagaaacatgctgaaacagaaaactaaaatgggtgattccaagtttgtcttcttgggatatctactggtgtgttcagtgctgcaattggtgtggtcacatggagatcatcctctgtcaaaagtttctattcatagggcaagcttatcccttcttgaccttgctcacatcaaagtttctccacccattcttgggctacaaggtcaaactgcagaatgggtaaccctggagtatagttctccaattccatcaattgatgattggatcggtgtattctctccctcaaatttcagtgcttccgcgtgcccagcggaaaaccgcagggtttatccaccgcttttgtgttctgcacccattaagtatcaatatgcaaattactcaaatcctcagtacagtgcaactggaaaagggattctgaagcttcagctgattaatcagagatcagatttctcatttgcaatgttttctggtggcttgtcaaatccaaaggtagtagcaatatcaaacaaaatatcttttgcaaatccaaatgcaccagtttaccctcgcctggcaatgggaaagctgtggaatgagatgactgtaacatggacaagtggatatgggatcaatgaagccgatcctttggttcaatggggtccaaaaggaggggatcacatacattcccctgctggaacactgactttcactaaggacagcttgtgtggtgcaccagcaagaacagtgggatggcgtgatcctggatttatacacaccagttatctgaaagaactctggcccaatagaatatatgagtacaagataggacacagattaaacaacgggacatatatttggagtcaaaactatcaatttagagcagctccttttcctgggcagaagtctttacaacgtgtagccatatttggtgacatgggaaaggacgaagttgatgggtccaatgaatacaacaatttccagcgtggctcacttaacactacccagcagcttatccaagacttagaaaacattgacatggttttccatattggagacataagctatgcaaatggatacctttctcagtgggatcaatttacagcacaggttgagccaattgcatctgcagtgccttacatgattgcaagtgggagccatgaacgagactggcctgggacaggatccttttacgagaacatggattctggtggagaatgtggtgtattggcacagattatgttctacgtccctgcttcgaacagggctaagttctggtatccgattgactatggcatgtttcgcttccgcattgctgacactgaacatgattggagagagggaacagaacaatacaagttcattgagcattgtttagcatcggttgacagacagaaacagccgtggctaatatttctcgcacatcgggtacttggttactcttcttgtatctgttatgctgaagagggatcatttgcggaaccaatggggagagagagccttcaaaagctctggcagaaatacaaggttgatattgccatctatggccacgtgcacaattatgagaggacatgccctatataccagaatatctgcactagtgaagagaaacaccactataagggaaccttaaatgggaccatacatattgttgctggtggtgcaggggcaagcctttcaacatttacttccctcaaaaccaaatggagtatctttaaagactatgatcatgggtttgtaaaattaacagcatttgatcattcaaacttgttgtttgagtacaagaagagcagagatggaaaggtttatgactccttcaaaatatcacgggactatagggacatcttggcttgcaccgtggatagctgcccaagaacaacactggcatcttgactgatgaaatggcgaaagcttcaacgcatctacgcatgttttaaggtgttgatgcagtgcgtagattatcttccacaacagaaagatgtgtgtatatggcagcaagccttgttagttgtcacattgatcctatgaccaaattggcttttctatgatgcattatcatgttacagatgctgatgttgatgctggaaatactttcttataaatagaataggaaggagaaatacaaagatgcaaaaaaaaaaaaa

SEQ ID NO: 9315 - DNA, 2096 bp, Lupinus luteus
tctgaaaagatgatggttgagatggagaaatcaagaatggtatttttgtatttgcttcttgtggcaacttttcaacaagcagtttcagatgatactcaacccctctcaaaagttgctattcataagacagtatttgctattgatgaacatgcttatatcaaagccactcctaatgtccttggcttcgagggacattataccgaatgggttacgctgcaatatagtaataacaaaccatcaatagatgactggattggagtattttctcctgcaaacttcagtgcttctacctgccctggagaaaacaaaatgacaaaccctccatttttgtgttctgcgccaatcaagtttcagtatgcaaatttctccagtcacagttacaaagatacaggaaaaggttcactgaaacttcagttgattaatcagagatccgacttctcatttgctcttttcacgggtggcttaactaatccaaagctcattgcagtgtcaaacaaagtttcattcgtcaatccgaatgctccggtgtatccacgattagcacaagggaaaacatgggatgaaattactgtaacgtggacaagtggatatgatatcaatgatgctgagccttttgttgaatggggcccgaaagaaggaaaccttgtaaaaactccggctgggacgttgacttttgatcgcaacacaatgtgtggtgcaccagcaaggacggttggatggcgtgaccctggatacatccacaccagttttctaaaggaattgtggcccaacagagagtacacatacaagctcggtcatagattatttaatggtacaacaatttggagtaaagaatatcactttaaagcatctccatatcctggtcaaagttcagtgcaacgtgtagtgatatttggtgatatgggaaaggcagaagccgatggatccaatgagtataacaattttcagcccggctcactcaatactactaagcagattattcaagacttagaggacatagatatagtcttccacatcggtgacttgtgctatgctaatggatatatttcacagtgggaccaatttactgcacagattgagccaattgcatcaactgtaccctatatgacagcaagtggcaaccatgagcgtgactggccaggaactggatccttttatgggaacttggactcgggtggtgaatgcggtgtaccggctcagactatgttctttgttcctgctgagaacagggaaaaattctggtactccacggactatggcatgttcagattctgcatagctcacacagaacttgattggagaaaaggaacagagcaatatgaattcattgaaaagtgcctagcatcagttgacaggcaaaaacagccatggctgatatttcttgcacatagagtacttggttattcttctgcagggttctatgtgcaagaaggctcttttgaagaaccaatgggaagagaggaccttcaacatctctggcaaaaatataaggtggacatagccatgtacggacatgtccataactacgaaagaacatgcccaatataccagaatgtgtgcaccaataaagagaagcataattacaaaggcaacttgaatggaacaatacatgtagtagttggaggaggaggagcatcccttgctgaatttgctcccataaacacaacatggagtatctttaaagaccatgactttggatttgtgaaacttacagcatttgatcattcaaatctgttgcttgagtacaggaagagtagtgatggacaagtttatgactctttcactatatcaagggattacagagacatcttggcttgttctgttgatagttgtccaactacaacattggcatcttgatctaatgaagaaaaaactgttgattttattatataatgatattgatgactgttattttcaaccaacttgatgcttagagacaactatagttgtttttaaggttgttcttatttgaataagaatatttttactttattctccacacaaaaattgggcatgaatacaaaagtgtgtgggaggttgtgggagacaaataagaatacgagtagttgcaataaaaaaaaaaaaaaaaaaaaaaa

SEQ ID NO: 9316 - DNA, 2082 bp, Arabidopsis thaliana
aaagtttcaatctttgagtttctccgaaagattcaaagcaaaaccaagttagttataatgtcctcactctgtttcttttaatccaattgctagtctttttgcatctttcttgtgcccgctcgaattgtttcagtcttagaagacatgagagaatcgttagttgcaatcttggtgactgttatatcagttcttggagcaattcaccaagtgaaatctcatgaagaccaacctttatcaggaattgctgtccataagattacatttggtctcaatgaaaaagcttatgtcaaagcatctccaacagttcttggatctaacggtcaacatagtgaattagtattggtccaatatagttctccgaaaccatctgatgatgattggattggagtgttttctcctgcagatttcaatgcttcgacttgtccaggagataacaaaatggtccaaccacctcgactttgttcagcgcctgtcaagtttcaatatgcaaactttagtaatccaagatacaccaatactggaactggttccttgaagcttcaactgattaaccaaagatcggatttctccttcgcgctcttttctggcggtttgttgaatcccaagcttgtggcaatctcaaacaaagtagcttttgagaatccaaacgcaccagtttatccgcggttggcgctaggcaaagaatgggatgaaatgacagtgacatggactagtggttatggactcaacctagctgaacctgttgttgagtggggcgttaaaggaggagaacgtaaactgtcacctgctggaacattgaccttcgcgcgtaacagcatgtgcggtgctcctgcaaggaccgtgggatggcgtgatcccggatacatacacacagcttttctcaaagagttatggccaaactccaagtatacctacagagttggtcatagattgtccaatggtgcattgatctggagtaaagaatatcaattcaaatcttctcctttcccgggacaaaactctgtccaacaagttgtaatctttggagacatgggaaaggcagaagtcgatggctcaagcgagtacaatgatttccaacgcgcttctctcaacaccacaaagcaacttattaaagatctaaagaagactgatgcagttttccacattggagatatttgttatgcaaatggatacctttctcaatgggaccaattcatagcacagattgagcctattgcttccactgttccatatatgattgcaagcggaaaccatgagcgtgtctggcccaactcaggatcgttttacgagggtttagactctggaggagaatgtggtgttccagctgagacaatgttctatgttcctgctcaaaacagagctaaggtctggtactcgagtgactacggaatgtttaggttctgtgtggctgacacagaacatgactggagagaaggaacagagcaatacaatttcattgaacactgcttagcatcagtcgacaggcaaaagcagccatggctgatattcctcgctcaccgtgttctcggttattcttccacatatttttatgcggaagaaggctcttttgccgaacctatgggaagagaaagtcttcagaagttatggcagaagtacaaagtcgacattgctatctatggccatgcacataactacgagagaacatgcccggtttaccagagtgtatgcacgagtcatgagaagagtaactacaaagctccattgaatggaaccattcacattgttgctggaggtggaggagctggtcttgctgaattctctgatcttcaaccgaattggagtctgttcagagactatgattacggattccttaaacttacagccattgatcactcaaaccttctgtttgagtacaagaagagcagtgacggacgagtccacgattctttcacgatatcaaaagattacagagacatcttggcttgtgcggttgatagttgtcctgcaactacacttgcttcataaaaacttttcaactgcttgagctcttctgtactcacttgttccctcttcattgttaaactgttataatgtttacacatcaattatacgcactttgca

SEQ ID NO: 9317 - DNA, 1833 bp, Glycine max
atgaagcctcaactcaacgttgctgttgctcttgttattagcttgctctgtattcagcactcattttgtgatgaaccttctgatactggactaaacaagtggaaatgtagatgctcttcattacaagggaacaagatatactctcttgctaattgttccaagtcatgtgattgccatccagatgctgaagagaatgcatccatatggacatgcgaatgtgatccaaacgggtttcctaaagtgacagcagatgtccataaccttagttgttttaatgcctgcaattgcacctggggaactgtcaggaagccactaggttcaaagaaacaaatttcgagcaagattgtagtaatttttctatcaatatgtgttatatgcacaactattgcatttcttacctcagttgtatgtcatgtctaccgaagggacaaaggtcctattcaatcaccaatgatctcatcagataaagaaacaagttacagtagtaccaccaacttgattagtcataggacttcttcagtgccagaaacaaaagttgctataacttctcctattagtcatattacaggatgctttcagaaggccgctttgttgtttgggagccaaagagaaacctttcatggaaatattattcaattttcgtttgctgaactggaaaatgccactgaaaacttctcaacttccaacctaattggactaggtggaagtagttacgtttaccgtggtcggctgaaagatggtagtaatgtggcagtcaagagaataaaagatcaaagagggcctgaggcagactctgaattttttacagagattgaactattgtctagacttcatcattgccatctggtgccattggtgggatactgctcagaattaaaaggaaaaaatgttcaaaggctgctagtatttgaatacatgactaatggaaatttgagggacaggttagatggaattcttggacaaaaaatggattggtcaactcgcgttacaattgcattaggagctgcaaggggcttggagtatcttcatgaagctgctgctccaagaattctgcacagagatgtcaaatcaacaaacattcttctggataaaaattggcaagcaaaaataactgatcttggtatggctaaaaacttgagagctgatgaccaccctagttgttctgattctccagcaagaatgcaaggaacatttggttattttgcacctgagtatgcaattgttgggagagcctctcttgagtcagatgtcttcagttttggagtggttcttcttgagcttataagtggtcggcaacccatccataaatctgcaggcaaagaagaaagtcttgttatatgggcaacttcacgcttacaggatagtaggcgagcattaacggagttggctgatccacaattgaacgggaacttccctgaagaagagctgcagataatggcatacttagcaaaggagtgcttgctgttggatcctgacactcgaccaactatgagtgaagttgttcaaattctttcaagtatttccccgggaaaatctagaaggagaagaaccattccagtgagcccttttcaggaaccagaggacttggagaagcaaagacaagccccaccaagtatatttccatctcgtaatttattgccactagatattgaccataatcttcatgtggggaacgaaaataaagatgtacatacagtttcatctgagcatctgaagagtttgatgctctttacttcaaaaggtgagagctggcatgcatcagatgaagaaatggtagatttaaccgagcctcgttttgaatcattttatatgataaacgacaatttcccttga

SEQ ID NO: 9318 - DNA, 1839 bp, Glycine max
atgaagccgcagctcaaaattgctcttgctttagttgttagcttgctttggattcagcaatcattttgtgatgaaacttctgatacatctagcttaaacaagtggaggtgtagatgttctttccaagggaaccaaagctattctcttgctaattgttcaaaatcatgtgattgcttctcagattctgaagagagtgcatctgtatggacatgcgtatgtgattccaatggatttccccaagtggcagcagatggtcatagctccaattgctttaatgcttgcaactgcacttggggaaccttcagcaggccgggaggttcaaagaagcatgtttccagcaagattgttgtagttatactattaatatgtgttatatgcacgaccatggcatttcttgtctcacttatatgccatgtctaccgaaaggacagatgtacaattcactcaccaatattctcaatggataaggaaaccagtagtggtagtaccaccaacttaattagtcatagatcagggacttcttcagtgccagaaacaaaatatgcaatgaattctccaatttatcatatcacaggttgttttcagaaagcctctttcttttttgggaacccaaaagaaacttatcatgggaatatttttccattttcgttagccgaactggaaaatgcaacagaaaacttttcatcttccaacctaattggggtaggtggaagtagttatgtataccttggtaggctgaaagatggtagcaatgtggcagttaaacgactaaaagatcaaggagggtcagaagcagactccgcatttttcaaggagattgaactattagctagacttcaccattgtcatttggttcctttgcttggatactgctcggagttaaaaggaaaacatgttcagaggttactagtatttgactacatggcaaatggaaatttgagggactgtttagatggagtttctggaaaacatgtcgattgggcgactcgtgttatgattgcaataggagctgcaaggggcttggagtatctccatgaagcagctgctccaagaattcttcatagagatgtcaaatcaactaacattcttctggatgaaaattggcaagcaaaaataactgatcttggcatggctaaaaacttgagatctgatgacctccccagctgttcaaattctccagcaagaatgcagggaacatttggctattttgcacctgagtatgccattgttggtagagcttctcttgagtcagatgtcttcagttttggggtggttcttcttgaacttatcagtggtcgccatcccatccataaatctactggcaaagaagaaagccttgttatatgggctactcctcgcttacaggatagtaggcgagtaataagggagttggttgatccacaattgaaaggaaacttcccagaagaagaggtgcagataatggcatacttagcgaaggagtgtttgctgctggatcctgacactcgaccaaccatgagcgaggtcgttcagattcttttgagtatttccccgggaaaatctaggaggagaagaaacattccagccagcctctttcaggaaccagaggatgcagaaaagcaaaggcaatctacacccagtaaatttccaacacatagttcattgccaatatataatgatcacaatctttctgttgagaacaaaaacaaagcagaagatgcagtttcagctgagaatatggagagtttgatcctcttgacttcgaaatctgacggttctcgtgcatcagaagaggaaatagtagacctgactgagcctaggtttgaatcattttgcatcacaaatggcaatgccccatga

SEQ ID NO: 9319 - DNA, 778 bp, Glycine max
ggagagaaggtggtaccgccttcaattctctctctccatttctcatcctcatcatcttattatacctcttccatctccataacatccacttgtgaaaaaaacccattaatatatatcacacacacatgtatctctgagctccaatccaatccaagaccacaccttgtcgcgtcggacgaaccttggtgtctgtctttttttttttgtttcattagtttctccgaagagatgcggaagggcagaggaggaggagcctcggcggcggcggcggcggcggtgaacggatccgttttaaaggagcctcggtaccggggcgtgcggaagagaccgtgggggagattcgcggcggagatcagagacccgttgaagaaagccagggtttggttgggaaccttcgattctgccgaggatgctgcacgtgcctacgacaccgccgctcggaatctccgaggttccaaggccaaaaccaatttccctctctcacctttttgctatcaacaccccaccacggatcctttcttctacgctggtttccacgaccaccaaaacaacagcaacaacaacaacgacaaccttaacaaccctcaaagaccaacttcaagtggcatgagtagcaccgttgagtccttcagtgggccccgccctcccaccacaaccacaaccaccacgacgccgtttttgaccactacgcggagatacccgcgcactccccctcttgtccccgaagactgccacagtgactgcgactcttcctctccgtcgtgacgacagcgacgac

SEQ ID NO: 9320 - DNA, 669 bp, Glycine max
atggcgccgagggatcataagacaagcaacgctaaggctaacggtaacggtaacagcggggtgaaggaggtgcattttcgtggagtgagaaagaggccgtgggggagatacgccgcggagatcagagatcccggcaagaagagccgcgtctggctcggaaccttcgacacggcggaggaggcagcgcgtgcctacgacgccgcagcacgagagtttcgcggccctaaggccaagacaaacttccctctccctttggaaaatgttaagaactcgagccccagccagagcagcaccgtcgagtcctccagccgcgaccgcgacgtcgccgccgattcctcgcctctagacctcaacctcgcccctgccgccgccgcatccgctcgattccccttccagcaccagttcccggtttttaccggcgcggtgcctgcggcaaatcaggttttgtacttcgacgctgtcctacgcgccggcatggccggtccacgtggctttgcgtttggctacaatcatcatcccgttgcggcgagtgagttccacgcgacgacgagcgactcggactcttcctctgttatcgatctaaaccataatgaaggcgaggttaaggggaacggttctagaatcttcgatctggaccttaaccatcctcctccgcatgagatcgcttga

SEQ ID NO: 9321 - DNA, 1142 bp, Glycine max
ttttttttttttttttttttgagcaatataagattaagattagtccataaaaaaggagaacaataatcaaggacaatcctgtttagcacaagcactcaataaaatctaaaacaatactaatctagagaatttcaacgaaggtttatctaacagtcacctgggtggctctgttcctaatttctaagaccttcttgtgagagtttgagtgcagtgatgctacaaaagtggggctagatgcaggccggtattcagcaaagagccggccagaccggtatcgaaccccacaggcattgcatagggtcttaggacccattggtccttctctccattgcggcgtctttgtcacctcacaatgcaagcattttctgggtgcaactgactcctgtgatgaggacctcttcatctcaattttgttagtcggcaggggaatatcctttttcctctgcttctttttgaacttgcataataattccccagaaggctgtgtttgtatatctgatttggagaaatccatcctctgaaatttttgaaaagccggtgaagtaaggataaaaggaatagagtaaagcaggctgatgtttgagagacgccggcgtttggtacggggacactttgttgggatgacaggtaactcaaagttggagttctcaaccgagggagaactactactgctttcaaaaacagaaactgggctgttggtttggaattggagcaaatcttttccttttaaagagactttctggacaggaatagttttgccatatgcaggtctgacagtcttcgctagagaagcagagaaactcttgctgccgagtttcgcattctcattccgagtttgtccacagaatgcagaggattgttgtagtgggaaaactccaagtggtggtggtgggtcttcaaggagtttgagctgagcatcccaatcttgttcttccacagcatcagtttccacatcctcaaagtcaaggggcaaatccaaaagctccatgtccatcacatcatcaagactctcatccgacagaccattgaaattgttgtcaaaaaaccaacagtccttcatacttgcaacacggtgacagagagagagagagagagaggacaggtgaaaatggcgcaactcgaaactcaactcaaagagagcc

SEQ ID NO: 9322 - DNA, 799 bp, Glycine max
ggagtgacataaccttctatgcttgaagacggtggattagaacctcaacaagagaaagagactcgtcagagaatatgatccttgcggtgctgtttgccaacgctgagggcaatatcctcatcgaacgttttcatggagttcctgcagaggagcgtctgcactggcgttcattcttagtcaaactaggagctgataatcttaagggtgtcaaaaacgaagagctcctagttgcttgccacaaatcggtttatattgtatacacagtgcttggcgatgtcagcatctatgtcgtgggcaaggatgagtatgacgaacttgccttgtccgaagtgatctttgtgataacctcagctgtgaaggatgtatgtgggaagcccccaagtgagcgccttttccttgacaagtatggaagaatttgtctgtgtctggatgaaattgtatggcagggatatttggaaaatacagaaaaggatagaatcaaaagactgataaggttaaagcctccaacagagttttgaatgaaaagtccagagccagtcatagttcaatgattagtctgagtcctgtgggtcatagtgtggcattttgtaaacggatatgggcaagcaaccgaagattgtgctggatgtatgcgctctgcaatgattgtattaaaatacttgcattaaaatcttcttaaattttagcacttgtattttgtagcattcccaaactctgcattatttcatttgcgtattttgcacctcttttatcccttactattgtttgctatggcaatcatgtttccattttatgtttc

SEQ ID NO: 9323 - DNA, 817 bp, Glycine max
ggaggcttgaaaacggtgttggttagaacctcaacaagaagaaagagactcttcagtgaatatggtccttgcggtgctgtttgccaacgctgagggcaatatactcatcgaacgttttcatggagttcctgcagaggagcgcctgcactggcgttcattcttagtcaaactaggagctgataatcttaagggtgtcaaaaacgaagagctcctagttgcttgccacaagtcagtttatattgtatacacggtgcttggcgatgtcagcatctatgttgtgggcaaggacgaatatgatgaacttgccttgtcagaagtgatctttgtgataacctcagctgtgaaggatgtatgtgggaagctcccaagtgagcgccttttccttgacaagtatggaagaatttgcctgtgtttggatgaaattgtatggcagggatatttggaaaatacagaaaaggatagaatcaaaagactgataaggttaaagcctccaacagagttttgattgagtagtccagagcaagtcatagttcaatgactggtctgagtcctgtgggtcatagtgtggcatcctgtagttggatatgggcaagcaaccgaagattgtgctggatgtatgcgctttgcaacgattgtattaaaatcttctcaatttttaacacttgtattttgtagcattcccaaattctgtcttataatttgcttattttgcccctcttttatcccttgctattgtttgctatggcaatcatgttttcattttattgaatgagaattttcatgcttggttaaagaaatcgtatttcatttcagtacg

SEQ ID NO: 9324 - DNA, 691 bp, Cicer arietinum
cgaacgccgaaggcaatatcctcatcgaacgttttcatggagttcctgccgaggagcgcttacattggcgttcttttttggtcaaactaggagctgataatcttaaaggtgtaaaaaatgaagaactcctagttgcttgccacaagtcagtttatatcgtatacacaatacttggagatgtcagtatatacgttgtggggaaggatgagtacgacgaacttgctttgtcggaggtgatctttacaataacctcagctgtaaaggatgtatgtggaaagcctccaactgagcgccgtttccttgataagtatggaagaatttgcttgtgcttggatgaaattgtatggaagggatatttggaaaatacagaaaaagaaagaatcaagagactgataaggttgaagcctcctaccgagttctgaatgagaaatcctgacagtcattagaatcagcagtttgaggtgtgttgagcatcttgtgagttataatggcaagacaccgaggtcaggcaaacctctgaatatgataattttttctctagtatggtgcatgtgaggattttgctcggccaataaatatttgtataacattctcaaattatacatcttttatgttgtaacatctatattgttgattttattctacctttaccttgtagaatgtgtgtttttcaaaaaaaaaaaaaaaaaaa

SEQ ID NO: 9325 - DNA, 831 bp, Vitis vinifera
aatttctggaagccttgcatcgaagtgggagagagagagagagaagacagagagggagggagatccagagagagcaaacatgctgctggcggttctattcgccaactcagaaggcaacatattagtcgaacgatttagtggagtcccagcagaagaacggctgcattggagatctttcttggttaaattgggagcggacaatcttaaaggcgtaaaaaatgaggagcttcttgttgcttgccacaaatcagtgtatatcgtttacacggtgctcggagatgtcagcatctatgttgtgggcaaggatgagtatgatgaacttgctttggcagaagtgatctttgttataatctcatctgtgaaagatgtctgtgggaagcctccaactgagcgcctcttccttgataagtacggaaagatatgcttatgtctggacgaaattgtttggaagggaatgctggagaatgctgacaaagacagaatcaggagactgacaaggttgaaacctccaactgagttctgaacttgaagcatctgcccatcatcggcctataagaatagcgcatagcaaggcatctgtctttcatgcttgacagctagattttattttcagacctgaattctggatgatcttttgtcatttgtcttcatgagtggagacaagtttgtgtgatccactgtgtgctgattaatgaggaaatacaatgactcatattgttttgtgatttggaattccaacagaatgtagacatttcgtatgtggttttttaaagattattagaaacaatttcactgaaactgctcagaatatgaaattctagttttgtctcc

SEQ ID NO: 9326 - DNA, 734 bp, Arabidopsis thaliana
gagaatgttttgaggtagagaggagaagtagaaatcgataaaggcgaagaaggaatcgcaaggaaggaagaaacttgagaggaagatcatgatcctagctgtgttgttcgccaattccgttgggaatgttttaatcgaaaggttcaatggagtaccagctgaggaacggctccactggcgatctttcttggttaagttgggagcagataatctcaaaggcgttaaaaatgaggagcttctcgttgcttgccacaagtcggtttatatcgtgtacacaatgctaggggatgttagcatcttccttgttggcaaagacgagtatgatgaacttgctttggcagaaaccatctatatcataacagcggctgtgaaagacgtatgtggaaagccgcctacagagcgagtgtttttggataaatatggaaggatttgcttgtgccttgatgaaatcgtttggaacggacttctggagaacaccgacaaagacaggatcaagcgactcatcagattgaaacctccttctgaagtttgatatgctccaaccaaccacacattcttcttctactcattttaagagctttctcattctccaccgattgttgtttgttgaatcacttctctatatcacatattcaactatcaactactgctgttgttcgatcagtccatcttgtagtgttgttttttaaatcttcagtttttagtgttacataacaaagaacaaatttctatcc

SEQ ID NO: 9327 - DNA, 758 bp, Hordeum vulgare subsp. vulgare
gagcacaccccgcacacacgctcgcgcggcagagagatcggaggggatcgccggggtaggtggtgatcggccggagcgggagggggaagatgattctcgccgtgctcttcgccaactccgagggcaacatcctcatcgagaggttccatggcgtcccggcggaggagcggctgcactggcgctccttcctcgtcaagctcggcgccgagaacctcaagggggccaagtccgaggagctcctcgtcgcttcccacaagtcggtctccattgtgtataccatgatcggggacgtctgcctgtacattgttggcaaggatgaatatgatgagcttgctctgtcggaggtgatcttcgctgttacgtcggcggtgaaggatgtgtgtgcgaaaccacccaccgagcgcctcttcctcgacaagtacgggaggatctgtctgtgccttgacgagatcgtttggcaggggttgctggagaacacggagaaggacagggtccggaggctgatcaggctcaagcccccagtggagccatgattttttccacttgatggatcctgtgtatgtatccctttgttagagcctggacggtactagtcacaaacacttgacacttgtgtggttcttctgtccatggatgtactgtgtacaacaagttgatgggaatgtaatttggtatatggtttcaatttcatttcatggcatgtgatttgtaatgacccagtaaaattcacacccataaattgtcctgctcatgcacac

SEQ ID NO: 9328 - DNA, 1034 bp, Glycine max
ggctctcgttacggttggagagaaatgaaggcgctaggcgttgttggtggtagtggtgccccagtgccagtggtatgttctagtgttaggaaccaccggtttcgcgtttccttctcttcttctccgtcatcgggacccaaaacggtggaacaagtgggaattgctgctccgaaatctgaatacaagcccggtgtgtttgatgacttgtttcttaatttgttccgcaacaaattggtacaggaggtgggttgggactcggagaaacctggatatgatggactaattgaagttgccaatcgtctaatgatgaagggcactaccaatactgccaccgtggaagcagcggtacgaatattgagatctctattccctccatatcttttggagctctataaaatgctcatagttcccataggaggaggcaaaattgcagctatgatggttgcaagggttactgtactgacttgtcaatggctcatgggcccctgcaaactcaattctgtagacctaccagatggaatctcatgcagtagtggggtgtatgtggaaagatgcaagtatctggaggagagcaagtgtgttggtatttgcaccaacacctgtaaatttccgacacagagcttctttaaggatcatatgggggttccactacttatggagccgaactttggcgattacagctgtcagttcaaatttggagttcttccgccactggatgatacgatcgtgaaggacccttgcttggaagcatgtccaaatgcttcccaacgacgaacggttgccagaaatattgatataactgcgtgcccaaagacatgaatatattttttttgggcttggggttttaacagtatttttgtagactttcaagtttgcaaagcctcttgaaaattttggtcccaacctgtacttgaagatggaactccatagcgataactcatctttgaccgagttcagatgaatttattattaatacaattcatccttttttaattaaaaaaaaaaaaaaaaaaaaaaaacaaaaaaaaaaaaaa

SEQ ID NO: 9329 - DNA, 871 bp, Glycine max
ggagaaaatgaaggcgctaggcgctgttggtggtggtggtgccccagtgccagtggtatgttctagtgttcggaaccatcgatttcgcgtttctttctcttcttcttctccgtcgccgggacccaaaacggtggaacaagtgggaattggagctctgaaatctgactacaaacccggtgtgtttgatgacttgtttctcaaattgttccgtaacaaattggtacaggaggtggggtgggactcgaagaaagctggatatgatggactaattgaagttgccaatcgtctaatgatgaagggcactaccaattctgataccgtagaagcagcggtacgaatattgaggtctctgttccctccatatcttttggagctctataaaatgctcatagctcccataggaggaggcaaaattgcagctatgatggttgcaagggttactgtactgacttgtcaatggctcatgggcccctgcaaagtcaattctgtagacctaccagatggaacctcatgcagtagtggggtgtatgtggaaagatgcaagtatctggaggaaagcaaatgtgtgggtatttgcacccacacctgtaagtttccgacacagaccttctttaaggaccatatgggggttccattacttatggagcctaactttgccgattacagctgtcagttcaaatttggagttcttcccccacgggatgatactatcgtgaaaggaaccttgcttggaagcatgtccaaatgcaaaacaacgacgaatggttgccagaatattgatattactgcgtgcccaaagacatgatatatttttcttgggcttggggttttcacatcatttatgtagactttccagtttgcaaatctggtc

SEQ ID NO: 9330 - DNA, 2172 bp, Glycine max
atgggtagcagcagaggacacacgctcatggaggttggacccgacggggttgccgtcatcaccatcgtcaaccctcccgttaattcactttcctttgatgtattgcgcagtttaaaggagagttttgatcaggcgatacagagagatgatgtcaaggcaattgttgttacaggtgcaaagggaaaattttctggaggttttgatatttctgcatttggtggtattcaagaggcaaaagagcgtccaaaacctggttggatatcagtagaaatcatcactgatactattgaagcggctaggaaaccatcagtcgctgccattgatggccttgccttgggtggaggattagaagttgcaatggcatgcaatgctcggttatcaactccaactgctcagctaggcttgcctgaacttcagcttggaataattcctggatttggaggaacacagcgacttcctcgtcttgttggtttgacaaagggacttgagatgatactggcttcaaaaccagttaaagggaaggaagcttttagtttggggcttgttgatggtttggtgtcacctaatgatttggtgaacactgcacgccaatgggcactggatatgttgggccaccgacgaccatggattgctagtctttataagaccgaaaaattagaaccccttggggaagcaagagagattttgaaatttgcacgagctcaggctcgaaagagggctcctaacctccagcatcctttggtttgcattgatgttattgaagcaggaatagtagctggtcctcgtgcaggactttggaaggaagctgaagcatttgaaggacttgtaaggtcagatacttgcaaaagcttagttcacgtattttttgctcaaagaggaacatccaaggtacctggggttacggattgtggtctggctccaagacaagtcaagaaggttgccatcattggtggaggactaatgggctctggaatagcaacagctttaattcttagcaactatccagtcatcttgaaagaagtaaatgagaagttcttagatgctggtatcaataggattaaagcaaacttacagagccgtgtaaagaaaggtaaattgaccaaggaaaattttgaaaagaccatctctcttctcaaaggttcccttgactatgaaagcttcagggatgtggacatggtgatagaggctgttattgagaatatttccttaaagcaacagatattttctgatcttgaaaagtattgtccacctcattgtatacttgcaagtaacacttccacaattgacttgaacctgattggagagaagaccaagactcaagatcgaattgttggtgcccatttcttcagtcctgcacatgttatgccgcttctggaaattgtacgtaccaagcagacctctgcccaagtgatagttgacgtgttagatatttcaaagaagataaagaaaactccagtggtggttggaaactgcacaggatttgctgttaataggatgttcttcccatatacccaagcaggtctcttgcttgttgaacgtggtgcagatgtttatcaaattgatagagtaataaccaaatttggaatgcccatggggcctttcagattgatggacctcgttgggtttggtgtggcaattgctactggcatgcaatttattcagaattttcctgagcgaacatataaatcaatgcttatttcccttctgcaagaagataagagagctggtgaaacaactcacaaagggttttatttgtataatgataaacggaaggctagtcctgatcctgaattgaagaactatattgagaaggctaggagcatttccggtgtctctgttgatcctaagcttgccaagttacaagaaaaggatatcatagagatgatattctttcctgtggtgaatgaggcttgtcgggtccttgatgaaggtatcgcagtcaaagcagcagatcttgatatttctgctatcatgggcatgggttttcccccttacaggggaggcatcatattctgggctgattctcttggatccaagtacatatattcaagattagagaaatggtcagagttgtatggggaattcttcaagccttgtgccaacttggctgcaagagctgccaaaggaattcctctgagtgcctctgtggagcaggggaagtctcgcatgtaa

SEQ ID NO: 9331 - DNA, 2420 bp, Vitis vinifera
caagctcttgcagcagaaagaggctcacagagatttgaggaattgagaaagaagagcaatgggtaggactcccaagggaagaacagtgatggaggttggagctgatggggttgctctcatcacccttatcaaccctcctgtcaattccctctcttttgatgtgctaaacagcttaaaagagagttatgaggaagccttacgtagagatgatgttaaggcaattgttattacaggtgcaaaaggaaagttttctggtggttttgatatcacagcttttggtggaatccaagctggaggtgaagtttcaaagcctggttttgtatcagtagaaattctcaccgacactgtagaagctgcaaggaaaccttcagttgctgctattgatggccttgccttgggtggaggattagaggttgcaatgggctgccatgcacgaatatctactcctaatgctcaactaggccttcctgaacttcagcttggaataattccaggatttggaggaacccagcgacttccacgccttgttggcctctcaaaagcccttgaaatgatgttgatgtcaaagccagttaaaggagtggacgctcatagtttgggccttgtggatgctgtagttgctccagatcagttagtaaagactgctcgccaatgggccctagatattttagagtgtagaagaccatgggttcatagtctttacaagaccgacaagttggagcccctaggggaagcaagggagatactcaagtttgcaagaactcaggcacagaaacaggctccgaatttgaagcacccattactttgcattgatgttattgaagcgggtatagtttctggtcctgttgctggactttggaaggaggctgaggcttttcaagaacttctacactctgacatttgcaagtccttggtccacatcttcttcgctcaacgaggaacctcaaaggttcctgggatcgctgatctgggtttggtaccaagacgaataaacaaagttgctattcttggtggaggattgatgggatctggaattgcaacagcattgatgcttagtaattatcctgtgatcctgaaggaagtaaatgaaaagttcttacaggctgggattggtagagtccgagctaatttgcaaagccgtgtcaagaaaggggcaatgactcaagagaaattcgaaaaaaccttctctcttctcaagggtgtccttgattacgagagctttaaagatgtagacatggtcatagaggcggtcattgagaatgtctctctaaagcaacaaatttttgcggatcttgaaaaattttgcccaccacattgcattcttgcaagtaacacttcgacaattgacttaaacctgattggtgaaaagaccaggtcccatgaccggattgttggagcccatttctttagtcctgctcatgtgatgccactgttggaaattgttcgcactcagagaacatctccccaagtaattgttgatttactagatatcggaaagaagataaagaaaacccctgttgtggttggcaattgcaccggttttgctgtcaacaggatgttttctccttacacacaggctgctcttttgctcgttgaacatggtgcagatgtctatcagattgatagggcaattaccaaatttggaatgccaatgggcccattcagattggttgacttagttggttttggtgtggcaattgcaactggcggacagtttgttcagaattttcctgagcgaacctataaatcaatgctaatcccaatcatgcaagaggataagagagcaggtgaaactactcgcaaagggttctatgtatatgatgataaacgtaaagcaagcccagatcctgaactgaagaagtatgttgaaaaggcaaggggcatttctggtgttgccattgaccctaagctaatgaaattatctgataaagacattgtggagatgatattcttccctgtggtgaatgaggcatgccgagtctatgctgagggtattgcagtcaaagcagcagaccttgacattgctggtgttatgggcatgggtttccctccttacaggggaggaatcatgttctgggccgattctcttggatccaagtacatctattcaaggttggaggcatggtcaaatctgtatggtggcttcttcaagccttgtgcatacttggccgaaagagctgccaagggagctcctctgagttccccactggagcgagcaaaacctcgactgtaagatgaatttgcacccacttgtttcttcttccctggtgttagaaaaaagctggatttgagctaaataatgtacttggatggagagttgattaaggcaggatgattattaacaagtgagaactcaggaaataataattaataatatcttcttaaacgaagttggttacgggttctctctttgcaatgcc

SEQ ID NO: 9332 - DNA, 2178 bp, Capsicum chinense
atgagtagtaatacaaaaggaagaactacgattgatgttggagctgatggagttgctgtcattacaataattaatcctcctgttaattctctagcattagatgtgctgtacagcttgaaagagaactacgagcaggccttaagaagggatgatgtgaaagcaattgttgtgacaggcgcaaatggcaagttctctggtggttttgatatcagtgcctttggtaaactgcagggaggaacagttgaatcaccgaagcctggttttatatcagtggagattctcactgacaccgttgaagctgcaagaaaaccttctgtggcggcaattgatggtctcgctctaggtggaggactagaagttgcaatggcttgtcatgcacgaatttctactcccaatgcacaacttggattaccagaacttcaacttggtgtacttccaggatttggaggtactcagcggctcccccgcctcgtaggtcttgccaagtcccttgaaatgattcttacatcaaagcccgttaaaggagaggaagctgttaatctgggccttgttgatgctgtagttccatcaaaccaattactgggtactgctcgtaagtgggctcttgatattttggagtgcagaaagccttgggttgccagtctccacaaaactgacaagattgagcctcttggtgaggcaagggaaatatttaagttcgcaagagttcaaacgcgcaaacaggctccaaatctccagcatctcttagttgtcattgatgttatcgaagagggtatagtgtctggtccacttgctgggctttggaaggaggctgaagcatttcaagctcttctacattcagacacttgcaaggccttggtcaatgttttctttgctcagcgtgcaaccacaaaggtaccaggggtgactgacttaggattaaaaccccgacgcataaaaaaggtcgcaattcttggaggtggtttaatgggttctggaattgcaactgcactgcttcgtagtggctacccagtgatcttgaaagaagttaatgacaaattcctacaggctgggttgggcagagtaaaagccaatttgcaaagcagtgtcaagaaagggaaaatgagtcaagagaagtttgaaaaaactctctccctactcaagggtgctctggattatgaaggttttagagatgtggacatggtcattgaggctgtcatcgagaatgtatctctaaagcagcaagtatttgcagatcttgagaagtattgcccttcgcattgcatcctagcaagtaacacatctactattgacttgaatttgattggggaaaagaccaaatctcaagatcgtattattggagctcactttttcagtccggctcatgtgatgccattgttggaaatcgtccgcacccaaaagacatcgccccaaattattgtagacttgcttgatgttggcaagaagataaagaaaacccctgtagtagtggggaactgcactggttttgctgtcaacagaatgttctttccttacacccaagctgctcttttgctagttgaacgtggcgcagacgtcttccgcatagataggatcattactaaatttggcatgccaatgggccccttcagattatgtgatcttgttggttttggtgttgcgattgctactggcgggcaatttgtgatgaatttcccggagagaacttacaaatcaatgttgatacctctcatgcaagaagataaaagagctggtgaaactactcggaaagggttttacgtatatgatgacagacgtaaggcaagcccagatccagaaataaagaagtatattgagaaggcaagagaaatgtctggtgttaccattgaccataagatggcaaaactctcggacaaggatatcattgagatgattttcttccctgtggtaaatgaagcctgtagagtgcttgcagaaggcatagcggtcaaatcttctgatcttgacatttctgctattatgggcatgggattccctccttacaggggaggaatcatattctgggcagacactcttggatccaaatacatctgttcaagattggatgagtggtcaagaatgtatggagactttttcaagccttgttcctaccttgctgaaagagccgccaagggggctcctctgagtttaacaacggatccagcaaagtcgcgcttgtaa

SEQ ID NO: 9333 - DNA, 2575 bp, Arabidopsis thaliana
tctctttttcattaattccgaaaattttgactcgcaaaatctcaacgaagctcgaaaatggattcacgaaccaaggggaagacggtgatggaagttggtggcgatggcgttgccgtcataacactcatcaatcctcccgtcaattctctatccttcgacgtgctatacaatctcaaaagtaattacgaggaggccttgagcaggaatgatgttaaagctattgttattactggtgcaaaggggaggttctctggtggctttgatatatctggttttggtgaaatgcagaaggggaatgtcaaagagccaaaggctggttacatttcgattgacatcataaccgacttgcttgaagctgctaggaaaccgtctgtcgctgccattgatggacttgccttgggaggaggattagaacttgctatggcttgtcatgctaggatatcagctcctgctgcacagttaggcttgcctgagctgcaacttggtgttattcctggttttggaggaacgcagcgtctcccgcgtcttgttggtctcaccaaagcccttgaaatgattttgacatctaagccagttaaagctgaggaaggtcattctttgggtcttattgatgctgtggtgccacctgcggagttagtaaccactgctcgtcgctgggcccttgacatagtcgggaggagaaaaccatgggtatctagtgtttccaagactgataagttacctcctcttggagaggcaagggagatactgacgtttgccaaggcacagacactcaagcgtgcccccaatatgaaacaccctttaatgtgccttgacgctattgaagtaggtattgtttctggtccaagggctggtttagaaaaggaagctgaagtcgcctcacaagtggtaaaactggataccaccaaaggcttgatccacgtcttcttttctcagcgaggaactgctaaggttcctggagttactgatcgtgggttggtgccaaggaagattaagaaggtagccataattggaggcgggttgatgggatctggaatagctactgcgttgatcctaagtaactatccagtgattctcaaggaggtaaatgagaaattcctggaggctggaattggcagagttaaagctaatctccagagccgtgtaaggaagggaagcatgtctcaggaaaagtttgagaaaaccatgtctctccttaagggttctcttgattatgaaagctttagagatgtggacatggtcattgaggctgttattgagaatatatctttgaagcaacaaatttttgctgatctggagaaatactgtcctcagcattgtatccttgctagcaacacatcgaccattgacttgaacaaaattggggagcggaccaagtctcaggatcgaattgttggagcacattttttcagtccagcacatatcatgccgctacttgaaatagttcggaccaatcatacctctgcccaagtaattgttgacctgttagatgttgggaagaagattaagaaaacaccagttgtggtgggaaactgcacagggtttgcagtgaataggatgttcttcccttacacacaggcagctatgttccttgttgagtgtggagcagatccatatctaatcgacagggcaatcagcaagtttggaatgccaatgggtcccttcagactgtgtgacctggttggatttggtgtggcgattgcaaccgcaacgcagtttatcgagaacttctcagaacggacttacaaatcaatgattattccacttatgcaagaggacaagagagctggtgaagccactcgcaaaggtttctatttgtatgatgataagcgcaaggcgaaacctgatcctgagctaaagaaatatatcgaaaaggcaagaagcatatctggagtaaagcttgaccctaagttggcgaatttgtcggagaaggacattattgaaatgacattcttcccagtagtaaacgaggcgtgtagggtttttgctgaaggtatcgctgtcaaagcagcagaccttgacattgctggcataatgggaatgggttttccaccttacagaggaggaatcatgttctgggctgattccatcggatcgaaatacatttactcgaggctggatgagtggtcgaaggcttatggtgaattcttcaagccttgtgcttttttggctgagaggggatctaaaggagttcttttgagcgctcccgtgaaacaagccagctcacggttgtaaggtcagcgtttcagtggaaccatttctccattggtgcatcttctgtgttttctttatgttcacattttacttagccgggaagtgggtatcttttggcctcagaagcttttaaataaagtctcatctcagacatatgaatctgggaggaagtagggattaagttgtagtagcaataagatttgttttatgttgtgctttgtcatacaacaaagttgtcagatacatttgttgttataaagctatatggagtaagttctatgatttaatgataatgttgtcatttgacaaatcagttaaaataaattgtgaatcaatatggaattaagtatggcaggttttg

SEQ ID NO: 9334 - DNA, 601 bp, Glycine max
gggatagaagaagcagaaagagaagcattagcaaaagcaagaagaactagtctaagcagaaatggcctcttcagtgatggcatctgtggccctcaaacctgcccctttcactgttgagaagtcctcagttagaggccttccctccctctcaaggaactcctcttcattcagagttgtggccagtggtggcaagaagatcaagactgacaagccttatggaattaatggtggcatggctttgagggaaggagttgatgcatctggcaggaaaggaaagggaaagggcgtttaccagtttgtagacaaatacggtgctaatgtcgatggttacagtcctatctacgacaccaaggactggtctccaaccggtgatgtctacgctggcggtacgactggcttggctatctgggctgtgactctacttggtcttcttgctggtggtgcacttcttgtctacaacacaagtgctttggcgcaataaactttgcaaatcgatgttttaagctcaaacttagtccatgtaactatctaaaaatgaagaattattcatgaagtactttgtggatacgtgttccttctgttctataaatgtgtggatgcg

SEQ ID NO: 9335 - DNA, 705 bp, Glycine max
ggataccatagaagaagcacaaagagaagcattagcactaggagcagcaacaactagtctcagctgaaatggcctcttcagtgatggcatctgtggccctcaaacctgcccctttcactgttgagaagtcctcagtgagaggccttccctctctctcaaggaactcttcttcattcagagttgtggccagtggcaagaagatcaagactgacaaaccttatggaattaatggtggcatggctttgagggatggaactgatgcatctggcaggaaaggaaagggaaagggtgtttaccagtttgtagacaaatacggtgctaatgtcgatggttacagtcctatctacgacaccaaggactggtctccaaccggtgatgtctacgctggcggtacgactggcttggctatctgggctgtgactctacttggtcttttagctggtggtgctcttcttgtctacaacacaagtgctttggttcaatagactttgcaaatcgatgtttaagttataacatagtccatgtaactatctaaaaatgaagaactattcgtgaagtactttgtggatatgttccttctgttctataaatgagtggatgtgaaaaaaacttttttgttagtaatcatgcttcttcatcaatgtctccaatttgtttctcaatgtgaatctcgtgcatagctagcttgcatttttatgatgatta

SEQ ID NO: 9336 - DNA, 387 bp, Arachis hypogaea
ttaaaacctgcacctttcactgctgagaggtcctcagttagagggatcccatccctttcaagggcatcctcttccttcaaagtcgtggccagtggtggcaagaaaatcaagactgataagccttatggaattaatggaggcatgaacttgagggatggacttgatgcatctggcaggaaaggaaagggaaagggtgtgtaccagtttgtggacaagtacggtgctaatgtcgatggttacagtcctatctacgatcaaaaggattggtctcccactggtgatgtctacactggcggtacgactggcttggctatctgggctgtgactcttgttggccttcttgctggtggtgcacttcttgtctacaacacaagtgctttgtcacaa

SEQ ID NO: 9337 - DNA, 632 bp, Solanum lycopersicum
atggcaagcacagtaatgagctcattaagcctaaagccaactttcactctggagaaaatatcagtgaaagggcttccatcacttactagatcttcttcttccttcaaagttgtggctagtggtgttaagaagcttaagactgacaaaccctatggaattaatggaagcatggccttgagagatggggttgatgcctcaggcaggaagcccaagggaaagggtgtgtaccaatatgttgacaaatatggggctaatgttgatggatacagtcccatctacaacacggatgaatggtctccaagtggtgatgtctatgttggaggtaccactggcttagccatatgggcggtgaccttgcttggcattcttgcaggaggtgctctccttgtctacaacacaagtgctttggcgcaatagatgttatccttgtattgtactattaagtttaagttgtattccatgttatcttttcaaaatatttcttggcatcttcattaatatgtaattgctgtgattttactgtggataatattacatctaatgttgctgttttagggtcttataaatcttttaagtttagccgtgattggattgccaaacagttataagctaatccaatattttgaagtgtt

SEQ ID NO: 9338 - DNA, 414 bp, Jatropha curcas
atggcaacctcagttatggcttcagtgagtctgaaaccatctcctttcagtgtccaaaaatcttcggtgagaggtctcccaaaactctctagaagagctttcaaagttgaggccggtggtgggaagaagatcaagactgataagccttatggaatcggtggtggcatgaacctcagaaatgggcttgatgcttccggaaggaaggctacgggaaagggcgtataccaatatgtcgacaaatatggtgctaacgtggatggatacagccctatctacaatactgatgaatggtctccaactggtgatgtttatgcaggaggcaccacaggattagcaatatgggcagtaaccctgctagggattcttgctggaggtgctcttcttgtgtacaatacaagtgctttggcacagtag

SEQ ID NO: 9339 - DNA, 560 bp, Solanum tuberosum
atggcaagcacagtaatgagctcattgagcctaaagccaactttcactttggagaaaacatcagtgaaagggcttccatcacttgctaggtcttcttctcccttcaaagttgtggctagtggtgtcaagaagcttaagactgacaaaccctatggaattaatggaagcatggccttgagagatgggcttgatgcctcaggcaggaagcccaagggaaagggtgtgtaccaatatgttgacaaatatggagctaatgttgatggatacagtcccatctacaacacagatgagtggtctccaagtggtgatgtctatgttggaggtaccactggcttagccatatgggccgtgaccttggttggcattcttgcaggaggtgctctccttgtctacaacacaagtgctttggcacagtagatgttatccttgtattgtactattttaagttgtattcatgtaatcttttcaaaaatacttcaaaatattttcttggcatcttgattaatatgtaattgctgtgattttactgtggataatattacacctaatgttgctgtttt

SEQ ID NO: 9340 - DNA, 561 bp, Populus trichocarpa x Populus deltoides
tcatagttaagaagaaaaaacgagagattgtgaaaaaaaagagagagagaagagaagcagaagctaagtcagcaatggcagcctcagttatggcttcattgagcctgaaaccatctcctttcacagtagagaaatcttcagtaagaggcctcccaacactttcaaggaggtctttcaagattgaagccagtggtgtcaagaagatcaagactgatacgccttatggaactggtggtggcatgaacctcagggatgggttagatgcatctggaaggaagcccaagggaaagggtgtgtaccaatatgtcgacaaatatggtgctaatgtggatggctacagccctatctacaacactgatgaatggtccccaagtggcgatgtctatgctgggggtaagactggcttgctaatctgggctgttaccctagctggcattcttgctggaggtgcacttcttgtttacagcacaagtgctttggcacagtagacttctgcttttctaatttatagcaatgtatcatatagcctgtcccattcactgtccaaaaaaaaaaaaaaaa

SEQ ID NO: 9341 - DNA, 1548 bp, Medicago truncatula
gaccctaatttcacttcacaaaccctcatttctctacactgcctctcatttctttgaatctttgccgcaaaacccatttcttcctcattcttcactcccttcatcttcatttctcaactgaacatcaaggattgaacaagtgaggcaccatgtcggatgatgaaagggaggagaaggagttggatctcacttcacctgatgttgtaaccaaatacaaaactgcagctgagatcgttaacaaggctctgaagttagttatttcggaatgtaaaccgaaggccaaggttgtcgacatttgcgagaaaggagattcatttattagagagcaaactagtaacgtgtacaagaatgtgaagaagaagatagagagaggtgttgctttcccgacctgtatttctgttaacaacacaatctgccatttctctcctctagccagtgatgagacagtgttggatgaaggcgatatagtcaaaattgatttggcttgtcatatagatgggttcattgctgctgtagctcacactcatgttcttcaggaaggtccggttactggacgggcagcagatgtcattgcggctgcaaacactgctgctgaggttgccttaaggcttgtaaggccaggaaagaagaacaaggatgtatctgatgcaattcaaaaggttgctgctgcctatgattgtaaaattgtggagggtgttctaagccaccaattgaagcagtttgtgattgacggtaacaaggttgtacttagtatctctaatccggatacaagggttgatgatgcagagtttgaggaaaatgaagtttatgcaattgatatagtgacaagtaccggagaaggcaagcctaagttattggatgagaagcagacaactatttataagagggctgttgacaagagttatcacttgaagatgaaagcatctcggttcattttcagtgaaataagccaaaaatttccaatcatgccattttctgctagggctttggaggagaaaagagttcgccttggtttagtggaatgtatgaatcatgagctattgcagccatatcctgttctgcatgaaaagcctggtgattttgttgcacacatcaaattcacggtcttgttaatgccaaatggatcggaccgcgtcacatctcatccactccaagaattgcagcccacaaaaacgatagatgatccagagatcaaggcatggctagccttgggcacaaagacaaagaagaaaggtggcggaaagaagaaaaaaggtaaggaagaggacaaggctgatgagacagcagaagctgagccagtggactcaacaaatgaggccacatctcaggaatgaattgacaccccctcaccctcaatcccaaaaaagaaatgtttttcatttcatttttctgacacccctttcagttttggtacattgttcactaaattatacctttttcgatatgaattttgggtatagtgtttagacatcgattctaatagcagttttcagtctcaaatatcaactaaaaaacagagaaattgttatgcttggaaaaaaaaaaaaa

SEQ ID NO: 9342 - DNA, 1342 bp, Ammopiptanthus mongolicus
gtagttgtacaaagccaccttctttgctaaaacccttcattttattctgattcaactacactgccgcactttcaatcaaacccttcactaagttattggaattcaagaattgaggtaccatgtcggatgatgaaagggaggagaaggagttggatctctcttctcctgaagttgtaaccaaatacaaaaccgcagctgagattgttaacaaggctttgaagttagttatttcagaatgtaagccaaaggccaaaattgtggacctttgcgagaaaggggattcatatattagagagcaaactggtaatgtgtacaagaatgtgaagaggaagattgagaggggtgttgcttttccaacatgcatatcagtaaacaacacagtttgtcatttctctcctctggccagtgatgaaacagtcttggaagaaggtgatatattgaaaattgatatggcttgtcatatagatgggttcattgctgctgtggctcacacacatgttctcgaggaaggtcctgtcacaggacgagccgccgatgtcataacagctgcaaacactgctgctgaagtggccttgaggcttgtaaggccgggaaagaagaacaaggacgtaactgatgcaattcaaaaggttgctgctgcctacgattgtaagattgttgagggtgttcttagccatcaaatgaagcagtttgtgattgatgggaataaggttgtgcttagtgcatctaatccagatacaagggttgatgaagcagagtttgaggagaatgaagtttatgcaattgatatagtaacaagcacaggagaaggcaagcctaagctgttggatgagaagcagacaactatttataagagagctgttgacaagagttatcacttgaagatgaaggcatctaggtttattttcagtgaaattagccaaaactttccaatcatgccattctctgctagggctttggaagagaaaagagctcgtctgggcttagtagaatgtgtaaatcatgagctcttgcagccatatcctgttctgcatgaaaagcctggtgattatgttgcacacattaaattcacagtcttgcttatgccaaatggatcagatcgtgtcacttcttatccactccaggaactgcagcccacaaaaacaatagatgatcctgaaattaaggcatggctagccttgggaacaaagacaaagaagaaaggtggtggaaagaagaagaaaggcaagaagggggaggataaggcagatgagtcagctgaagctgagcccatggactcaactaatggagcaacacctcaagattgacctcccttccctaacaaaaaaaaaaaaaaaaaaaa

SEQ ID NO: 9343 - DNA, 1504 bp, Glycine max
ggagttgcacaggagcaccgtttggctctacaagtctttccttttctatttaattcctaaaatcccattcttcttcgctcattcctctgcactgccatcatccccaacttcctcacaaggttacaaggactaaagagttgtgccaccatgtcggacgatgaaagggaggagaaagagttggacctctcttctgccgaagttgtcaccaaatacaaaaccgctgctgagatcgttaacaaggccttgaagctagttatttcagaatgtaaaccaaaggcgaagattgtggatatttgtgagaaaggggattcatacattagagagcaaactggaaatgtgtacaagaatgtgaagaggaagattgagagaggtgttgctttcccaacatgtttatcaatcaacaacgttgtctgccatttctctccactagccagtgatgaggccgtgttggaagaaggtgatatattgaaaattgatatggcatgccatatagatgggttcattgctgtggtagctcacacccatgttcttcaggaaggtcctgttactggaagggcagctgatgtcattgctgctgctaatactgctgctgaggtggccttgaggcttgtcaggccgggaaagaagaacaaggatgtaagtgatgcaattcaaaaggttgctgctgcctatgactgtaaaattgttgagggtgttcttagccaccaaatgaagcagtttgttattgatgggaataaagttgtgcttagtttgtctaatccagacacaagggttgacgaagcagagtttgaggagaacgaagtttatgcaattgatatagtaacaagcactggggatggcaagcctaagctgttggatgagaagcagacaactatttataagagggctgttgacaagagttatcacttgaagatgaaagcgtctaggttcattttcagtgaaataagccaaaaatttccaatcatgccattctctgctagggctttggaagagaaaagagctcgacttggtttggtggaatgcgtcaaccatgagctcttgcagccatatcctgttttgcatgaaaagcctggtgattttgttgcacatatcaaattcacagtcttgttgatgccaaatggatcggatcgaatcacaactcatccactccaagaattgcagcccacaaaaacaatagatgatcctgatattaaggcctggctagccttgggcacaaagacaaagaagaaaggtggtggaaagaagaaaaaaggtaagaaaggggagaaggcagatgagtcagctgaagctgagcctatggactcaacaaacgaggccactcctcaagagtgacttaactctcctcccctctcctctcccccaaacaatgaaagaagttttttcatttcattttcgataccccttttcaattttggtacactgttcaccaaattgtattttgcttggatatcaattttagtatagtgttccgacattgattctaatagcaaaaaaaaaaaaaaaa

SEQ ID NO: 9344 - DNA, 1592 bp, Vitis vinifera
ctagctcaactgagccaccaccccctccccaaagacaatcgcatcttttccgtctcttctgaaccctagctgttcgtcttctcaagcctcgaaacgatgtcggatgacgaaagagaggagaaggagttggatctcacttctcctgaagtcgtcaccaaatacaagagcgctgctgagattgctaacaaggctttgcagttagtcttgtcggaatgcaagccaaaggcaaagattgttgacatctgcgagaaaggcgattcattcattagagagcaaactggcaatatgtacaagaacgttaagaagaagattgagaggggtgttgcctttccaacttgcatttctgttaacaacactgtctgtcatttttctccccttgccagtgacgagacagtgttggaagatggtgatatgttaaaaattgatttgggttgccacatagatgggttcattgcagtagttgcgcacactcatgttcttcagggagggccagtgatgggtagagcagctgatgttcttgcagcagcaaatactgctgctgaagttgctctgaggcttgtaaggccaggaagaaagaataaggatgtaacagaagcaattcagaaggttgctgctgcctatgactgcaaaattgtcgaaggtgtactcagccaccagctaaagcagtttgtgatagatgggaacaaagttgtactgagtgttcccagtccagagaccagagttgaggatgcagagtttgaggagaatgaagtttatgcagtagatatagtcacaagcacaggtgatgggaagccaaggctacttgatgagaagcagacaactatttacaaaagagcagtcgacaagagctatcatttgaagatgaaagcttctagattcattttcagtgagattagccaaaagtttcccatcatgccattttcagcaagggctttggaagagaagcgggctcgactgggtctagtggaatgtgtgaatcatgatcttttacaaccataccctgttcttcatgaaaagcctgctgaaacttgggttggctatgcaggtgactatgttgctcacatcaaattcactgtcctgctaatgccaaatggatcagatcggattacatctcattcactgcaggaactgcagcctacaaagacgacagatgacccagaaatcaaggcctggttagccttgggcacgaagacaaagaagaaaggtggtgggaagaagaagaaaggtaagaagggggataaacctgaagagtcagcagaagctgaacctatggatgcaacaactaatggggcatctcaagaatgagaggatgttcctttttgtgctttttttttttttttttaaatgtcaattttggtacttcactcctttgtatctggttgattaagagttgatttggatagtgttagaaagatgatcctaatcgcggtttcctgcctatgcagctgatgcatgcatccagagttacccttgtatctcttttttttcttcaatcatttttatgacaattgaaaagcaggaatttaggttcaataaacatgctggcacaatggatgagactgggaggtctgatattatattgaatttgagaa

SEQ ID NO: 9345 - DNA, 1621 bp, Glycine max
ggaggcgactaaccctagttcattgcactgcaacttagccacttgaacccccttcgtaagcctcttcacatcttcacttcttcttccgcactaatacgaaaccagagggaattcacaaaagaggttaccatgtcggacgatgagagagaggagaaggagttggatctcacttctccggaagttgtcaccaagtacaagagcgccgcggagattgttaacagggctttgcagttagttatttcagaatgtaaaccgaaggcaaagattgttgacctttgcgagaaaggggattcgtatattagagagcaaactggtagcatgtacaagaatgtgaagaggaagatagagagaggtgttgccttccctacatgtgtgtctgtgaacaacactgtctgtcacttctctcctcttgccagtgatgaaacagtgttggaagatggtgatatagtgaaaattgacatggcttgccatatagatgggttcattgctgctgtggcacacactcatgttcttcaggaggggccagttacaggacgggcagccgatgctcttgcagcagcaaacaccgctgccgaagtggccttgcggcttgtaaggcctggaaggaagaacaaggatgtaactgaagcaattcagaagattgccgcagcgtatgattgtaaaattgttgagggtgttcttagccaccaaatgaaacagtttgtgattgatgggaataaggttgtgctaagtgtatccaatccagatacaagggttgatgatgcagagtttgaggagaatgaagtttatgcaattgatatcgtagcaagtactggagatggcaagcctaagcttttggatgaaaagcagacaactatttataagagagctgttgacaagagctatcacttgaagatgaaagcatctaggttcattttcagtgaaataagccaaaagtttcccatcatgcccttctctgcaagggctttggaagagaaaagagctcgtttgggtttagtggaatgtgtgaatcatgagctcctgcaaccttatcctgttctgcatgaaaagcccggtgattatgttgcacatatcaaattcactgtcttgctaatgcccaatggatcagatcgtgttacgtctcactcactccaggagttgcagcccaccaaaacaatagatgatcccgaaatcaaggcgtgtctagcattgggcacaaagacaaagaagaaaggcggtggaaagaagaagaaaggtaagaagggggcagaagctgaaccaatggatgcaacaaatgatgctacaccccaagaacaagattgagagacaaaaaccctttgattttgcttttgatccctttcaattttggtacatttttcaccaagttgtatctgcttgatcgtgaatttagtacagctttcggacatccaatgttaataggaatttgatttccttggctattgtacttgacctgaatgctgtactcctgattaagcataaatatgcttaattgttggaggggttttaatttataaacaaaagatatcaaatttaaaacccaattacatggttggaaatgtatgttgtgaggttttgaaatggttaaccttgttggtttgagaaaaaaaaaaaaaaaaaaaaa

SEQ ID NO: 9346 - DNA, 1459 bp, Solanum tuberosum
ttgttgcctccatttttcttccatcgcaaaatcccaattttgcttcgaatttgtgtgtttgaattaatagctacttggtaactatgtcggacgacgagagagaagagaaagaattggatctcacaagtcctgaggtcgtcaccaagtacaagagcgccgctgaaattgttaacaaggcgctgcagttggtgttgtccgaatgcaagccaaaagtaaagatagttgatctttgtgagaaaggggatgcctttatcaaagagcaaactggaaatatgtacaagaatgtgaagaagaagattgagagaggtgttgcatttccaacatgtatttcagttaataacaccgtgtgccatttctctccattggctagtgatgagacaatagtggaagaaggtgatatattgaagattgatatgggatgtcacattgatggatttattgcagtagttggacatacacatgttcttcacgaaggaccagttactggtagagctgctgatgtcattgcagctgctaatacagctgctgaagttgctttgagacttgtaagaccaggaaagaagaactcggatgtaacagaagctattcagaaggttgctgctgcctatgactgcaagattgtcgagggtgtattgagccatcaaatgaagcagtttgttattgatggaaacaaagttgtattgagcgtgtccaatcctgacacaagagtagatgaagcagaatttgaagagaatgaggtctactccattgatatcgtgacgagcactggtgatggaaagcccaagttgttggatgagaaacaaacaaccatctacaagagagctgtggacaaaagctataacctgaagatgaaagcctcaaggttcatcttcagtgaaatcaatcagaagttccctatcatgccatttaccgcaagggatttggaggagaagagggctcgtttgggccttgttgaatgtgttaaccatgagcttttgcagccatatcctgttctacatgagaaacctggtgatttggttgctcacattaagttcacagtgctgttaatgcccaatggatcggatagggtaacatctcatgygctccaggagcttcagcctacaaagacaacagagaatgaacctgaaatcaaggcttggctagcccttcccaccaagactaagaagaaaggyggtgggaagaaaaagaaaggaaagaaaggtgacaaggtagaagaggcatctcargctgagcctatggaaggatagtgaagtggctccaaaactttcatacttgcaattttgaggtgctttgatcgatcaactttactgaaactattggttcagtgtgagtcgattcggcacgttgagctgcttatgttcatctttgtggggttatgaaagacgattattgtacccgttcatgttaagttgttctccttaggtttttcaatgctattcaaaattctcttatcatttta

SEQ ID NO: 9347 - DNA, 656 bp, Glycine max
tttttttcaaacaaagttaaagtagtaacaatgaatccttcctttccttcaaaatcctttatgtatgttgttcttatcttttgctttcttggtgccaccagattgtatgcaagtgacccttatctaacactggattactatgcatcaagttgccccaccgtgtttgacattgttaggaaagaaatggaatgtgcagtgctttctgatccccgcaatgcagccatgatagttcggctacacttccatgactgctttgttcagggctgcgatggatcagttttgcttgatgacacaatcacacttaaaggtgagaaaaacgccgctaccaacatccactctttaaaaggcttgggaattgttgataagatcaagaacatagttgaatcagagtgccctggaattgtttcttgcgctgatattctcactattgcagccagagatgctgttattctggtaggtggaccttactgggatgttcctgtgggaaggaaggattctgtcactgcaaattttgatcttgccaacaccaatcttgccactccagatgagagccttctgtctatcattgccaagtttctttaccaaggactatctgtcacggatatggtagcccttgcagagcccacaccattggcatggcacagtgtaagaatttc

SEQ ID NO: 9348 - DNA, 2172 bp, Glycine max; identical to SEQ ID NO: 9330

SEQ ID NO: 9349 - DNA, 1342 bp, Ammopiptanthus mongolicus; identical to SEQ ID NO: 9342

SEQ ID NO: 9350 - DNA, 1548 bp, Medicago truncatula; identical to SEQ ID NO: 9341

SEQ ID NO: 9351 - DNA, 1541 bp, Glycine max
ggaaccctagttcattgcactgcaacttagccacttaaaccccattcgttagcctctccacatcttcactgcttcttccatacaaatccgaaaccagacggaattcacaaaagacgttaccatgtcggacgatgagagagaggagaaggaattggatctcacttctccggaagttgtcactaagtacaagagcgccgctgagattgttaacaaggccttgcagttagttatttcggaatgtaaaccaaagacaaagattgttgacctttgcgagaaaggggattcgtatattagagagcaaactggtaacatgtacaagaatgtgaagaggtagattgagagaggtgttgccttcccgacatgtgtgtctgtgaacaacactgtctgtcacttctctcctcttgccagtgatgaaacagtgttggaagacggtgatatagtgaaaattgacatggcttgtcatatagatgggttcattgctgctgtggctcacacccatgttcttcatgaggggccagttacaggacgggcagctgatgctattgcagcagcaaacaccgccgccgaagtggctttgcggcttgtaaggccaggaaggaagaacaaggatgtaactgaagcaattcaaaaggttgctgctgcgtatgattgtaaaattgttgagggtgttcttagccaccaaatgaaacagtttgtgattgatgggaataaggttgtgcttagtgtatccaatccagatacaagggttgatgatgcagagtttgaggagaatgaagtttatgcaattgatatcgtagcaagtactggagatggcaagcctaagctgttggatgagaagcagacaactatttataagagagctgttgacaagagctctcatttaaagatgaaagcatctaggttcattttcagtgaaataagccaaaagtttcccatcatgccattctcagcaagggctttggaagagaaaagagctcggttaggtttagtggaatgtgttaatcatgagctcctgcaaccttatcctgttctgcatgaaaagcctggtgatgatgttgcacatatcaaattcactgtattgctaatgcctaatggatcagatcgtgtcacatctcacccactccaggaattgcagcccaccaaaacaatagacgatcctgaaatcaaggcatggctagcattgggtacgaagacaaagaagaagggtggtggaaagaagaagaaaggtaagaagggggcagaagctgaaccaatggaggcaacaaatggtgctacaccccaagagcaagattgagacaaaaaccatagattttgctttttgatccctttcaattttggcacatttttcaccaagttgtatctgcttgattgtgaatttagtacagccttcggacacccaatgttaataggaatttgatttccttggctattgtacttgacctgaatgctgtactcctgattaagcataaatatgcttaattgttggaaaatatatcaaatttaaaaccccaattttgtgtttagaaaaaaaaaaaaaaaaa

SEQ ID NO: 9352 - DNA, 597 bp, Glycine max
atgtctgctcaggtcggtgtcaggacacgagcccgagccgcattagccatggaagctgctactgccagttcagctcaaccctcttcgaagagaaagaagatctacgacactaaccatgtggcaaaactctccaaaactccgagaacaagttcttcctccttcttcatacctgcgacggtgacggagattgttcaggaacgctgcctcagccctacctccagtgaaattccggcttcttgctgctccagcaacggatccattggcctcgatgaggataggatcaagctcttagatctggaggtggagagcgcgcaagttgaaacgtcgacgtgcaatggtggtcaagaaattgagaggagagagatgaaaagttccagcgagcttcgagagaattcacaggagccggagccaatggagatcaattctcaccgtgccttatcaaaggcaaaagccatgcctaccgagttggagcycgaggaattcttcgttgctgcggagaaggacattcagaaacgatttcaagacaagtacaattatgatattgttaaggacgtaccactggaaggacgctacgagtgggttcaattgaagccttga

SEQ ID NO: 9353 - DNA, 876 bp, Glycine max
ggactttcatcagcaaaaaccaaaacctgaaaaaggaagagtgtgtggaaattggcatcgctcgcaagagcaacaactagtagtacctaaagagacagagagtgtgcacatctatgtcatctcaggtcggtgtcaggacacgagcccgagccgcattagccatggaagctgctactgccagttcagctcaaccctcttcgaagagaaagaagatctacgacactaaccatgtggcaaaactctccaaaactccgagaacaagttcttcctccttcttcatacctgcgacggtgacggagattgttcaggaacgctgcctcagccctacctccagtgaaattccggcttcttgctgctccagcaacggatccattggcctcgatgaggataggatcaagctcttagatctggaggtggagagcgcgcaagttgaaacgtcgacgtgcaatggtggtcaagaaattgagaggagagagatgaaaagttccagcgagcttcgagagaattcacaggagccggagccaatggagatcaattctcaccgtgccttatcaaaggcaaaagccatgcctaccgagttggagctcgaggaattcttcgttgctgcggagaaggacattcagaaacgatttcaagacaagtacaattatgatattgttaaggacgtaccactggaagacgctacgagtgggttcagttgaagccatgaacgtgtgcgtctcgccaccgaagaagaaaaactccgatcaatttgaacatgtcattttggtctatttatatattgttaattaagtctagtctaggtctttgatttcaatcttaattatctttttaattttacaccagccagactcttttatattctggtgcagcttt

SEQ ID NO: 9354 - DNA, 618 bp, Glycine max
atgtctgctcaggtcggtgtcaggacacgagcccaagccgcattagccatggaagctgttagttctgctgaaccatcatccaagagaaagaagatcagcaacagtactaaccaagagccaaaactctccaagactccgagaacgagttcttcctccgctgtcaaaccagcgacggtgacggagatggttcggccggtgtcgccggagatggttcagcaacgctgcctgagccctacctccagtgaaattccggcgtcttgctgctccagcaacggatccattggcctcgatcaggacaggatcaagctcttagatctggaggtggagagcgcgcaagttgaaacgtcgacgtgcaatggtggtcatgaaattgagaggagagagatgaaacgttccagcgagcttcgcgagaattctcaggagccggagccaatggagatcaattctcaccgtgtcttatcaaaggcaaaagccatgcctaccgaattggagctcgaggaattcttcgctgcctcggagaaagacattcagaaacgatttcaagacagatacaattatgatattgttaaggacgtaccgctggaaggacgctacgagtgggttcagttgaagccttga

SEQ ID NO: 9355 - DNA, 858 bp, Glycine max
gacctgaaaaaggaagggttagtgagtgtgtgtgtggaaattgtcatcgctcgcaagagcaacaacaactagtacttaaagagacagagagtgtgcacatcaatgtctgctcaggtcggtgtcaggacacgagcccaagccgcattagccatggaagctgttagttctgctgaaccatcatccaagagaaagaagatcagcaacagtactaaccaagagccaaaactctccaagactccgagaacgagttcttcctccgctgtcaaaccagcgacggtgacggagatggttcagccggtgtcgccggagatggttcagcaacgctgcctgagccctacctccagtgaaattccggcgtcttgctgctccagcaacggatccattggcctcgatcaggacaggatcaagctcttagatctggaggtggagagcgcgcaagttgaaacgtcgacgtgcaatggtggtcatgaaattgagaggagagagatgaaacgttccagcgagcttcgcgagaattctcaggagccggagccaatggagatcaattctcaccgtgtcttatcaaaggcaaaagccatgcctaccgaattggagctcgaggaattcttcgctgcctcggagaaagacattcagaaacgatttcaagacagatacaattatgatattgttaaagacgtaccgctggaagacgctacgagtgggttcagttgaagccttgaacgtgtgcgtcccagttcgtatcgccatcgaagaagaaaagctccgatcaaattgaacatgtcattttgggctatttatatattgttaattaagtctagtctagtctttgatttcatctaattatctttttatttacac

SEQ ID NO: 9356 - DNA, 597 bp, Glycine max; identical to SEQ ID NO: 9352

SEQ ID NO: 9357 - DNA, 1843 bp, Glycine max
tttttttttttttttttttttctctgaaatatatgtacgaattatttgttgtctggtttgctgaatttcatatgccaaaagtgggaatgaaagacaatgagatcctctctgaacagtttcaatgttccgcaatatcaccactctatacacacattttcacacaagtgaaatcaatttcctcccatttatcattaacatcccaatgctcttctacaccatttaggcctacttttttctcaatttctctgtttctaacttaacactcccgggctgcaagcatttattacagaatcagtgtagttgttaaggatctttccgtaatttcaagcctcactagttgggtagagcatcacaaaacatgtcattcatgttgtctcaaactgatcattgactagaatcctcaggtgggtcagcaggtaagacttgttttggcagttgtgaaactttgagtgttcctccaagctctactggcacaagagggatcagtgagtgaagaacatctgcaatcagtggacggtaacttggctctggttgcacacatagcacagccacagcagcaacctggtataagtgcttggggtccattgtattcttaattacaggatccacaatgtttggaagcttagatctgtctgtgagctgtggcatggccaatgtgacaatagattggcattgagcttgtgctagtttttccacaggcttctttcccaatagaagctccagaagcacaactccaaaagcatatacatcacttttatcagtcaatttaccatctaaaagatactccggggcaacgtacccaacgttcctgaaagcttgaggttgttcttgttctgggacccattggttatggcaagaccaaaatcagaaagcttggcattgaactttgtatctaaaagaatattagaagatttcagatctctatggatcaccggagggtaacagtgctcatgtagatattttaatccccttgctgtgtcaagagcaattttgatcctcaaatgccaagtcaatgctgagccatgagaaggtccatgtaattgagtttccaatgatccattatgcatcaactcatagacaataatccttgtatcctcattactgctacaacccagcagagaaatcacatttggatgttgaattttacttaacaaatccacctcgttctcaaattcttgctcagcatactgattttcacagtgcaattttttaaccgcaacatccaaattatcatccaaatgagccttgtaaacgcatccaaaacctcccttgcccaagatgttaatttccttgaaatttccggtggccttttctatttgcttatagtcaattattggaacacaccctttcttaccaaccagctttatagagctgaatttactcaaaaatggtgatgaagctagccctttctcagcatctgatctttgaacgtttttccctttggattttgaagggtatttggtgtagtaaatccagatgcacaacaaacacaaaatgactgcaccaagtgaagtgctgacaacagcaacagcaattaccattttcttgtgcgaatccatgtgttgctgttcagcccccatcacaattcctggagaggaagcagacattgaagtgggaaatggagaaaagggaggaacttgaggagagggagcaagagggtatgcagaggcaagaaaccaagttggtttgtggagaataaggaggagcatgagaagcataagaagaagaagcttcgttttcattgtttctttctaagaaaacatgaagataaagatataaaaatagtagatgtgtgaaggaaagacttgtgcctgagaaggagcacacactcactacaaacacc

SEQ ID NO: 9358 - DNA, 1689 bp, Glycine max
ggaaagaaacaatgaaaacgaagcttcttcttcttacgcttctcatgctcctccttattctccacaaaccaacttggtttcttgcctctgcataccctcttgctccctctcctcaagttcctcccttttctccatttcccacttcaatgtctgcttcctctccaggaattgtgatgggggctgaatagcaacacatggattcgcacaagaaaatggtaattgctgttgctgttgccggcacttcacttggtgcagtcattttgtgtgtgttgtgcatctggatctactacaccaaatacccttcaaaatccaaagggaaaaacgttcaaagatcagatgctgagaaagggctagcttcatcaccatttttgagtaaattcagctctataaagctggttggtaagaaagggtgtgttccaataattgactataagcaaatagaaaaagccaccggaaatttcaaggaaattaacatcttgggcaagggaggttttggatgcgtttacaaggctcatttggatgataatttggatgttgcggttaaaaaattgcactgtgaaaatcagtatgctgagcaagaatttgagaacgaggtggatttgttaagtaaaattcaacatccaaatgtgatttctctgctgggttgtagcagtaatgaggatacaaagattattgtctatgagttgatgcataatggatcattggaaactcaattacatggaccttctcatggctcagcattgacttggcatttgaggatcaaaattgcccttgacacagcaaggggattaaaatatctacatgagcactgttaccctccggtgatccatagagatctgaaatcttctaatattcttttagatacaaagttcaatgccaagctttctgattttggtcttgccataaccaatgggtcccagaacaagaacaacctcaagctttcaggaacgttgggttacgttgccccggagtatcttttagatggtaaattgactgataaaagtgatgtatatgcttttggagttgtgcttctggagcttctattgggaaagaagcctgtggaaaaactagcacaagctcaatgccagtctattgtcacattggccatgccacagctcacagacagatctaagcttccaaacattgtggatcctgtaattaagaatacaatggaccccaagcacttataccaggttgctgctgtggctgtgctatgtgtgcaaccagagccaagttaccgtccactgattgcagatgttcttcactcactgatccctcttgtgccagtagagcttggaggaacactcaaagtttcacaactgccaaaacaagtcttacctgctgacccacctgaggattctagtcaatgatcagtttgagacaacataaatgacatgttttgtgatgctctacccaactagtgaggcttgaaattacagaaagatccttaacaactacactgattctgtaataaatgcttgcagcccgggagtgttaagttagaaacagagaaattgagaaaaaagtaggcctaaatgggtgtagaagagcattgggatgttaatgataaatgggaggaaattgatttcacttgtgtgaaaatgtgtgtatagagtggtgatattgcggaacattgaaactgttcagagaggatctcattgtctttcattcccaaaaaaaaaaaaaaaa

SEQ ID NO: 9359 - DNA, 1798 bp, Glycine max
gggtccacacttctttccttcaacttcaacctcaacctcaacctcaacccccacttaccagttttcccaaattttcgttcttttttcctttccatgagttgatgcatctttttcaagctaattaagcttgaattagctggtggggctttttaaattcgtcgataaaaaaacagtgttctgctttttttctcttgtgttttttggttgcagattcaggaactggtgtgtgagatttcttcaacttggggtgtcattgacataaatgcaaacaatcttgaatttgaaggcagtaagtgattacttaaatccctgaaagacatgcagtcagccttcgttctgctgaaatgaagaacttgcagacctcggaggaattacagtcatcgactcaagcttctcatgagcccaagagtgaacaaccaaacaatcacacaactgatgctcctgttacagacacaggctcagcatctgctacaagtaatgacagcaaaaaagtttcacggcaggatattgagtttgttcagaatttaatagaaagatgcctacagttatatatgaataaagatgaagtggttaaaacactactgactcgggcaaagatagatcctggattcacaactcttgtatggcagaagttggaagaagagaacgctgatttcttcagggcctactatatcaggctaaaattgaaaaagcaaatactattattcaatcatttacttgagcatcagtatcatctcatgaagtgtccaatgcctgcaaaggttccattggctccaatacagaatggaatccatccaatgcctgtcaacaacctacctatggggtatccagtgctacagcagcctcccatgccagcaacaggtcaacctcatattgactccatgggttgtggtttatcaagttgtcatgtagttaatggagtccctgcctcaggcaactttcaccccattcggatgaattctggaaatgatatgatgatggaccacagcgctcctgatatggttcctgttataccaccaaatggtacaatgtcatctgtctcagaaatgcctgtgagtccgacatcagtagcatccagtggtcattttcccttcactgcatcagaaataccaggaatgggcgcagatacatcagctcttgatacagcatttacatctgatgtggcaagttcagtaggactacagcttgcagcagatggtggcaatggaatttctagatcgctggatcaaattcaatggaattttagcctatctgatctaacggcagatttgccaaacttgggagatctaggagctctgggaaactatcctggttcaccatttttgccatctgattcagacattttgctagaatctcctgatcaacaggatatagtggatgacttctttgttaattttgagcccccatgctctcaatcagatgaggagaaatcttgaggtgaggcgagttgcatgtttcacattaattgttaggttagggaaaattagtattaataaatgtcatctagcttacatggcatacaggtttactgttacctaagtgtaggcagcctgatttatatcatcagagtgaagatagagaatgtcaattttccatgtagtagcaaactagcaatcttttgcattcttttaagaaatctgttatcaggatgagttgggacagtggttaggatgtaattgatttgatgcatttgattatatatgtatattgtttggatccttgtcagtccattggttggtgtgatatttgattcacattgtttcagagcaaaaaaaaaagaaaaaaaaaaaaaaaaaaa

SEQ ID NO: 9360 - DNA, 2109 bp, Vitis vinifera
ggtgagatttttatctctcagtttctcttcagcttctcttcagcttctctccattttgtcacaccaaatctcacaacgcatagagaaaaattttcaaccatttcactcaaatttcgctcgattcatccaaattttcgtttctgatctcaactcaaacgcttccgaatcgaaatctctgttttttcctctttagttttatgtatgaatcttcagatttctcgcaaaatatcgcagaaacctcaatgctatacatatagctttcatgctcatttgcggttccttgatttgtagctgttgtcgatgttttgagcctcgaatttgtgttcttttctagattctcggaacatgttgtgcatttgttattatttatttttgaatccgaagctctgaaggactagggttttggaatccctcgaaacgaagcgtgtttttagagattttcggaagcacggtgaaaggcgaaaactgtctcaactttatgaagtattagagatttagatgcaaacttttgaacttagtgaatcagacaaccttagctgcagctgggagatacctgagctaaacagagagatgagttcaacttgcattcagatgtaatgaagaccttacagagtgcacaggaaatacagtcctcaacccaagtttcacatgagtcccaaagtgaccaccagaacaacacagcagaggctcctgtggcagactcaggttcaatatgcatttcaagcaatgatagcaggaaagtttcgcgtgaagatattgaacttgtccagaatttgatagaacggtgcctacagttgtacatgaacagggatgaagtggtgaagaccctcttgagtcgtgcaaggatagatcctggatttacaactttggtatggcagaagttggaagaagaaaatgctgattttttcagggcctattacataagattaaaattgaagaaacaaatcattttgtttaatcatttgcttgagcatcaggctcatctcacgaattatcatgtttctccaaaagttcctttggcgcccatacagaatggaatccatcccatgcctgttaacaacttaccaatgggatatcccgttcttcaacaacctcctatcccggctcctggtcaacctcatattgattccatgggttgtggaatatccagctgtcatgttgtaaatggagtccctgcaccaggcaatttccaccctatgcggatgaattccggaaatgatatggtgagggacaccagcacagcagatgtagcacctgttattccaccaagcagtgccatgtcatccatgtcagagatgcctgttagtcctacttcagttgcatcaagtggccatttccccttcactgcatcagatatatcaggaatgggagtagaggcatcagcacttgagacagcatttacatctgatgtggccagttcagtaggattgcagcttcctccagatggtgggcctgggaattctagagattccctcagagctttggctccgattccatggaatttcagtctttcagatttaacagcagatttatcaaacttaggagatctaggagctttgggaaactaccccggttctccctttctgggttctgattcagacattttgcttgattctccggagcaagaggatatagtcgaggagttctttgtcgattctgtcccagggccgccaaatgcccaatcagatgaggagaagtcctagaataaggttgcggaatcatgcatttgacttccacagatgctctcctcatggaacctcataaaattgtattctaacgtgttcatcccgaagcgacttaccacaaaagagttgctctacttccagagtcctggtatgccctgtgagtgcccttctaggggaatcctgggtcacagcatatgaaaatttttgcagctcaaccagtccaatcttcaccagaaaagtaggaagctggtatagctttggagatgaagattgatcctcttacagtgtatggcgattctcaactgattgttaatcagatctatgcactatttattaagtaagaaagaggtctctcgagcccagtttatctagattttcaatatatgatttggtgatgactgattttgtcacgcttttgcttttc

SEQ ID NO: 9361 - DNA, 1868 bp, Arabidopsis thaliana
agcggacgtctccgtctcttcttctgcttctaacttgctccaaattttcatttcaatttttttgataggacttaaaaattccaagctcgcttatgagagtaatggcgtagcaaaatctttatctaactcttggctcttgtctttttttgtttgtttctcaacctacgccggatcttgcttcttcgaacttctccgacgcatcttcttcagattccgcagaagtttgcgtcgttttcttgaatccactcaaaattttattggaagtttgtgttgtttttactagctctgaatctttagagggctcaaaaattcgtcgagaaaaccagtctttggaagtgtagcattttggattcgcttgtgacttgaatcttgaatattaggtttctatttggtcaacaacatcagaaacatgtgtgctcagatgttgagctctttagattcaattgttgtgaacattgtcaaggagaatagtgattattgaaggatgcaagatttttatattcagctctaatgaagaacggacaggagttgcagtcttctacccaagtttcacatgagtcccaaggtgaacagaaagttaatttatcagtagaagctccaatacaagattctggttctgtatctgcctcaagtaatgacggtaggaaagtgtcaagacaagatattgaacttgtccaaaatttgatagaaagatgtctccagttgtacatgagcagagatgaggtcgtaaagacactcttgacccgtgcaaggattgaccctggttttacaacattagtatggcaaaaactggaagaagaaaacgcagagtttttcagggcatattacatcagactgaaactgaagaagcaaatagttgtattcaatcatttgcttgagcatcagtatcacctcacgaagtataatgtacattcaaaagttcctctggtcccaatgcagaacggtattcatcctatggcatctgtgaacaacatgcccatgggatacccagtactacaacatcctcagatgcatgctcaaggtcatccccatcttgatcctatgagctgtggaatgtcaagctgccatgtggttaatggagtccctgcacctgctaatttccaaccaatgaggatcaactcagggaatgatatggtaatagatacaaccatggctgaaccaactccaatgattccaccaaatagtggtatgtcggatatgccagtaagtccagcttctgtggcgtcaagcggacactttccatttgctgcttcagacatgtcagggatgggaatggacacgtcagctcttgactctgctttcacatctgatgtcggaacttcagtagggttacaacttggatcagatggaggagctggaaattctagagaccctctcaggccatttgatcagataccttggaactttagtctctctgacctcactgcagatttgtcaaatcttggagatttaggggctttaggaaactatcccggttctccttttctgccatctgattcagagattttacttgactctcccgaacaagaggacatagatgaattctttgtggattcgattccaggacctccatgttctcagtcagaagaagacaagtcttaatcaagcttatgatatttgatcaatagaaacagtcttattatctagcaagcaagcattgtttgtgccgtttctctatattagagaaaacctcccaaaaggatttaaaatcttcttcttttttcctcttctaagggtaatgatcgatcatagattcatagacttagattaattgctcagttgtttgtttattgtacacctttattttgggactttgctaagcattgtataatatctcccaataatctattttcttgttggatagttca

SEQ ID NO: 9362 - DNA, 4379 bp, Solanum demissum
atgaaagcagaaaaaaaactgctgccaaacaacacagaaaagaaaccatcaattcaggcttctcatgaggcccaaaatgaccagcagaaccatacagcagatacacctgtagctgatgcaggttctgtttccgcatcgggcaatgataacagaaaagtttcacgtgaagatattgaacttgtaagacagtttttaaattctttattttgcctggatattattcattgggaagttttactggggtcttttaactttatgataacatatttgttgcaggtccaaaacttgattgaaaggtgcttgcagttgtatatgaacaaggatgaagtggtaaaaacacttctgaatcgtgcaaggatagatcctggatttacaactctaggtaagtacatgagttactgatgaagttgcttgtgattctgtctgcttgcattatatatgctgtatactgtctcacatgtgtagtgaccaagtgttttctggtttatgactatggttattgggtggtcactttagatcttcagtttctaactttaacatgttttcaaattgtgtacagtttggcaaaaattagaagaagaaaatgcagatttctttcgggcctactacattaggcttaaactgaagaaacaaatcatcctgttcaatcatttgcttgagcatcagtatcatctaatgaaatatccagtgcctccaaaggttccgttggctccaatgcagaatgggattagtaccatgccaggtaaatttatttgtcatatgaaggtgagtattactgtattgttctgcttcagtattagatttggaaatgttgagattgttgaatcatcaattactgatccttttctatgtcctcctttgcgatctattcgttttgtgaacatgtagaagataggtacccctccagttgtagtggagggtcaactgtactaatctttattagtgaagaagcttgtctcttctgcataatgtttattagatggtttggaatgggcaaagaaactcgtgttgctttatcactttatttggactacgcctgcattcttgaatggaccaaatggagtccctctatggaggggaattgcagatttgcagagagttatacaatataagtcatccttataaaaacaaagagtttatacaacataagtcatccttataaaaacaaagagttgatacaacataaattcttacaaaatatgtagttcaacttgccctttgcacttgctttcttcctcaatgttgagaaacatggctttttgaattggaattaagttgtttgaatagcatggggattaatattattttcagaacaggtaaatgagttttttttagttttattatcattatatttattgccacttgtttccggtgcagtcaacaacttacccatgggatatcccgtcctgcagcaatctccagttccttctgcaggtcaacctcatcttgatccaatgggcatgtccagctgtcacgtggttaatggtgtgcctgcaccaggaaactatcatccgatgaggatgaattcaggaaacgagtgagaaccttttttgtttaggattttaggcctctttgattctaaaatagaaatttatgagctatctaaactcttttctggttagccagtgtggctgtggtacttgtttgctcagcatcttacttgccatgtgctcaaagatttgccatttgactatttccagtacatttaattcgcggtttcccagagttagtaggaactgaaattgcattgatgttccatattggtttaaaatgagtgtaggttagggaaataggttgcttttatgtgaatatttgaaacctaatacttgtttcttgttgcccatgcgtagtttgttaaggatatgaggttcctgtcttctttttaaagatgattaaataagctgattgttgaagtgaacatatctttgggcttctgggatgaaaagatgtttatatttgttgaaggagacgtggcatgacaaatgacactttatacattgttctctgctggcagtatggtgattgacaccaatgtgtcagatgtagcagcagctgttccacctggcaatgccatgtcatctatgtcagatatggctgtaagccctacatcagtagcttccagcggccattttccctttactacttcagagatttcgggtatgggagttgacaccttagcccttgatgctgcctttccatctgatgtagcaagttcagtgggattacaactaccaccagataatggtgttggtaattctagggattcacttagatctttggctcagattccttggaactttagtctctcagatctaacagcagatctgtcgaacttgggaggtaagttaacttatgcacaactcaaacattatcgctgctcatgagtgagattcagcattaatttgcaatgtggttcaacccccctcccactcctttggtgcttcctttgttgttacgaagagtgtttgatttgagaacttcattattgtcctatttgaagtattgccaatgggatcttttgacaagtcaaaatgtgaagtttggaataaagtgaaataattttccgtaaaaaagtgaaattctcatggtcaaaaaatctgatccagcagcttatagaattacaaataaagtccatcagcctaaaatgagaaatttactttgaaggtcattgtagttactccattaagcagtacttcatgtatgaactttcatgttaatagtcaaccatggcaaactgtaacatttaatttcagaggaagcatagtaagtgtgtacatatttagtgtacttctaagctcagtaagaacgtttgtgtgggaaaaaatcatattgtccacaattgaaaccttatggttgttttcatggattatcacagttctatcaaggttcttgctttatctctaataatgcaaagatctttactactagatggtattgacgatttgaactgtctggccctggatatcttatctctgtattgggctttcagaaaacttatactccctccgtttcaaaaagagtgacctagtttgatttggcacgcagttttagaaaataaagaagacttttgaatcttgtggtcctaaattaaagttatgtcaaatgtactaaattgcccttcaatcttgtggctttaaacatgccatgtggaatgctaaaattaaaaatgttaccaaaaaaggaaagaggtcattctttttgaaacagactaaaaaggaaaggaggtcattctttttgaaacggagggagtagtagtttttagattggcgtgccttcttccaccttagagccaaaaatatctttagaaatttcggagaagtcgtcattcttcatttcaggaaatgcttatagatttcggctcagcagcagaacaccacttgatatttatttctagtcagctgtggacttcgttaggccaaaaggagatccattcgagaaaatagactagtctatggtggactggctagtatgctctgtgcccagatagatataggtggccagcctgtggggatttacattcatactcgtcaaagacctttattttcaaataaggacatacttttcaaggaattctagtatggacttgcttgtttattgttatgtcgtggtaccgattggcaaatcagactatgtgctgcaaaaatgttgcatcacaatattcttttccaggcaatagggagtaatgctctaaaagttaaatacatttaccaatttccatgtatgatgtgtcaacaacaacatacctagtgtagtcccacaagtggggtctgtggaggctagtgtgtatgcataccttaccactatcttgggaggtagtgaggttgtttctggttgaccctcggctcaagaaaataacaggagtgtaattacatatatgatatgtattggaagatgacttacaaagacagtttcactagtactagtagagagtacaataatgtgtatgggcttcttcttcaataatgattttatggattgttattctgctcagagtttctaaaattttctatctcctatctcatggactgcaagcctatccctgtcttttttcttccttctattaatttattcctcttttattctggttttaatgttcatttttgctccaatataattacagatctaggacctcttgggaactatcctggttctgcatatttgccttctgattcagatattctacttgactctcccgagcaagatgatataggtgggaacttttactttcttgcccgtcaaatgttatgctttgaatcataatctgcagagatgttcaaaatatgttagcattaagcatctcaacttgtctgttgtttttagccaaagttattagatgcaatgttgatgctgttgtctttactacaacaacatacccagtg

SEQ ID NO: 9363 - DNA, 1857 bp, Arabidopsis thaliana
acagtctactctcctgtttggtctctctctctctctcttttttttttactcttatctctgtgcaagcaacttcgtctctctcgataatggcgttccgatatcttctcgctgtctccgtcttcggagtttttgtttgaattcttcaaaggacagtcggatctttgttttacactatcttcataatctttgttggatttcatcagacttgtcatttattaatccatcgcgtttctcagtgtttctagttcgccaatttcggtttttatattggctattaacaattcgtcgacataactttgtgtgttttcgagtgtgtgagatttttagggttcgttcttcaaaggcttcagggtcgcgggaaggtttatgtttgcttgaaaattttgatacaaattgaccaatatgttgaactctatggactgcattgttgtttttggtgctaaagagaacacttctgattgaaggatgttttcactttacattcagcagtaatgaagaacggacagtgcgcacaggagctacaatcttccactcaagcttcacatgactctcaaggtgaccagaaaaccaacctatcaatagatgctcctatacaagattctggttctgtatctgcttcaagcaatgacagtaggaaagtttcacgacaagatattgaacttgttcaaaatttgatagaaagatgtcttcagttgtacatgaacagagatgaggtcgtgaagactctcttgactcgtgcaaggatagaccctggatttacaaccttggtttggcagaaattggaagaagaaaacgcagactttttcagggcatattatataaggctgaaactgaagaagcaaataattttgttcaatcatttgcttgagcaccagtaccatctcatgaagtatcctcctggacctccaaaagttcctctggcaccgatacaaaacggaatgcatcccatggcacctgttaacatgccgatgggatacccagtactacaacatcctcaaatgcatgttccaggccatccccatcatcttgatgcaatgggagtatcgagctgccatgttgttaatggagtccctgcccctgctaatttccatcctttgagaatgaatacagcgaatgatatggtgatcgatacaactgcgaacgatgcaactcctcaagtgattccaccaaacagtggtgcgatgcctgagatggtagcgagtccagcttctgtggcgtcaagtggacactttccatttgctgcttcagacatgtcgggtatggtaatggacacttcagtacttgattcggcattcacatctgacgttggaccggatggagaaggagccgggaattccagagattccctcaggtcatttgatcagatcccttggaactttagcctttctgatctcaccgcagatttgtcaaatctgggagatttaggagccttaggaaactatccaggctctccatttcttccatctgattcagagattttcctggattctcctgaacaagaggacatagaggagtttttcgtggattcggtgcctggacctcgttctaattcagatgaagagaagccttgaattgaaaggtagagacggccataatcatctacagtcaccaagcattattaaaataacaagtattgatatataaatcagagtattatgaataaaatgaagctgcagttgtagtctccttgtatctctattacaattctcttaaatgaagcaagaaataggcgtagactagtttccttttcttttatttgtttcaatcctatgctttggtcatatgttatgttgtagttatctctaaatggatattttctttaaaaacttttttagaaatatgtcttacaaaacactg

SEQ ID NO: 9364 - DNA, 2254 bp, Glycine max
atgtttcattcactcttctaaccaaacccgaaaacagagtacaagattttaaacacgcgaacaccgtgtttgaaaatcgaacataagaggagagggcgcaatcgttagggtttccaagatggaaggcatggttgatcacctggctttcgagcggaacaattcgcagttcgatgtcgacgagatgaagatcgtttgggccggttctcgtcacgcttttgaagtatctgacaaaatggctcgcctcgttgccagcgatccggcattcagaaaggatgatagagttgtgcttgataggaaggctttatttaagaacactttgaggaaagcagcttatgcatggaaaaggattattgagctccgtctcagtgaagaggaagctgctatgctcagatcctttgtggaccaacctgcttttacggatctacattggggaatgtttgttcctgctatcaaaggacaaggaactgaggaacagcagaagaagtggttgcctttggctcataagatgcaaataattggttgttatgcccaaactgaacttggccatggatctaatgttcaagggcttgaaacaactgcaacctttgatcccagaacagacgagtttgtaattcatagccccacattgacttcaagcaaatggtggcctggtggattgggtaaagtgtcaacacatgccgtggtttatgcccgactaattactgatggccaagatcatggagtgcatggtttcattgtccagctgcggagcctggatgatcacttacctcttccaggcataactgttggtgatattggaatgaaatttggaaatggagcatataactccatggataatgggatgctaaggtttgaccatgtacggattccaagaaatcaaatgttaatgagggtttcacaggtaacaagggaaggaaaatatgtacaatccagtgttccacgacaattagtctatggtactatggtatatgtaagacaaacaattgtatctgatgcgtcagttgctttgtcgcgagcagtttgcattgctacaagatatagtgctgttcgaagacagtttgggtcaaaagagggaggtcttgagacacaggtgattgattataaaacgcagcaagctaggctcttccctttgttagcttctgcctatgccttcagatttgttggtgaatggttgaaatggctttatatggatgtgatgaaaagattgcaagccagtgatttttcaaccttacctgaggctcatgcgtgcactgcagggttgaagtccttgactacttcagcaactgctgatggaattgaggaatgccgcaaactatgtggtggccatggttacctttgcagcagtggtctccctgagttatttgcagtctacattcctacctgcacatacgaaggagacaacactgtgctgcttttacaggtggctaggcatctcatcaagactatttctcagttgggctccagaaacaagcctgttggtacaacatcttacattggacgagtggaacagcttatgcaatatcgttctgatgttcagaaagtggaggattggctgaagcctaatgcagtgttgggagcatttgaagctagggctgctaagaaggtggttgcttgtgctcaaaatctcagcaagtttaccaatcccgaagaaggtttccaagaactctcagtcgatctagttgaggcagctgttgctcattgccagttaattgttgtttccaaatttattgagaagttgcagcaagatatccctggaaagggagtgaaacagcaattagaacttctttgtagcatttacgctttgtttcttcttcacaagcatttgggtgattttcttgcaactggctgcatcactcccaaacagggttcccttgcaaatgagctgctgaggtccttgtattcacaggttcgtcctaatgcaattgcacttgttgatgcgtttaactacactgatcactaccttggttcggttcttggtcgctatgatggagatgtgtatccaaagctgtacgaggaggcatggaaggatccattgaatgattcagttgtgccagatggcttccaagaatatattcgaccaatgctaaagcaacaacttcgtaatgctagactctaaattacttttttataactgcactgttgatactggagaaagttatgtattgctttcaatttaaaagacagtaataaagttctacgaaagggaaacaaatttgacatcaactttgacaaaattgattatgaatagaattga

SEQ ID NO: 9365 - DNA, 2268 bp, Gossypium hirsutum
agtttcgttgttccctcattatttataaccaaatctgaaattacagaatacgaattctcttgctttttttttattgaattttcaatttggatcgagaaaaaaaaatggaggcattggattaccacgccgaagaaaggcgaaaggcagagttcgatttggaagagatgaagatcgtttgggctggttctcgtcaaaactatgaaatctccgatcgaatggctcgtctcgtcgctagcgatccggtctttcgaaaggataacagaactatgctaagcaggaaggacttgtttaaagatactttgagaaaagctgctcatgcatggaagcggataattgagcttcgtctctctgaagaagaggcccatatgctaaggtcttatgtggatcagcctgctttcacagatcttcactggggaatgtttctacctgcaattaaaggacaaggaactgaggaacagcatgagaagtggttgccaatggcatataagatgcaaataattggatgctatgcacaaactgaacttggtcatggctccaatgtccaagggcttgagaccactgcaacatttgatcctcagactgatgaatttgtcattcatagtccaacattgacttcaagcaaatggtggcctggtggattgggtaaagtatccacacatgctgtggtctatgcacgtcttataacaggtgctcaagaccatggagtgcatggttttattgtccagctgcgtagtttggatgatcactcacctcttccaggcataacagtaggtgatattggaatgaaatttggaagtggggcatataacagcatggacaatggtcttctgagatttgatcatgtgcgcattccaaggaaccaaatgctaatgcgtgtttcacaggttacaagagaagggaaatttgtgcaatctgatgtgcctcgccagctggtttatggcaccatggtctatgtccgacaaacaattgtatctgatgcttcttgtgctttagctagagcagtttgtattgcaacaaggtacagtgctgttcgtagacaatttggttcccagaatggcggtccagagacccaggtgattgactataaaactcagcaaagcagactctttcctttgcttgcttctgcctatgctttcagatttgttggtgagtggctgaaatggctatacactgatgtgacacaaagattgcaagccaatgatttctccacattacccgaggctcatgcatgtactgcagggttaaaatctatgactacttctgtaactgcagatgctattgaagaatgccggaaattatgtggtggtcatggttatctctctaacagtgggctccctgagttatttgcagtttatatacctacctgtacctatgaaggagacaatgttgtgctgctcttacaggttgcaagatttctcatgaaaaccgtttcccagctggggtcagggaagaagcctgttggaacaacagcttacatgggacgagcagaacacctcatgcagtgccactgtgaagttgaaagggctgaagattggctaaagccaagtgtaatattggaggcatttgaagcgagggcttttaggatgtctattgcctgcgcaaaaaaccttagcaaattttcaaacccagaagacggtttttctgaactttcgcctgatttgcttgaggctgcaattgctcattgtcaattaattgttgtttccaagtacattgagaaactgcaacaagacataccagggaaaggagtgaaaagacagttggagattctctgtaatgtatatgcttcgcatcttttacacaaacatctcggtgattttgtcacgaccagctgcattaccccgaagcaaggtgcactagcaaatgaacagctgagattgttgtactcccaggtccgtccaaatgccattacccttgtagatgcattcaattacaccgaccactaccttggctcggtcctcggttgctataatggaaacgtctatcaaaggctctatgaggaagcatggaaggatcctttgaacgatacagtcgtgccagatggttaccttgaatatgttcggccaatattgaagcaacatattcgcactgcaagactctaacaaataaccaaagcaccgtgccattttgaaccatatattaaggtcattaatgaataaagtgaagagatatctaccacctcaaaggtcaggtatcgctgctctagacttctagtatctccaatctcttggatgatggcattagttatttacttaaaaatcggggggtgga

SEQ ID NO: 9366 - DNA, 2248 bp, Solanum lycopersicum
tatcttttctttttttcaagaattcaattgggtatttgtaaaacaacccaagattggattttttttcattgtgtaagaattttggttttgatctgagagtaagagagatggagggtgtagattatttggctgatgagaggaagaaagctggatttgatgtggatgagatgaagattgtttgggctggttctcgtcatgattttgaacttacagatcgtatctctaagcttgttgctagtgatcctggcttcagtaaggagggaagaaccatgcttcctaggaaagagctattcaagaacactctaaggaaggcagcatatgcatggaaacggatcattgaacttcgtctatctcaagaggaagccactatgttaaggcgttacgtagatgagcctgcttttactgatcttcattggggaatgtttatacctgccataaaaggacagggcacagataaacagcaggaaaagtggctgccgctggcttacaagatgcaaataattggctgttatgctcaaactgaacttggtcatgggtccaatgtgcaaggccttgagaccactgccacatttgatcctcaaacagatgaatttgtcattcatagtccaacattgacgtcaagcaagtggtggcctggtggattgggtaaagtgtctacccatgctgttgtgtatgctcgtcttataacagatggtaaagactatggggttaatggttttattgtccaactacggagcttggaggaccacaaacctcttccaggtgttactgttggagacattggaatgaaatttgggaacggagcatacaattccatggataatggggtgttaagctttgatcacgtgcgcattccaagagatcaaatgttgatgagggtttctcaagttacaaaggaaggaaaatatgttcagtctgatattcctcgacaactcctttatgggaccatggtatatgtacggcaatcaattgtagcagatgcttcccttgcaatgtctcgggctgtgtgtattgcaaccagatacagtgccgttcgtagacaatttggctctcagaatggtggacaagaaactcaggtgattgactacaaaactcagcaaaacaggctcttccccttgttggcttctgcatatgccttcagatttgttggtgagtggctgaaatggttgtacactgatgttacccaaagacttgcagcaaatgatttctcaacattgcctgaggcacatgcatgtaccgcaggattgaagtctttgaccaccagtgccactgctgatggaattgaagaatgccgaaagttatgcggaggtcatggttatctttgtagcagtgggcttccagaattatttgccgtttatgtccctgcctgtacttacgaaggagataatgtcgtgctacagctacaggttgcaaggtttcttatgaagaccatttcacaactgggcactggaaagaagccagtaggtaccgtatcttatatgggaagaatcgaacacttgatgcagtgtcgttctgatgtgaaacaagccgaggactggctgaaacctagtgcagtattggaagcatttgaagcaaggtctgccaggatgtctgttgcctgcgctaagaatcttagcaagtttgagaatcaagaagaaggctttgcagaactagcagctgatttagttgaagcagcagttgctcattgtcaattaattgttgtgtccaagtatattgagaagttgcaacaaaacattcccggtaaaggggttaagcaacagctggaggtgctttgtggcatctattcactgttcattcttcacaaacatcaaggagattttctcgggactggctacatcacctcaaagcaggggtcgcttgctaacgaccagctcagagccttgtattcccagcttcgtccaaatgctgtatcactggttgatgcatttaactatactgatcactaccttggttcaattcttggacgttatgatggaaacgtgtatccaaaactgtatgaggctgcatggaaggatcctctcaacaaatcagacatagcagatggcttccacgaatatattaggccactactcaagcagcaactacgaactgctaagctgtgaagcgcgagagctgcagcaaactgttgttccgtgctgtgccaataaattagattttgaaatagcaacatcctttatgactattaagttgtgactgatagtattttgttctgaataatattattgaacttttgtaaggaaaactgtta

SEQ ID NO: 9367 - DNA, 880 bp, Cicer arietinum
catcatctccttcttttccatttttccacatacagagcgaaacaaagcattacactttcatcatcatcaatggctaccaccaaagtttacattgtttactattctacgtacggacatgttcataagctagctgaagagatacaaaaaggggcagcttccgtggaaggagtagaagcaaagctatggcaggtacctgaaacactgcctgaggatgtccttgggaagatgggagcacctccaaagagtgatgtgccaattattacacccaatgaactacctgaggctgatggtttgttgtttggtttcccaacaagatttggaatgatggctgctcaatttaaagcattcatggacgcaactggaggcttatggcgtacacaggcacttgcaggaaagcctgcaggaatcttttacagcactggttctcaaggaggcggacaagagactactccgttgacatccattactcagcttgttcaccatggattgatttttgtgcccattggttacacatttggtgctgggatgtttgagattgagaaggtgaagggtggctctccatatggtgcaggcacctacgccggggatggctcgagacaacctaccgagttagaattggctcaagctttccatcaggggaagtactttgcaggtattgcaaagaagctcaaaggatctcagtgatttttattctctatacgtaagcaaaagagtgccgtgttgtgcattacattcagtttccagtatgttcaacaaaataagatgttaattgaaaaagatgaaaaatatctaatgcttatgttcaatattacttgttacaaagtgaatcctcaaatacactgttattgttaataacaagaaaaaaaaaaaaaaaaaaaaa

SEQ ID NO: 9368 - DNA, 828 bp, Glycine max
cttctatagagacacacggagagagtctcagagcaataaacacccttcaatggctaccactaaagtttacattgtttactattctacgtacggacatgttgagaagttagctgaagagattaaaaagggagctggttccgttgaaggtgtggaagcaaagctatggcaggtacctgaaacactttctgaagaggtccttgggaagatgggtgcacctccaaagagtgatgtaccgattattacacccaacgagctacctgaggctgatggcttattgcttggtttccccacaagatttggacagatggctgctcaattcaaagctttcatggatgcaactggaggcctgtggcgcacacaggcactagctggaaagcctgcaggaatcttttacagcactggttctcaaggaggtggacaagagactactccgttgacatctattactcagcttgttcaccatgggatgatttttgtgcccattggttacacatttggtgctgggatgtttgagatggagaatgtgaagggtggatccccttatggtgcaggtacctatgccggggatggttccagacaaccaactgagttagaattggctcaagcttttcatcaagggaagtactttgctggcattactaagaagcttaagggatcatctcagtgagatctctatacatctaccatttcatgtttctatatacttaagcaagcaaaagagttatgtgcgtcatatgtccagtttccagttcataatttccaacagaataagatgttaattagagagagagaatgagagagagagagaaagtaatcaacacttgggtc

SEQ ID NO: 9369 - DNA, 1010 bp, Glycine max
ggatccaccagcatcaatacccacacacaccttgttttcctttctatagagacacacagagagagcaataaacacccttcaatggctaccactaccactaaagtttacattgtttactattctatgtacggacatgttgagaagctagctgaagagattaaaaaaggagctgcttctgttgaaggagtagaagcaaagctatggcaggtacctgaaacactgcctcaagaggtccttgggaaaatgggagcacctccaaagagtgatgtaccaattattacacccaatgagctacctgaggctgatggcttattgctcggtttccccacaagatttggactgatggctgctcaattcaaagctttcctggatgcaactggaggtctatggcgcacacaggcactagctggaaagcctgcaggaatcttttacagcactggctctcaaggaggtggacaagagactactccgttgacatctattactcagcttgttcaccatgggatgatttttgtgcccattggttacacatttggggctggtatgtttgagatggagaatgtgaagggtggatccccatatggtgcaggtacctatgctggggatggttccagacaacctactgagttagaattagctcaagcttttcatcaggggaagtactttgcaggcattgccaagaagctcaagggatcatctcagtgagatctttatacatctaccatttgatgtttctatatacttaagcaaaagagttatgtgcatcatatatccagtttccagttcctataatgtccagcagaataagatgttaattagagagagagaaaataattaatacttgggttcaatactgttgtgttgtcatttgtcataatgatgtatcctcaaatacaatgttattgtcaataacaataatttttcaattgttactattttcattgagatcaaagtgtttgtcataatattggtatggcggttaatcagcaaaaaaaaaaaaaaaaaaaaaa

SEQ ID NO: 9370 - DNA, 820 bp, Glycine max
ggaccgactccttttggttgctacagagacagggagacaagacagagtagtacagattactactaatggctaccaaggtttacattgtttattattctacgtatggacatgttgagaagctagctagagagatagaaaaaggggctgcttctgtggagggagtagaagcaaaactgtggcaggtacctgaaacattgcctgaagaagtccttgctaagttgggagcacctccaaagagtgatgttccaattattactcccaatgagcttcctgaggctgatggctttttgtttggttttcccacaagatttggatctatggccgctcaatttaaagcattttttgatgcaactggaggcctttggcgtacacaggcactagcaggaaaggccgcagggttcttctatagcactagttctcaaggaggaggccaagaaactaccccgttgacatctattactcagcttgttcaccatggattgatctttgtccccattggatacacatttggcggtggcatgtttgagttggagaaggtgaaaggtggctccccatatggtgcaggaacttatgctggagatggctcaaggcagcctagtgaattggaattggctcaagctttccatcagggaaagtactttgcgggcattgcaaagaagctcaagggatctcaatgatttttatcctccatatatctcccacaccatattctgtgtcaaataaaatgagatgttagaagcaaaataaaataaaagtgtgagagaataaagtaatacttcatatatcttcgatacaattgttgtcaccacttgtcatcgtc

SEQ ID NO: 9371 - DNA, 890 bp, Prunus armeniaca
actcacaacacgcacaaagcacaaagcgcatacacaacaaacacacagacgcaaactcttccatcaatggccaccaaagtctacattgtttactattctatgtatggacatgttgagaagctggccgaagagatactaaaaggagctgcatctgtggaaggagtagaagccaaactatggcaggtagcagaaacactgcaagacgatgttcttggaaagatgggtgcaccaccaaagagtgaagtccctataatttcacccaatgacctttctgaggctgatgggttacttttcggtttccctaccagatttggaatgatggctgcacaatttaaagcattttttgattcaactggaggcttatggagaacccaagcacttgcaggcaagcctgcaggaattttctacagcactggatctcaagggggtggacaagagactactgccttgacagcaattactcagcttgttcaccatggaatggtctttgtgcctattgggtactcatttggagctggcatgttcgagatggagcagatcaagggtggcagcccctatggtgcaggaacttatgctggggatggcacaagacagccttctgaactagaactacaacaagctttccaccagggaaagtactttgcgggcattgcgaaaaagcttaagggctcaactgtctgattatgatcgagtacacaattgctgttcagcttctattctgcattttttattttcttaattcccattccagatttcactttgcaacctcatgttttcgtaaaaaataatatgtactttgtcaaatacgtttgttgtaatgcgttttatgtcgactaaaacagtggctattactaaagatcaaagtttgtataaaaaaaaaaaaaaaaaaa

SEQ ID NO: 9372 - DNA, 871 bp, Vitis vinifera
acacagagagaaaagagagaagcgaaagaaagctttcaggagttcaacaatggtgaccaaagtgtatattgtgtactactctatgtatggacatgtagagaagctcgcagaagagataaagaaaggagctgcatctgttgaaggagttgaagccaaactatggcaggttcctgagacactaccagaggaggtccttggcaagatgagtgcaccaccaaaaagtgatacaccaataattacaccgactgaccttgctgaggctgatggatttgttttcggcttccctacaagatttggaatgatggctgctcaattcaaagcgtttcttgatgctactggtggcctatggagaacacaacagcttgcaggtaaaccagctgggatcttctatagcaccggatctcaaggtggtggacaagagactactgcgttgactgcaattactcagctggttcatcatgggatgatctttgttcccattggatacacttttggagctgggatgtttgagatggagaaggtgaaaggcgggagtccctacggtgcaggaactttcgctggggacggctcaagacaaccatctgagctcgaattggagcaagctttccaccaggggaagtacattgctggcatcacaaagaaactcaaggaagcagcttaatatccattccctattctgagattgttttgcattcttccattttttcacttctagaatttaagttccgtatttctatgtgattgccaaaaaaacaaaaaaaaaaaagaataattgttgctgtgtttggcatatgctctatgtgttgtatgtactcagaacattggtttctgttaatgataaagtaagattgctcatccaacttgaaaaaat

SEQ ID NO: 9373 - DNA, 612 bp, Gossypium hirsutum
atggcaaccaaagtgtatattgtatactattccatgtatggacatgtggaaaaactagcagaggagataaagaaaggggcggcatctgttgaaggtgttgaagcgaaactatggcaggtccctgagactctgtcagatgagattcttggaaagatgagtgcaccaccaaaaagtgatgtaccgatcattacaccacatgaccttcctgaggctgatgggtttatttttggcttcccaacaagatttggcatgatgtctgcccaattcaaagcatttatggatgcaactggtggtctatggagaactcagcaacttgctggaaaacctgctgggatattctatagcactggatctcaaggtggcggacaagaaactacaccgttgactgcaatcactcagcttgttcaccacgggatgatttttgttcccatcggatacagctttggtgctggcatgtttgagatggagcaagtgaagggtggaagcccttacggtgcaggaacctatgctggggacggaacaagaatgccatccgaacttgagttcgcgcaagctttccaccaagggaagtacattgccggaatcacaaagaaactcaagacagctgcctga

SEQ ID NO: 9374 - DNA, 1843 bp, Glycine max; identical to SEQ ID NO: 9357

SEQ ID NO: 9375 - DNA, 1689 bp, Glycine max; identical to SEQ ID NO: 9358

SEQ ID NO: 9376 - DNA, 1900 bp, Vitis vinifera
ggcagtccacagagagagagagagagagagagagagagagagagagaggattcaaacaaggaaaaaaagcatagaagattcaaacatcaaacaccttcttagccttcaaatatctccctctctttctctgttccttcctccaatccccatacacttccttccatgtcttcttcttctgcttcagcttagaacaagaaaggaaaaataaataaataaaaatgaagttttttcttctgattctgcctcttcttcagtccatttggagttttcacttctctattgttgaggccatctcagaccctcctctttcctctatatctgctcctctttcttcaccaccaattggggccacttcaccaatctcttcatcaatggctgccttctctccagctattcaagagggaagtgaagaaaatcagaaggattctcacaagaaaacgtttatagcactcactgttgcttctgctgcactgggtgtaaccatattgattctgttgtctctgtggattcataagaagtgctcccaaaaatcccacaagagcaatgctcagagctcagatgcagagaaagccctcactttaggtccattgttggctaaattcaacaccatgaaagtgattgggagaaagggttatgtctcttttattgattataaggtactagaaactgcaacaaacaattttcaggaaagtaatatcctgggtgagggcgggtttggttgcgtctacaaggcgcggttggatgataactcccatgtggctgtgaagaagatagatggtagaggccaggatgctgagagagaatttgagaatgaggtggatttgttgactaaaattcagcacccaaatataatttctctcctgggttacagcagtcatgaggagtcaaagtttcttgtctatgagctgatgcagaatggatctctggaaactgaattgcacggaccttctcatggatcatctctaacttggcatattcgaatgaaaatcgctctggatgcagcaagaggattagagtatctacatgagcactgcaacccaccagtcatccatagagatcttaaatcatctaatattcttctggattcaaacttcaatgccaagctttcggattttggtctagctgtaattgatgggcctcaaaacaagaacaacttgaagctttcaggcaccctgggttatctagctcctgagtatcttttagatggtaaactgactgataagagtgatgtgtatgcatttggagtggtgcttctagagctactactgggaagaaagcctgtggaaaaactggcaccagctcaatgccagtccattgtcacatgggccatgccacagctgactgacagatcaaagctcccaggcatcgttgaccctgtggtcagagacacgatggatctaaagcatttataccaagttgctgctgtagctgtgctatgtgtgcaaccagaaccaagttaccggccattgataacagatgttctgcactccctcatcccactcgttccagttgagttgggagggatgctaaaagttacccagcaagcgccgcctatcaacaccactgcaccttctgctggaggttgaagcatttttcaagctgctgcaccatttcaggaccttcatttctttgatcacagtttcaaaattccacgccctgtccatatttctcattgtttcttcagattattaattccttgattatttggatgaagaagagtgggtctgcttggagtgaactattgacttttatcacatatgtaaattgaggtaatctagatgagttgttctatagaattctggaaataattttgtgcatacaggtttcatcttggttcctctggttacatttcagactttatcttgttagtaaagggcacacctctaaaattttccctatc

SEQ ID NO: 9377 - DNA, 919 bp, Glycine max
  misc_feature (900)..(900): n is a, c, g, or t
aaggctgctgcttccggctcctctctgaatcctcaggggagcctaactttgtctagggatcttagcaggaaaactgttgatgaggtttggaaagatatgcaactgaagaaggtcactaatagggataaaaaaatccaggaaaggcaagctacactgggtgagatgactctggaggacttcttggtgaaggctggagtggttgctgaagctttgcctaccaagggtggggctatgtcaggggtcgattcaaatggggctttctcacaacatggccattggttgcaataccagcagctctcttcttcgacgcagcagccgaatgtgatggggggttatgtggctggccatgccattcagcagcctttccaggttggagtgaatctggttttggatgcagcatactccgagcagccggcttctttaatggggacgttatcggatacacaaactccaggtcgaaaaaggggtgcctctggtgttgtggtggagaaaactgtggagaggaggcagaagaggatgattaaaaatagggaatctgctgctcggtcacgggcaagaagacaggcatacacacaagaactggagattaaagtttcacgattagaagaggagaatgaaaggcttagaagactaaatgaaatggagagggcattgccatctgtgccaccacctgagcctaagccaaagcaacagcttcgcagaactagttcagccatcttttgatatcttaattgcaatgaattcctaattcttgcccatgctatcacattacaatacctctcatgtgcattatactcccgcctcttcaagtttggttatagatgggaggctattgtttgtgatgctatcagttctccccagcttgctctattctactaatgtttacctcttatgtatatnttgataagtttggcttaca

SEQ ID NO: 9378 - DNA, 1686 bp, Glycine max
tttttttttttttttgctgatctgaaaaaccattgttgaccaaaagtgcaaggtttacgcaacaggatacattaatgcattgatacaacacgacacaatgttcttctaggaaattctatactaatttttattttaaaatgaaagcatctgaaacactaaagcctctggtgctacaattgctgaaagaatacaatgaatttaatcacaaatcagcaaaaacatggtatgttttggagtctacagaaatgagccgtatggctgaaattgttgctgccagaggcataatggcaaagaaaccaatattgaaccggtgccagagcttttgtgagctgtttagtttgtccttctttgccttaaggtacatgtggtttgcaagaataaacgtaaggggaaatgtgctgatcgcccctgtgaggctcatgaaatctccaaggaatggcaggaaagccgccacaaatgtgttaaaggctaggtagccacctcttaccacgactcggaatgacaagtttttagcattcagtgcacttcctttgatcccatatttagtatccaaaaactcgtacattggacttgcaaaaatatgcaatgcaatgactgattgaagaaaggctgtgatgttggcagaagccttcacccaaactggaccattcacactattcagcaaatacacttctgtggaagatccataagcccagtatcctgtaaagacaaccaggtacaatggtagaactccaacggtaaactgaaagtacaaggctttcatcatgttcttaacaactggttgcctaattgttgcctgtatctcaggaagcatgccggtattaaatgcaaacacaaggttagcagatgctccaattattgtaaagattttgcttacaccatctcctggaatctcgtaatctcgaggcggtgattgtaatccatctttaagcgacaacacaaatgatataacaatatatgccaggctgaagactgttgaaaatcctagccaaattcccagagctgaaagatgaggaatgcagatggcaaacattgcacacacaaatccacctatggcaatacaatatggaagtttcagcagcccatcatccctgaatagaacataagtagctttcaaggctgaaccggccaaaatgatgtagccagtatttatcatgaaaagattgatatactgcagaacccatgtgagattatacgctttcttaccgtatataaatccagcaagatctctatacctaatgtgcctttggcctcctaattcatggagataagcaattagagcatttgcatagagtgacaccatggtagcaagaattagaccaatcacacccccgatccaacccaggggaaccatgacggtccctggatatccaagaacaaaggcactgttgattccggttgtgaggataaaagccacttgaaaccatgaatcagtgcttatctgatgagcggtatctgggacttcaacgtcccctcgtgcatcctcgtagtcatagaccttgtttgtctcgagttccatgtttccttttcccattatttgatgttgtcacacgaggttgtcgtcgtcttcgtagagcagcgtcacggtgagaagctgctcccaccaaacacaagccttgcagccagcgtgaaccaaggaaccaaaaagaaataaactctgttgtttgtctattcaaacactacccc

SEQ ID NO: 9379 - DNA, 1603 bp, Vigna unguiculata
ggcttgtcaccacctcaaacaatgggaagaggagacattgaactcgaaccaaacaaggtctatgaccaccatggtgcaccagacgttgaagttccaagtaccgctcatcaaattagcagcgattcatggtttcaagtgggttttatcctcacgactggaatcaacagtgcctatgtgcttggatattcagggactgttatggttccattgggatggattggaggtgtggttggtctagttcttgctaccataatatcactctatgcaaatgctttaattgctcaactccatgaacatggaggacaaaggcatattaggtatagagatcttgctggatttgtgtatggtaagaaggcctattctctcacatgggctctgcagtatgtcaatctttttatgataaatactggctacatcattttggccggttcagccttgaaagctacttatgttctattcagggatgatggtctattgaaacttccttattgtattgccatagctggactcgtgtgtgcaatgtttgccatctgcattcctcatctttcagctctcggaatttggcttggattttcaactatcttcagtctagtatacattatcatagcatttttgttgtcgcttaaggatggattacactcaccgcctcgtgattacaaccttctaggagatggtttcagcaaagtattcaccataattggggcatctgcaaaccttgtgtttgcatttaatacaggcatgcttcctgagatacaggcaacaattaggcagccagttgtgaagaacatgatgagggcactgtactttcagtttactgttggagttttaccgttgtacctagttacgtttacaggatattgggcttatggatccaagacatcggtgtatttgcttaacagtgtaaatggtccagtttgggtgaaggcttttgccaatattacagcctttcttcaatcggtcatcgcattgcatatctttgcaagtccaatgtatgagtttttggatactaaatatgggatcaaaggaagcgcactgaatgttaaaaacatgtcatttcgaatcgtggtaagaggtggttacctggcttttaacacatttgtgtcggctttcttgccattccttggagatttcatgagtctaacgggggcgataagcacatttccccttacatttattcttgcaaaccatatgtaccttaaggcaaagaaggacaaactaacaacctcgcaaaagctctggcactggttaaacattggtttcttttccatcatgtcttttgtagccacaattgctgccatacgacttattgctgtagactccaaaaattaccatgtttttgctgatgtgtgattaaattccttctattctctcagcaatagcaactccatagtttttagtgtttaaggtactttttgttttagcaataaagataagcatagaatttcctagtaggagattgtactgtaccaatgtattcatgtatttagttgaggaaaccttttagttttaatcaaaactggtcactctgatcagaagatatgcatatttggcggttcagctacgaaattgatcatatttgtgaaaaaaaaaaaaaaaaaaaaaa

SEQ ID NO: 9380 - DNA, 1779 bp, Vitis vinifera
agcgagtggctgtgcagccgaaccaaaaagaggcagattctgaaaatagcgagctgtgtgtacgcgattgggattcactcaggaattttacggttgaaagtgaatgctgcatttaaggaaagagagaggcgctggcgatgacatatcaacatatatcggaggccggaacgctcttggcagccgaagaagaagaagaagagggagaagaggctgtgcaggagcttatgatggaggggcctagctctgagtctcgggctccgaaggcaaatggtgaggcgcattcggcggttgaaataccagagacggcacatcagatcagcaaagattcatggcttcaagtcggttttgtcctcaccaccggaatcaacagtgcttttgttttggggtattctgggacaactatggttccccttggttgggctggtggtgtgattggttttcttttagccgcaggaatatcactttatgcaaattctctcgttgccaagctccatgaatttggtggaaagagacatattagatacagagatcttgcaggatatatatatggtaagaaagcatatactctgacttgggctttgcaatatgtaaatcttttcatgattaatactggatatctcattttggcaggtcaggctctgaaggctgtctatgttctttttagggatgatggtggcatgaagctcccatactttattgcgattggaggctttgtatgtgccatcttcgccataggaatcccacacttgtcagctctagggatttggctgggtttttcgacatgcttgagtctaatatatattgttatagcatttgtgctgtcacttacagatggaattaaagctccatctagggattacagcatcccaggaacagaagcaagcaaggtcttcagtattataggggcagctgctaatcttgtttttgcattcaacacaggaatgcttcctgagatacaggcaactattagacaacctgtggttaagaatatgatgaaagctctctacttccaatttactgctggaattctaccactgtatgctgttgtttttatggggtattgggcttatggatcaacaacatcaacctatttgctcaatagtgtctctggtccagtttgggttaagacaatggcaaatcttgctgccttcctgcaaacggttattgctttgcatatatttgctagtccaatgtacgagtatatggacactagatatggtataacaggaagcacattgtcctttcggaacttgtcattcaggattctagtgagaggcggttacctggccattaacacacttgtgtcagctatgctgccattccttggagatttcatgagcctcacaggagccattagcaccttccctcttacattcgtccttgcaaatcatatgtaccttgtggcaaaggacaagaagttgaactccttacagaaactctggcattggctcaatgtgtgtttctttggttgcatgtctattgcggcagcagttgcagccttgaggctcattgctgtggattccaaaacttacaatctgtttgccgatctgtgacaatatttaatgtttatatatcggcctccttgttcgcctagtaagtttttattttatttaaagcttcaaagctttaagcatatgcaaagctgttattaagctcccttttagcttaaaagttttaatgatagaacatgcatccatgatccctttaatgtcacaaatccatgattctttagtggatttatatagtttatatatatattttacagttcaggggattgca

SEQ ID NO: 9381 - DNA, 1801 bp, Arabidopsis thaliana
cccaccaataccaattttttaaagagatttctgtcacaagtaagaaagaagcactaattacaaaaaaaaagaaaaagaatcaatcttttgttcttcgattcgatttctaatcaattagattgtttttgttttgtttaacatcagttgcgaatcgagctggattcttgggctcgctttttctttcaatcaaaagtttcgatattagtgaaggataaaattcgctaaaaaaagagaattttttttgttaaaaaaattataaaagctggctttctcaaaatttctccatgtggtcgacgaagaagacgaagaagacgaagaagaaagagaaagtctcttagcaaacatgaccgccaccgaagctaagaatcgcaaaatcaatgtcggagatggagatgacgttgttgatatcgaaatccctgacactgctcatcaaattagcagcgattcatggtttcaggtggcgttcgttttgaccaccggtataaacagcgcgtatgtgttgggatattcaggaacaattatggttcctttaggttggattggtggtgtggttggtcttcttattgctactgcaatctctctttatgcaaacactctaatagctaagcttcatgagtttggtggcagaagacacattcgctatagagaccttgctggattcatttacggtaggaaggcttatcatcttacatggggattgcaatatgttaatcttttcatgattaattgtggattcattatcctagctggttccgccttaaaggctgtttatgtgcttttcagggatgatcataccatgaaactacctcattttatagccattgctggtttgatttgtgcgattttcgctattgggattcctcatttatcggctcttggggtctggcttggagtttcgaccttcctcagtctcatctatattgttgtggcaatcgtgctatcggttagagatggagtaaaaacaccttcaagagattacgagatacaaggatcatcattgagcaaactttttaccatcacaggagcagccgcaaatctggttttcgcattcaacaccgggatgcttccagaaattcaggcaacagtgaggcaaccagttgttaaaaacatgatgaaggctctatactttcaattcacagcgggtgttttaccgatgtacgcagttacattcatcggatattgggcttatggatcctcaacctcgacctatctactaaacagtgttaatggcccactctgggtcaaagcccttgctaacgtctctgctatccttcaatctgttatctctttgcacatatttgcgagtccaacatatgagtacatggacacaaagtatgggatcaaaggaaacccatttgcgataaagaacctgctgtttaggatcatggcgagaggcgggtacatagcggtaagcacgcttatctcagcgctgttgccgttcctcggtgacttcatgagcctaactggtgcagtgagcacattccctctcacattcattctagccaaccacatgtactataaggcaaagaacaataagctgaatgctatgcaaaagctatggcattggcttaacgttgtcttctttagtttgatgtctgttgctgcagccattgcagctgtcagactcatcgccgttgattccaaaaatttccatgtttttgcagatttgtaattcattatattatatagtcaattgtgtatcctttattcttaggcaggtttatttctcctgtaagcttgtattctctctctatttgtcttaccattagagcctaaataaataaatcaagttctaaaatct

SEQ ID NO: 9382 - DNA, 1682 bp, Arabidopsis thaliana
aattagattgtttttgttttgtttaacatcagttgcgaatcgagctggattcttgggctcgctttttctttcaatcaaaagtttcgatattagtgaaggataaaattcgctaaaaaaagagaattttttttgttaaaaaaattataaaagctggctttctcaaaatttctccatgtggtcgacgaagaagacgaagaagacgaagaagaaagagaaagtctcttagcaaacatgaccgccaccgaagctaagaatcgcaaaatcaatgtcggagatggagatgacgttgttgatatcgaaatccctgacactgctcatcaaattagtagcgattcatggtttcaggtggcgttcgttttgaccaccggtataaacagcgcgtatgtgttgggatattcaggaacaattatggttcctttaggttggattggtggtgtggttggtcttcttattgctactgcaatctctctttatacaaacactctaatagctaagcttcatgagtttggtggcagaagacacattcgctatagagaccttgctggattcatttacggtaggaaggcttatcatcttacatggggattgcaatatgttaatcttttcatgattaattgtggattcattatcctagctggttccgccttaaaggctgtttatgtgcttttcagggatgatcataccatgaaactacctcattttatagccattgctggtttgatttgtgcgattttcgctattgggattcctcatttatcggctcttggggtctggcttggagtttcgaccttcctcagtctcatctatattgttgtggcaatcgtgctatcggttagagatggagtaaaaacaccttcaagagattacgagatacaaggatcatcattgagcaaactttttaccatcacaggagcagccgcaaatctggttttcgcattcaacaccgggatgcttccagaaattcaggcaacagtgaggcaaccagttgttaaaaacatgatgaaggctctatactttcaattcacagcgggtgttttaccgatgtacgcagttacattcatcggatattgggcttatggatcctcaacctcgacctatctactaaacagtgttaatggcccactctgggtcaaagcccttgctaacgtctctgctatccttcaatctgttatctctttgcacatatttgcgagtccaacatatgagtacatggacacaaagtatgggatcaaaggaaacccatttgcgataaagaacttgctgtttaggatcatggcgagaggagggtacatagcggtaagcacgcttatctcagcgctgttgccgttcctcggtgacttcatgagcctaactggtgcagtgagcacattccctctcacattcattctagccaaccacatgtactataaggcaaagaacaataagctgaatgctatgcaaaagctatggcattggcttaacgttgtcttctttagtttgatgtctgttgctgcagccattgcagctgtcagactcatcgccgttgattccaaaaatttccatgtttttgcagatttgtaattcattatattatatagtcaattgtgtatccttcattcttaggcaggtttatttctcctgtaagcttgtattctctctctctttgtcttaccattagagcctaaataaataaatcaagttcc

SEQ ID NO: 9383 - DNA, 1715 bp, Arabidopsis thaliana
tgcaaataattcatacatacagacgtatcgatcttgctgacccatcaattaaattttgacccaaaaggtcaaattcactataagaaaaacagaattcatttcatcaaaattccatttcacactttttctgtctgttacgattcttgcttgatttctttctaaacaaagcaaaagttgtctttttggagttgtgagcaactaattctctgaaattgaggaagagaaagcgagaaggtttttttggagtcagagacagaagaagaatttaacagattcttgtcggaaacatggatacgagtgaagcaaggaaccgtaaagttgttgcagttgaacaattcgatctcgaagtccctgagactgctcatcagattagcagcgattcatggtttcaggtagcttttgttctaacgaccggtataaacagtgcctatgtgttgggatattccgggacagtcatggttcctttgggttggattggtggtgtggttggtctcattcttgctaccgcaatctctctttacgcaaacactcttatcgccaaacttcatgagtttggtggcaaaagacacattcgttatagagatcttgcaggcttcatctatggtaaaaagatgtatcgtgttacatggggattgcaatatgtcaatcttttcatgattaattgtggcttcatcatacttgctggttcagccttaaaggctgtttatgtactttttagagatgatagtctcatgaaactgcctcacttcatcgccatcgcgggtgttgtatgcgcgattttcgcaatcggtattcctcatttatcagctcttggaatctggctaggagtttcaacaatcctcagcataatctacattattgttgcaatagttctatcagctaaagatggagtaaacaagcctgaaagagattacaacatacaaggatcatcaataaacaaactctttaccataacaggagcagctgcaaatctagttttcgcattcaacacgggaatgctcccggaaatacaggccacggtgaagcaaccggtcgttaaaaacatgatgaaggctctgtattttcaattcactgttggtgttttacctatgtacgcggttacattcatcggatattgggcttacgggtcctcgacatcgacttatctcttaaacagcgtcagtggacctgtttgggtcaaagcactcgctaacatttcagcttttctccaatctgttatctctttacatatttttgcaagtccgacttatgagtatatggacacaaagtatggagtcaaaggaagtccattggcaatgaagaatctgttgtttagaacagtagcaagaggaagctacattgcggtgagcactcttctctctgcgcttttaccgtttctcggagatttcatgagccttaccggagcgataagcacgttccctctcacattcatattagcgaatcacatgtatcttgttgctatgaatgatgagcttagtcttgtgcaaaagctatggcattggctcaatgtttgcttctttggattaatgtctcttgctgctgctattgctgctgttagactcatctctgttgactccaagaacttccatgtttttgctgatgtttgattaaaatgtcttcgacatttttaacgatgtaatctttataccaattagaaaaaatttgtaatccttttgttgttacttttattatttcaaatgaaagaaattttttat

SEQ ID NO: 9384 - DNA, 807 bp, Glycine max
ggaagttcctttggcttttatatctcatcatatagttattgcttaattgcttccatagctgatggcgttttctcaggttatcacaacacttctttttgcattagctatagccagaattagcccctcagcatgccaaacggtagagggcaaagtctcttgcactgactgcgctgacaactacgatttctctggcattaaggtctcagtgaagtgtgaaggtgtgaaaaacctggctatggcgaccacagaagataagggcttctcccaggttgaccttccctcagaccaaacaaaacctccctcagtgaattgctttacaaaacttctcggggggccaaatactaatctttatgcctcaaagaaaaacctggtctctcaaattgttaagggaaaagagaaaaacacatacaccatctccactcctcttagtttcttcacatcgtgtccccagaacactgaatgcaaggctgctaattataaccagttcggttcatccaaaacctttgatcttccattgcctcgggagtggggtttggctcctagtagcttctatgttcctttcttccccatcatcggaattccttaattattgtgtacgtacgttccactgttatatgctcttgttctttaaatgtttatatatgcatgctgccatgtcatttgtgtaacttatgaaagaatgccatgtatatgcagttgtgtggtcttaaattttaatgcatgcagataaacgtcctgcgctgctttgtgcatttatatgtatcacccgtactatcttatgatcgatatttgatttgaaagcgctat

SEQ ID NO: 9385 - DNA, 1686 bp, Glycine max; identical to SEQ ID NO: 9378

SEQ ID NO: 9386 - DNA, 1292 bp, Glycine max
gggagcaccaactacctacccctttctttgattttgtgtcccaccctgcatcttagcagagccactctgatcactaaaatgccattgttaacttcctctttgttcaacatggttcctctcttctctcttcttttgttctcactcatgattcgttatagtacttctcaggatccaccttcacctggttactaccctagttccaaaattagtcccgttagctttggtgagggatttagaaacctttggggacctcagcatcagaaactagaccaagactcattaacaatctggcttgactcttactcagggagtggattcaagtcacttcactcttatcggtctggatactttggtgctgcgattaagcttcaaccaggttacactgcaggagtcataacatctttatacctctcaaacaaccaagactacccaggacaccatgatgaaatagacattgagttccttggtaccacgccggataagccatatgtcttgcagacaaacgtatacgtcagaggaagtggagatgggaatattatagggagagagatgaggattcacctttggttcgacccaacacaagattttcacaactatgctattctgtgggaacccagtgagatcatatttttagtggatgatgtcccaataaggagctatcctaggaagagtgatgccacgttcccctcaagagaaatgtatgtgtacggatcaatatgggatgcatcttcatgggctacagagggaggaaaatacaaagctgattataattaccaacccttctttggtagatacaaaaacttcaaaatacaaggttgtaccactgaagcttcaacctcatgccagccaccatctccctcaccaccaggctatggcagcctaagccctcagcaactttctgcaatgcaatgggtccaaaacaactacttggtctatgactattgccatgatcctggaagagaccatacacttactccagaatgctaaggttttaagctatatttggattgaaattgggaaagtatatttttataaaattctatacacaattgcaaatacagaatgaaaaaggaataatttgttgctttgcaaataaaattacttttgagctttcccaattgaaatccaagcatgcacttaattagtttggttcaagagttggtgtgtttcaaagttatttgttatttttcacatattaccaaaacagtttattaagggggtggattttgtgatggtttgctaatgctaagtgtaattgcaacaacagtgagcgtccaagttcccctcaaaaa

SEQ ID NO: 9387 - DNA, 1399 bp, Glycine max
ggaagcagcatcaactaaacctaaaatcttctgccccacccagcattgtagcagagtgattctgttcactacaatgccatcatcactatcctctttcctccgtatggctcctattctctcccttcttgtactctcatgtgtgatttgttctagtagtgctcagggaccaccttcacctggctactatcctagttctaaaattagtcctgttagtttttatcaagggtttagaaacctctggggatctcagcatcagagactagaccagggctcattgacaatctggcttgactctaactcaggaagtggattcaagtcacttcactcttatcgatctggttactttggtgctgccattaagcttcaacctggttacactgcaggagtcattacatcattatatctttcaaacaaccaggaccaccccggaaaccatgatgaaattgacattgagttccttggcaccactccagataaaccatatgtcttgcagacaaatgtatacataagaggaagtggagatgggaatattattggaagggagatgaagtttcatctttggtttgacccaacacaggattttcacaattatggcattctatggaaaccgaatgagataatattttttgtggatgatgtccccataaggaggtatcctaggaaaagtgatgccacatacccctcaaggccaatgtatgtgtatgggtcaatatgggatgcatcttcttgggcaacagaggatggaaaatacaaagctaattataattaccaacccttcgttggtaggtataaaaacttcaaacttcaaggttgcactagtgaaagctctgcctcatgcaagccaccttctttctcgccatctggctttggtagtctaagccctcagcagtttagggcaatgcaatgggtccaaaacaactacatggtctacaattattgccatgaccctaggagagaccacacatttatcccagagtgttagggtctatctagttcacgcctgtttggaaattcgttgagaagaaaataattacgtctaagatgtgaaagatataattattagtttctgaagatcacattcgagatgtgaaaaatgtgaaaccaattaagctatcatgttggtgtgtctcaattccaagttaccctatacactttgcatatttgaattgtaaaatggttttgtttattcaggtggtggtggtggtggtttttgtgatggacccatttgctaagtataattgcaagagtagttgagcgtccaagcccccgttcaagccactccaatgattggaatgtttttgttgtttatgtaatttgtgttgtagtattgtttgggtcctataatactgttcaaataaattgattcagatgctttcctcaaaaaaaaaaaaaaaaaaaa

SEQ ID NO: 9388 - DNA, 1031 bp, Vigna angularis
agcagagtcattttgttcctacaatgtcatcatcactatcctctttcctcccaatgcttcctgttctcttccttcttgtactctcatgtatgatttattctggttctgctcagggaccaccttcacctggctactaccccagttccaaaattagtcctattagcttcaatcaaggctttaaaaacctttggggacctcagcatcagagaatagaccaaggctcattgacaatatggctagacactagcacagggagtggattcaagtcacttcactcttacaagtctggatactttggtgctgcaattaagcttcaacctggttacacggcaggagtcattacatctctctacctttcaaacaaccaagaccaccccggaaaccacgatgaaattgacatagagttccttggtaccacgccagacaagccatatgtcttgcagacaaatgtatacatcagaggaagtggagatgggaatattataggaagagaaatgaggtttcatctctggtttgacccaacacaggattttcacaactatgcagttctatggaaaccttctgagttaatattttttgtggatgatgttccaataagaaggtatccaaggaaaagtgaggccacataccctacaaggccaatgtatgtgtatgggtcaatatgggatgcatcttcttgggcaacagagggtggaaaatacaaagctgattacagataccaacccttcgttggtaggtacaaaaacttcagacttcaaggttgcaccagtgaaagctctgcctcatgccacccaccttctacatcttctggcttcggaagtctgagccctcagcagttcagggccatgcaatgggtccaaaccaactacatggtgtacaactattgccatgatcctaggagagaccacaatctgatcccagaatgctgagccaaagttgtttttcatgttggtgtgtctcaattctatgttaccctttatatacttaaaaattgaaactttgaaacggtgttggggttgaactttgaagtg

SEQ ID NO: 9389 - DNA, 1267 bp, Litchi chinensis
atcataggcatatcacattacacacattttccaattctgtgtctgaaacttgctttcatggctgccattgttgtctatcttcttctcattctcatgatttcttcaaatactggcgctcaaggtggtccaccttcaccaggctataaccccagctcaagagtcagttctttaggcttcaatcaagggttcaagaacctatggggtcctcagcaccagagactagaccaggacacattaacaatctggctagatcaaagctcaggcagcgggttcaagtcacttcaatcatatcgttctggttactttggcgccgccatgaagctccaacccggttacactgctggagtcattacatctctctatctttcgaacaaccaagatcatccgggaaaccatgacgagattgattttgaatttctgggaaacacgactggtaagccctatactttgcagaccaacgtgtacatcagaggaagtggagatggaaatattattggaagagaattgaggtttcatctctggtttgatcccacacaagactttcacaactatgctattctatggacccccagtgagatcatattcctagcggatgatgtgccaatcagaaggtatccaagaaaaagcgatgcaacatttccattaagacctatgtatttgtatggctcaatatgggatgcatcatcgtgggccactgaagatggaaaatacaaagcggattaccaataccaacctttcgttggtaggtacaaaaatttcaaactaggtggctgcaccgccgacgcgcccgcctcatgcaccccgccctccgcctcaccatccggttccggcggcctgagccaacaacagattgcggcaatgcaatgggttcagaggaactacttggtctataactattgcagtgaccccaagagagaccatacactagtaccagagtgttaatgttgtttaattttataaggtggtgtcatttttatttaaacagtaacattgggaggtgttgaaacagccagaagcaatgtgtttgttaatgattttggaggggtcttgagatgggttccacttgccaaaaaaaagtgcaagagtagttgagcgtccgaggctccatagatgttaagggttttgccatatgtatttgtcgtcttttaaaattattgctgttgtcttattgtttatcttgtattgttgtgatattggaaatttggaatgaattagattggtaagtgtttctgtaaaggaacaaaagtaaaaaaaaaaaaaaaaaaaa

SEQ ID NO: 9390 - DNA, 1358 bp, Carica papaya
ggcacgaggttttcacaatctgcatttaagcacatatagctatacatacatacatatatatatagataattcgcaatggcaaagcttagttgtgtgttaatggctccactactattctcttttctgctcattctcatggtttcttctcagggtcctccctcaccagggtactatcctacatccagattcccgtctttaggttttgatcaaggattcagaaatcgttggggtcctcagcaccagagagtagaacagggtgtcctaacaatctggcttgattctacctcaggaagtgggttcaaatcacttcatacatatcaatctggttattttggagctgccattaaacttcaacccggttatactgctggagtaattacatctttctatctttcaaataatgaagattatccaggaaatcatgatgaaattgacattgaatttctgggtacaactccaggggaaccctacactttgcagacaaatgttttcataagaggaagtggagatagaaatatcgtcggcagggaagtcaaatttcatctctggtttgatccaacacaagacttccataactatgctattctctggaccccaagtgagatcgtattttttgtggatgatgtgcctattcggaggtatccaaggaagagtgatgccacatttcccttaagaaccatgtgggtttatgggtcaatttgggatgcttcatcttgggctactgacgatggaaaatacaaagctgactaccaataccaaccctttgttggtaggtataagaatttcaaaatagccgcgtgcagagccgacgggcaagcttcctgtaggcccccttctgtgtctccatctggctttggcgtgttgagcccacaacaagaatcggccatggaatgggcacagagaaattctttggtttataactattgtttagaccctaagagagatcataccccaacgcccgagtgttgaaaaaaataaaaatcattacatgtttttgggctaaaaatggcttccaatacccccaacatgtgatctgtttgtgttaaaattaagtgagataaaatatgatgtgaaatgagaacaaaaaaaatatatattttttttttatgtgggtaagtgtatgtatatgttaagggggattgtgtatattgaggtggaacaagttacccaaaatatataggagttgtttgtttgttttgttatgggtatggttccgcttgccaagaataggtgcaggagtagtagttgagcatccaaggcctccaaaagatttgaaagggtttttttgtcttttatcaaatgttgatgcaataaaattgctacgatttatgtgttccaaaaaaaaaaaaaaaaaaaaa

SEQ ID NO: 9391 - DNA, 1229 bp, Tropaeolum majus
ccttattcacttcacaaatgccttctccctccataatgcctcctaacattctatccatttttcttcatcttcttcctattctaatgttttcttcaagctgtttgggtcagggcccaccttcaccaggatattaccctagtagccaaatcacttccctaggctttgatcaaggctatacaaatttatggggtcctcaacatcaaagggtagaccaaggctcattaacaatatggcttgattctacctcaggaagtggattcaaatcgattaaccgatatcgctctggttacttcggtgctaatattaagttacaatctggatacactgcaggagtcattacatctttctatctttcgaataaccaagactatccaggaaaacatgatgagatcgatattgaattcctcggaacaatacccggaaagccgtatacattgcagacgaatgtttttatagaaggaagtggagattacaatataatcggaagggaaatgagaattcatttatggtttgatccaacacaagattatcataactatgctatttattggacaccaagtgagatcatattttttgtcgatgatgtaccgataaggaggtaccctagaaagagcgatgctacatttcctttgagaccgttatgggtgtacgggtcggtgtgggacgcgtcttcttgggctactgaaaacggtaaatacaaagccgattatcgataccaaccttttgttggaaagtacgaagatttcaagttaggttcgtgcaccgtggaagcggcttcgtcttgcaatccggcttcggtatcaccttatggtcagttgagccaacaacaagtcgcggcgatggaatgggttcagaaaaattacatggtttataattattgtgatgacccgacacgagaccacacgttaacacccgagtgttaagatttcatgtcgactaaaaaaacacagcaaaagaacaaaaagttttatgggtttcaataatttttctgaaaaaaaaatgatttttctatttggatttaatttgataaaaaaaaaaaaagggtttgttgttgttgttgtttaataatggatgacttgagatgggtctacttgccaagaaaaaggtgcaagagttgttgggcgtccaagcattcaagaactttgaaggttatgttgggggctgttttgttttttttttaatatatgtataattgatcatcttttatattttaaatgaatttattgaat

SEQ ID NO: 9392 - DNA, 1275 bp, Vitis vinifera
ttattccttcttaattttcatggctccccttctctgtcttctcattctcatgatcactacttgcagcgatgctcagggtccaccttcccctggtttctcccccagttccaaatttagtcctattagctttaatcaaggttttagaaatctctggggttctcagcatcaaaccatagaccagggtttattaacaatttggcttgacagtacctctggaagtgggtttaagtcgcttaagccctatcgttcaggttacttcagtgctgccatcaagctccaacctggctatactgcaggagtgatcacatctttctatctttcaaacaacgaagactaccctgggaaccacgatgaaatcgatatcgagttcctgggaacaacactggataagccttataccctgcagaccaacgtgtatatgaagggaagtggagatggaagactaatagggagggaagtgaagattcatctctggttcgatccaacagaagactttcataattatgctatcctatggaccccagatgagatcatattcctagtggacgatgtccccgtaagaaggtatccaagaaagaatgacgctacatttcccgcaaggccaatgtgggtgtatggatcgatatgggatgcgtcatcatgggccacagaggatggaaaatacaaagccgattaccggtaccaaccattcataggtaggtacaaaaatttcaagctaggcgggtgcaccaccgatgcagcagcctcctgccggccaccctccatctcgccgtcctccgcaggaggcctgagccaacagcagtactcagcaatggaatcggtgcagaagaattacgtggtttacgactattgccaggaccccaagagagaccactctcagataccagagtgttaggtagatgttgataaaaagactaaagagtgggttggttatacacagttataagttgttacttaagttacaaagacagtttgttttggagtgcattgtgatgggtccagcttgccaagaacaggtgcaagagtcgttgagcgcgcgtccaagcctccaagatttgaatcgcttttgttggattgttgttggaataaattatttgcttgctattttggttaaaggataggcgtgggtgtgagtgtgacaaatgagagaggtctttgggtatttgtgtatacactctgctattacttaataaagcagagaaagaattgtgattgtgtaccaattacttataatattattacattataaagattgataaggtctctttaaactct

SEQ ID NO: 9393 - DNA, 1603 bp, Vigna unguiculata; identical to SEQ ID NO: 9379

SEQ ID NO: 9394 - DNA, 1008 bp, Glycine max
cttcccctaactaacaccactaacaacaatcactaaaaaaagaaagaaaatttaccctgatcgcaggatctccgaacaaagctttgatttcacaaaagctaaatttagataaacacctgcatattaaatttttctgctctatacatgcatcacatgtccctcacactaaacaaaagaaaaacaccaccaccctttgcttttgcttttctataagtagtcaacggctcagccttaatttctttgctttttttaggttaaggtacatggtgagggagaagattcagattaagaagatcgacaacgccacggcgaggcaggtcacgttctccaagcgtcgcagagggctcttcaagaaagctgaggagctttcggttatgtgtgatgctgatgttgccctcataatcttctcttccactgggaagctctttgagtactcaagctcaagcatgaaggaaatacttgaaaggcatcatttgcactcaaagaacctagcaaggatggaacaaccatctctcgagttgcagctagttgaaaacagcaattgctctagattgagcaaggaagtggctgaaaagagccatcaactaaggcagctgagaggagaggatcttcaaggcttaaacatagaagaattgcaacaattggagaggtctcttgaaactggattgggccgtgtaatagaaaagaagggtgagaagattatgagtgagatcactgatctccaaagaaaggggatgctattgatggaagagaacgagcgacttaaacgtcacgtggcgggcataattaatggccaaaggcatggtggtgccgaatctgagaactttgttatggatgaaggtcagtcttcagagtctgttacgtacgtttgcaattccactggacccccccaagactttgaaagctcagatacttccctcaaattggggctaccatactccggctgatgagaaagtgtgtggggcgataaaattaacccaggcaaaaattcacaagattatgatataa

SEQ ID NO: 9395 - DNA, 1041 bp, Vitis vinifera
gtggttttttttttttttcccagttttttctggtcataattgtgctcggaaggagctgaaatggcgagggagaagattcaaatcaagaagattgataacgccactgctaggcaagtgaccttttctaagagaaggaggggacttttcaagaaggctgaggagctctccgttctctgcgatgcggatgttgctcttatcatattttcttccactggcaagctcttcgagttctcaagctccagtatgaaagagatacttgagaagcatagtttacaatcaaagaaccttgagaaacttgagcaaccatctcttgagttgcagctagtagaaaacaacaatcactccaggttgagcaaggaagttgcagataaaagccataagctgaggcagatgaggggagaagaacttcaaggattaaatatagaagatctgcagcaactagagaaatcccttgaagctggattgagccgagtgatacaaaaaaagggtgaaagaatcatgaaagagataaccgatcttcagtcaaagggtgtccaattgatggaagagaacgagcgattaagacaacaagtggtagagatttccaaccgccgaaggcaggttgctggtgattcagaaaacatgttccacgaggaaggccaatcatctgagtctgtaaccaatgttagcaactccaatgggcctccacaagactatgaaagttcagatacatccctcaaattggggctgccatactctggttaacgggtataaccagtggaggaagtcgggaactactgtggctgaagagactggagtttttcaggaacatcaactcaattaaatggaatgtaaaattaacccccacgctatatgttaaatatacacacgattacaagtcaatgagacggtaatatttcaaggtgcaagttgaaccttgtcaatgcactctggtatatatatctagtgtcctttatagcaaagcgggtatagtgatggaatcgatgccatggtgtgacagcacattatagcatatgacggcgccttccactatttttttca

SEQ ID NO: 9396 - DNA, 646 bp, Pisum sativum
atggctcgagaaaagattcaaataaagaagattgaaaacgcaacggcgaggcaagttacgttttcaaagagacgaagaggtttgttcaagaaggctgaagagctttccgttctctgtgatgctgatgttgctctcatcattttttcttctactgggaagctctttgaatactccaacttaagcatgagggaaatacttgaaaggcatcatttgcactcgaagaatttggctaagatggaagaaccgtctctcgagctgcagctagttgaaaacagcaactgtacgagattgaacaaggaaattgctgagaagagtcatcaactgaggcagatgaggggtgaggatcttcaagggatgaatgttgaacaattacaacacttggagaggtctcttgaaattggcttgggtcgtgtaatagaaaacaagggagagaagactatgatggagatccaacatctccaaagaaagggaagacaactgatggaagagaatgatcgactaaagcgacatgtgacgggcatgatgaataatggcaaaattgttggaggagttgaatgtgagaatgtggttattgaagaaggtcaatcctcagaatctatcactaacgtttacaactctactggtcccccccaagactatgagagct

SEQ ID NO: 9397 - DNA, 727 bp, Petunia x hybrida
catggcgagagagaagattcagatcaagaaaattgataacgcaacagcaaggcaagttaccttctcaaagagaagaagagggcttttcaagaaagctgaagaacttagtgttttatgtgatgctgatgttgctctcattattttctcatctactggcaaactctttgagtattctagctccagcatgaaagaaattcttgagaggcgtgatttgcattcaaagaatctggaaaaattggatcaaccatcacttgagctgcagcttgtagagaacagtaattactctagacttagcagggaaatttctgagaaaagtcatagattaaggcaaatgaggggagaagaacttcaaggactaagtattgaagagttacaacagttagagagaactcttgaagctggattgggccgtgtcatagagagaaagggtgataaaataatgagagagatcaaccagcttcagcaaaagggcttggaactaatggaagagaatgaaaaattgaggcaacaggtgatggagatttctaataatggctacaagaatccagcagcagcagtagtagcagttgaattagaaaatgcagcaaatgaagaaggtcaatcttctgaatctgtcactaatgcatgtaactctactggccctcctcaagatgatgacagttccgatacttctctcaagttggggctaccctactcgggctgaagggaggaacaaatgcttattgcc

SEQ ID NO: 9398 - DNA, 3772 bp, Antirrhinum majus
cagacacacatgatagcacagtaccacagtactactactactactactccaaccacccctaaactagtaaaaaagtagatatcaaaaaatcctctcacaaccaatctctcttcttcctttccttctttgtatccattaattaatctgtcttaaatctctcagacaaaaatctcctccactcatctggatctgaatgaagtgcctcattctctctctaatttttgatattatgagtcttttccatttctttctatcttaagggtttattccatattcccactctaaaaatggcaaaaatgccgcctttctaattccacccacaaacgccacaaataaaaaaaaatcccatttctggaaatctttaatatcacatcatttttccattaagtagtattttggtttgacattccttgtttgtcttttgtgcaagtgggattttgttgtagctaatcttcaataaattgtaatccatttttgtgtgtgaagtgaattataataaaatggctagggagaagatccagatcaagaaaattgataacaccacagcaaggcaggtgactttttccaagagaagaagagggctttttaagaaagctgaggaactagcggttctttgtgatgctgacgtggctctcatcatcttctcatcaactggcaagctctttgagtatgccagctccaggtataaaattaaaatatgttatctttttttaggggtttgatgtattggtggttatggttgattaattccttatgacattaatcataggtttttttttttttttttatcatagtttttataatattcctgatgatcttctgatattatattatgttggctactataatctgacacatagtcatggcacttcttacatgatctgatcgtcagtttcattattgaaatattacttgttactctattggaagagtgcagattatttacttttgcctgttcactctttgctactcttaagttaaacaatgtcaagttggttctgatgttatcttggaatttgttgctttttttcctgctatagtctttctgaataagcttcatttgtgaaaaataacttctttttcattccataaatattaatggtagtcttattttatgatccaatttgaaatctgaggagtttgaagagacacttaactagaggtgccaaatcttttggtttacttttcagtagggtttggtagttatgtggttatggtggtgccacatgttctaaaatttatgatatttaaagacatgaaatgaatttagttgtcagttcattgttggtagacctggtctaaataagtttttttcgtttttctactatatgtctggacaattgatctataagtaactaaggtaagttgtccattttgcatacttctgtgtggctttaatgtttctactttgcatgtaaaaggccttcatgaaacttaccaaaattctgtaatgaaccatgtttgttgataaaaaaacacggggtataataaaacacaagggtttggtgcaggtttcaacccctacatttgaactgttaaatgctattcttgttaaagtcttatgttgcttttgcattaacacaagtattatcctctaatggagtaaactatggtatattttggtacggatgatggaaatacatagtatgcttaatggactaccaggacgagcaattatgtaacttctctcttttttttttttctttttttgatcaaatgaagtatgaaggaaatacttgaaaggcataatttgcactcaaagaaccttggtaagatggaacagccttcgcttgagcttcaggtaccctaaactccatcctatttctgattttatatggggttgatcaattacattacgccactttatcactttacaactctattctcgggctcatattctacaaaacaattccatctcctgtgagaatgtcgtttagaattgatgacaacaatgaaattctgattcgacattagcaatatttatggttgtaacaaactttaattccttaaaagctttttaaaaacacatgaaaatctgatataaaaagatgcaactttgagtttcaaaacaacaacgaatgacatttgtatcttccggtgcttctaattcacaaggttgttattttaaatgttaaaacgtggaattgtgtaatttcatcaagcattagggttacaactgtaatgcgacatgtatatattaacgaaaaaaggtggattttgtgttcatttctttgttaattaccagttttcactaatggcaatatcctttattttcatttaattggtaaaagaagtgtgaaattgatacaacttgtttttttttttttttttttgatgaatgatgcagcttgttgaggacagcaactgcaccagattaagcaacgaggtggctgaaagaagccaacaacttaggtatgtgttcctcctcaacgactatatatatagacgatggtgttcgtaaaaataatgaagaacatttcctttggacaggcgcatgagaggagaagagcttcaagggttaaacatggaagagttgcagcgtcttgagaggtcacttgaagttggattgagtcgcgttttagacaaaaaggttggtgcatgttcggcagtgtactgatactatgatatatgtacccttgattaaaatattttgatctgtcacagggcgagaaaatcatgaacgagatcaatcaacttcaagaaaaggttggcatttcaataaactatagtaaataatccgtgatcatatattgacatataatatgttatatttgaaaatatgttaaacagaaagcatgtcttttaatgaaatatgcagggaatgcaactcatgcaagaaaatcagagactaaaacaacaggtgagagttagatatattttacctcattttccctcgttttttccatctgatcaaatcttctgtaccaaatggttatacaactctctgtaccaccgccttgatttctgtcaaggtgcaataagtgtatggtaaagatgtagatgcttatttctttaagtgctcattgtcgcgtgcataaatatctcactacacgttatatccacgtgacgtaaatctggcaatggtacgagtttggtacaaaaaatgatgtacgattttgacacaaaagatttgcgcgtcttttttctgtcaatacaacacaaaacatgtacatgcttatgaaataaaggaaattttctgtgtcatttctttataaggtggtggatatatcaaattaccaacaaatcacggcaacgcctgattcagagatcattcatgtgtacgaggaaggccagtcatcggagtctgtcacttacacctgtaactctactggacttccacaagattatgattgttcagatacatatcttaaattggggtgagtttctcattgcaaaaaagtcacaacgaatcgtctaagccactttgtaacactccatgtgccaaataaaccaattcatcctttgtttattaagactcgggacacgtgttattatcacaattaaatgacacgtataataacacaaaaagggtttctgatctttacccgttaaatgacttaagctttaatggtaataataacttttttgcaggttgccatactctggctgaaactgaaggagagatcacattgtgtaagaacagatgatgtctgatcttataagacattgactcctaatgaagggatttaaagctaactccaaagaattattgagcttactgtgtatgtaacggactgtagcaacatatttttatgtttgccttatctatgta

SEQ ID NO: 9399 - DNA, 686 bp, Misopates orontium
atggctagggagaagatccagatcaagaaaattgataacacaacagcaaggcaggtgactttttcaaagaggagaagagggctttttaagaaagctgaggaactagctgttctttgtgatgctgacgtggctctcatcatcttctcatccactggcaagctctttgagtatgccagctccagtatgaaggaaatactggagaggcataatttgcactcaaagaaccttggtaagatggaacagccttcacttgagcttcagcttgttgaggacagcaactgcgccagattaagcagagaggtggctgaaagaagccagcaacttaggcgcatgagaggagaagagcttcaagggttaaacattgaagagttgcagcgtcttgagaggtcacttgaagtcggattgagtcgcgttttagacaaaaagggcgagaaaatcatgaacgagatcaatcaacttcaagaaaagggacagcaactcatgcaagaaaatcagagactaaaacaacaggtggtggacatatcaaattgccaacaaatcacagcaacgcctgattcagagatcattcatctgtacgaggaaggccagtcgtcggagtctgtcacttacacctgtaactctactggacttccacaagattatgattgctctgatacatatcttaaattggggttgccatactctgg

SEQ ID NO: 9400 - DNA, 675 bp, Malus x domestica
atggcgagagagaaaattcagataaagaagatcgacaacgccacggcgaggcaggtgaccttttccaagaggagaagaggccttttgaagaaggccgaggagctctccgttctctgcgatgccgatattgctcttatcatattttcttccaccggaaagctctttgaatacgccagctctagtatgaaggaaattctagaaaggcacaacttgcattcaaagaatctcgagaaactagaacaaccatctcttcagctacagctagtggagaacagcaactacaccaggttgagcaaggaaattgcagcaaaaagtcatcaacttaggcagatgagaggagaagaaattcaaggactaaatttggaagaactccaacaattggagaagtcacttgaaactggcttgggccgcgtaatagagaaaaagagtgaaaaaatcatgaaagagatcggtgatcttcaaagaaatgggatgcaattgatggaagagaatgaacgattaagacagcaagtggcggagaaatctgatggccggaggcttgttcaggtcgattcagagaacatgtttacggaggagggtcaatcatcagagtctgtcaccaatccctgtaactcaaacaacggtcctcaagactacgacagctcagatacatctttaaaattggggtgcgtttaa

SEQ ID NO: 9401 - DNA, 1165 bp, Paulownia kawakamii
ggcacgagcacgcacaaaacacactttatatagaaacccttttctcttctccactgctacgacgcttatcattccattttgtgctggtttattccgcctgttcaagtgggaaagcaatataactgttgtggtaaagtttccataaacatggcgagagagaagattcagatcaagaaaatcgacaacgccactgctaggcaggttactttctccaagcgaagaagagggatcttcaagaaagctgaagaactctcagttctttgcgatgctgatgttggcctcatcatcttctcctccactggcaagctctttgagtatgctagctccagtatgaaggaaatacttggaaggcataatttacactcaaagaatctcgataagttggaacaaccttcacttgaactgcagctagtcgaggacagcaactactcccgattaagcaaggaagtggctgagagaagccatcagctaaggcgcatgagaggggaggagcttcaaggattgagtattgagaagttgcagcatctgaagaagtcgcttgaatctggattgagccgtgttatagagaaaaagggtgagaaaattatgaaaggagatcaatcaacttcaagaaagggaaagcaactcatggaagagaatgaacgactcagacaacaggtggcggatatatcaaatgactgcaaaaacaatgcagcatctgattcagagaacatagtctatgatgaaggccaatcatcggaatctgtcaatgcctgtaactccgtcggccctccacaagattacgatagctctgatacatcacttaagctggggctgccttactctggctaatgccaaaggagctcaatgtgcaaggactgttgatgttcaaatttacagggctaactccaaagatttagatgaatgtacaagacagtacaagagggaactgttcctacatgttctctgtaacttcctagtatctgtatgttttaccagatgatgcagatgccttaatgttgttaataggcttatgacttaagagatgccaagtgttgaacgagataaattggcacattatggaactgtggaagcatgtgataggactaagcgtgtttgcgttatttgcaatagctctcatagtatagttgtagtgatatatttcgccaaaaaaaaaaaaaaaaaa

SEQ ID NO: 9402 - DNA, 708 bp, Eucalyptus occidentalis
atggcgagagaaaagattcagatcaagaagatcaccaatgcgacggcgaggcaagtcactttctcgaagcgacggagaggactcttcaagaaggccgaggagctgtccgtgctttgcgatgccgatgtcgcgctcatcgtcttctcttcttctggaaagctcttcgaatactgcagttccagcatgaaggaaattctcgaacgacatcattcgcactccgagaatcttgggaaactggatcaaccatcacttaagttgcagttagtagaaaacggcgactactctaggttaagcaaggaagttgcagagaaaggtcaccaattgaggcagatgagaggggaagagctccaaggactaaatattgatgaactgcagcagctagagaaatcgctcgaagctgggttgaatcgtgtaatagaaaagaagggtgaaaagatcatgaaagagatcaccgaccttcaacagaagggcgcaaaactaatggaagaaaacaagagactaaagcaacaggttactgaaatctcgggccggaaaaccactgccaccgattcagagaccatcatcaatgaggaaggcctctcgtcggagtccatcacgaacgtctgcagctccagcagcggtcctcctcaggaggatgatagctccgacatttcccttaagctggggttaccctacaatggctgatctgctgtctaaatctacaacaat

SEQ ID NO: 9403 - DNA, 1218 bp, Arachis hypogaea
atggcttcggctacactttctgtagccaaaccagctcttcagggaaatggtgggaaggggttctctgaattctctggcctccgcaactcatcatctagctaccttcctttctctaggaagacttcagatgacttccactctatcatttcattccagacatctgcagttggaagcagtggaggatacaggaaaggtgtgacggaagcgaagctgaaggtggccataaacggttttggcaggattggaaggaacttcttgaggtgctggcacggccgcaaagactctcctctggatgtcattgccatcaatgacaccggaggcgtcaagcaggcctctcaccttctcaagtatgactccacccttggcatattcgacgccgacgttaagcctgtcggtgaggatgccatctccgttgacggaaaggtcatcaaagttgtctccaaccgcaaccctgctaaccttccctggaaggaattgggagttgacttggtgattgaaggaactggggtgttcgtggacagagaaggtgcagggaagcacattcaggcgggagccaagaaggtactgatcacagccccaggcaaaggtgacatcccaacctatgtagttggtgtcaatgctgatgcttacagcccagacgaacccatcatcagcaacgcttcttgcaccactaactgccttgctcccttcgtcaaggtccttgaccagaaattcggtatcatcaagggaaccatgaccaccactcactcctacaccggagaccaaaggcttcttgacgccagccaccgcgacctcaggcgcgcgagggcggcagcgctgaacatcgtgccgacctcaaccggagcggccaaggcggtggcgcttgtgttgccgacacttaagggaaagctgaacggaattgcattgcgtgtaccaacgccaaacgtgtccgtcgttgacctcgttgttcaggtgtcaaagaagacgttcgcggaggaagtcaacgctgcgttcagagagagcgcggagaaggagcttaacggcatcctctcagtgtgtgatgaaccacttgtctccgttgatttcaggtgcaccgacgtttcatctaccgttgactcttcgttgaccatggtcatgggtgatgacatggtgaaggttattgcttggtatgataatgagtggggttactcacaaagggttgtggatttggctgacattgttgcaaacagctggaagtga

SEQ ID NO: 9404 - DNA, 1492 bp, Glycine max
ggaacctgaaaatctagtttcttacaagcctctactatactgcttcaccttctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagttggaagcagtggaggatacaagaagggtgtgacagaagcaaaactgaaggttgccataaacgggtttggaaggattggaaggaacttcttgaggtgctggcacggtcgcaaagactcccctcttgatgtcattgccatcaacgacaccggcggcgtgaaacaagcctctcaccttctcaaatacgattccatcctcggaaccttcgatgctgatgtcaagcctgttggcagcaatgtcatctccgtggatggaaaggaaatcaaagttgtttctgaccgcaaccctgccaaccttccttggaaggacttggggatagacttggtgattgaaggaaccggggtgtttgtagacagagaaggtgcagggaaacacattcaagcaggagctaagaaggtgctcatcactgctcctggtaaaggagatatccccacctacgtggttggtgtcaatgagtatgactacagccctgatgaacccatcatcagcaatgcctcttgcaccactaactgccttgcaccctttgtcaaggtccttgatcagaaattcggtatcatcaagggtaccatgaccaccactcactcctacaccggtgaccaaaggcttcttgatgcgagccaccgtgacctgaggcgtgcaagggcagcagcactcaacattgtccccacttcaacaggagcagcaaaggcagtggcccttgtcctcccaaccctcaaaggcaaactcaatggcattgcactccgtgtgccaacaccgaacgtctcagtggtggacctcgtcgttcaggtctcaaagaagacctttgcagaagaagtgaatgcagcattcagagagagtgcagacaatgagctcaagggaatcctctctgtgtgtgatgagccacttgtgtccgttgacttcaggtgcactgatgtgtcctcaaccgttgactcctcgttgaccatggtcatgggagatgacatggtgaaggtcattgcttggtatgacaatgaatggggctactcccaaagggctgtggatttggctgacattgttgccaacaaatggaagtgagagccaaacaaattctcattggtaattaaattattatgtatgtaccatgccattgtaattttgtatgcttactactactactaccactacaacacttgttgcttcatttttcttttaaacttgtactgagaaacagaaccatcaattttttctgccttctcattgtgcaataaaattcttacccaaaaaaaaaaaaaaaaaa

SEQ ID NO: 9405 - DNA, 1212 bp, Glycine max
atggcttccgctactttttctgtcgccaaaccagcccttcaggcaaatgggaaaggcttctctgaattctctggcctccgaagctcatcaggcttccttcccttttctagaaaatcttcagaggatttccattctgtcattgccttccagacctatgcagttggaagcagtggaggatacaagaagggtgtgacagaagcaaaactgaaggttgccataaacgggtttggaaggattggaaggaacttcttgaggtgctggcacggtcgcaaagactcccctcttgatgtcattgccatcaacgacaccggcggcgtgaaacaagcctctcaccttctcaaatacgattccatcctcggaaccttcgatgctgatgtcaagcctgttggcagcaatgtcatctccgtggatggaaaggaaatcaaagttgtttctgaccgcaaccctgccaaccttccttggaaggacttggggatagacttggtgattgaaggaaccggggtgtttgtggacagagaaggtgcagggaaacacattcaagcaggagctaagaaggtgctcatcactgctcctggtaaaggagatatccccacctacgtggttggtgtcaatgagtatgactacagccctgatgaacccatcatcagcaatgcctcttgcaccactaactgccttgcaccctttgtcaaggtccttgatcagaaattcggtatcatcaagggtaccatgaccaccactcactcctacaccggtgaccaaaggcttcttgatgcgagccaccgtgacctgaggcgtgcaagggcagcagcactcaacattgtccccacttcaacaggagcagcaaaggcagtggcccttgtcctcccaaccctcaaaggcaaactcaatggcattgcactccgtgtgccaacaccgaacgtctcagtggtggacctcgtcgttcaggtctcaaagaagacctttgcagaagaagtgaatgcagcattcagagagagtgcagacaatgagctcaagggaatcctctctgtgtgtgatgagccacttgtgtccgttgacttcaggtgcactgatgtgtcctcaaccgttgactcctcgttgaccatggtcatgggagatgacatggtgaaggtcattgcttggtatgacaatgaatggggctactcccaaagggttgtggatttggctgacattgttgctaataaatggaagtaa

SEQ ID NO: 9406 - DNA, 1480 bp, Pisum sativum
gcaaaacttgtatactacaaacttcaccttcaaaatattcagtgttccttgttggctcaatcatggcttcggctactttctctgtagccaaaccagctattaaggcaaatgggaaaggcttctctgaattctctggtctccgcaactcttcaagacatcttcccttttctagaaaatcttcagatgattttcattctcttgttaccttccaaaccaatgcagttggaagtagtggaggacacaagaaaagtcttgtagtggaagcaaaacaactgaaggtagccataaatggatttggaagaattggaaggaacttcttgagatgttggcatggtcgcaaggactcgcctcttgatgtcattgcaatcaatgacaccggaggtgtaaagcaagcttctcaccttctcaagtatgattccacacttggaatctttgatgctgatgttaagcctgttggtactgatggcatctcagttgatggaaaggttatcaaagttgtctccgaccgcaaccctgccaaccttccttggaaggagttggggatagacttggtgattgaaggaactggagtgtttgtggacagagaaggtgcagggaggcacattacagcaggggctaagaaggttctcatcactgcccctagaaaaggagacatccctacttatgtggttggtgtcaatgctgatgcttacacccacgccgacgacattatcagcaatgcttcttgcaccactaactgccttgctccctttgtcaaggtccttgatcagaaattcggtatcatcaagggtaccatgactactactcactcctacaccggtgaccaacggcttcttgacgcgagccaccgtgacctaaggcgtgcgagagcagcagccctcaacatagtcccaacatcaacaggagcagctaaagcagtggcccttgtcctcccaacactcaaaggcaagctcaacggtattgcgcttcgtgtgccaacaccaaacgtttcggtggtggacctcgtcgttcaagtctcaaagaagacatttgctgaagaagtgaatgaggcttttagagagagtgcagccaaggagctgactggtattctctcggtctgtgacgagccactcgtgtctgtagattttaggtgcaccgatgtgtcgtctaccgttgattcgtcattgacaatggtcatgggcgatgacctagttaaggtgattgcttggtatgataatgagtggggttactcacaaagggttgttgatttggctgacattgttgccaataactggaagtaagagccaaataaggtttgttaattatatctatatctatatatatatatatatatatatatatatatatatgtacgtataccatgtgccattgtaattttgtacacttcttgcttatttttttctttctaaacttgtattgagaacagaaccatcaattttctcttgctcctcattgtgcaataaattgttttaccttgctg

SEQ ID NO: 9407 - DNA, 1571 bp, Medicago sativa
attgaatgaaaatgctatccaaaatctaatccttacatggttgggttcatgagtcacaaccacacatccacgtacccacatcttactacactttatagtaacataataacaacataacatataactaacaatttgcttctcttcaagactctatactacaatttcttcttccttgtaggcttaatcatggcttcggctactttctctgtagccaacccagctcttaaggtaaatgggaaaggcttttctgaattctctggtctccgtaactcatcaggatatcttcccttttctagaaaaacttcagatgactttcattctgtcatttccgtccaaaccaatgcagttggaagcagtggaagatccaggaaaggtgttgtagtggaagcaaaaattaaggtagccataaacggatttggaaggactggaaggaacttcttgagatgttggcatggtcgtaaggactcgcctcttgatgtcattgccatcaatgacaccggaggtgtaaagcaagcctctcaccttctcaagtatgattctacacttggaatctttgatgctgatgttaaacctgttggcactgatggtatctctgttgatggaaaggttatcaaagttgtctctgaccgtaaccctgccaaccttccttggggggagttgggaatagatttggtgattgaaggaactggagtgtttgtggacagagaaggtgctgggaagcacattacagcaggagctaagaaggtactcatcacagcccccggaaaaggagacatcccaacttacgtggttggtgtcaatgctgatggttacaaccacgctgatgatatcatcagcaacgcttcttgcaccactaactgccttgctccctttgtcaaggtccttgatcagaaattcggtatcatcaagggtaccatgactaccactcactcctacaccggtgaccaaaggcttcttgatgctagccaccgtgatctaaggcgtgcaagagcagcagctcttaacattgtgccaacttcaaccggagcagcaaaggcagtggcccttgtcctcccatcactcaaaggcaagctcaacggtattgcacttcgtgtgccaacaccaaacgtctcggttgttgacctcgttgttcaagtctcaaagaagacatttgctgaagaagtgaatgaggctttcagagacagtgcagccaaggagctgagcggtattctctcagtttgtgatgagccacttgtgtctgtagattttaggtgcactgatgtgtcctcaaccgttgattcgtcattgacaatggtcatgggagatgacatggtgaaggtgattgcttggtatgataatgaatggggttactcacaaagggttgttgatttggctgacattgttgccaataactggaagtgagagccaaataatatttgctaattatatatatgtatgtaccatgtgccattgtaattttgtacacttcttgcttcatttttcttttatcttccgaaacttgtattgagaaatagaaccatcaattttctcttgctcctcattgtgcaataaattcttttaccttgaaatgt

SEQ ID NO: 9408 - DNA, 1468 bp, Thellungiella halophila
gaccctctgctgctgaaaccttaacttttggatcgtttctggttaccatggcttcggctactttctctgtccccaaaccatctcttcagggtttcactgaattctcaggattgcgaagctcatctgcttctcttccctttggcaagaaactttcttccgatgagtttgtttccgtcgtcactttccaaacttctgcaatgggaagcagtggtggatacaggaaaggtgtgactgaggctaagcttaaggtggccattagcgggtttggtcggatcgggagaaacttcttgagatgctggcatggccgcaaggactctcctcttgacgtcattgccataaacgacaccggaggcgtcaagcaggcttcgcatctccttaaatacgactctactcttggaatctttgacgccgatgtgaaaccttctggagacgctgctctctctgttgatggaaagattatccaggttgtgtctaaccgcaacccgtctaatctcccctggaaggagttaggcatcgacattgtcatcgaaggaaccggagtgtttgtggatagagaaggtgcagggaaacacattgaagctggagccaagaaagttatcattaccgctccaggcaaaggagacattccaacttacgttgttggtgtcaatgccgatgcttacaatcccgatgaaccgatcatcagcaatgcatcttgcactactaactgtcttgctccctttgtcaaagttcttgaccagaaattcggtatcataaagggtacaatgacaactactccctcttacactggtgaccagaggttgctagacgcgagccaccgtgatctaaggagagcaagagcagctgcgttgaacattgttcccacatctacaggagcggctaaagctgtggctcttgtgcttcctaacctcaagggaaaactcaatggaatcgctctccgtgtaccaacaccaaacgtatcagtggttgatctcgttgtgcaggtctcaaagaagactttcgcagaggaagttaacgctgctttcagagatgctgcagagaaagagcttaaaggtatactcgaagtctgcgatgagccgctagtttccgttgatttcagatgctcagatgtgtcctcgaccattgattcttcactcactatggttatgggagacgatatggttaaggtgattgcttggtatgataatgaatggggttactcacagagagttgttgatttggctgacattgttgccaacaactggaagtgatttgtaacttttggaatcaacttgtttcattttttgctctctttttttacattgtgattctcaaaatatcggtcaagactgtataattgtagcctgagttgtggatttgtaataatgataaactcgatccagacttgtctacatatgaaactctttttaacaggtctcaaacaaaagataataatatacagagatgttatatgaaaaaaaaaaaaaaa

SEQ ID NO: 9409 - DNA, 1484 bp, Bruguiera gymnorhiza
ggaggaaaacttgggcctcacagagtttttgtttttctgatatcatcagtcttttctgcttgccgtatatcactgcttccttccactgttatggcttcggctaccctttctgtagccaaaccttctcatcttcaggcgaatggaaagggattcacggaattctcagggctccgcaactcatcagctttccttccctttgccaagaaaacatccgatgacttcctttcagttgttgctttccagacttctgctttggcaagcagcagtggaggatacagaagagctgcagcggaggcaaagctgaaagtggccataaatgggtttggtaggattggtaggaacttcttgaggtgctggcatgggcgaaaggattcccctctagatgttattgccatcaatgacactggtggtgttaagcaggcctcgcatctcctcaagtatgattccaccctaggcatatttgaggctgatgtcaagcctgctggtgatagtgccatctctgttgatggcaagatcatcaaggttgcttctaaccgcaaccccgtcaaccttccctggaaggaaatggagattgaccttgtgatagaaggaactggagtttttgtggatagagaaggtgcaggcaaacacattcacgcaggggccaagaacgtgctcatcacagcgcctggaaagggtgacatcccaacgtatgtagtcggagtcaatgctgacgcctataaccctgatgagcccatcatcagcaacgcctcttgcaccacaaactgccttgcaccctttgtcaaggtcctcgatcagaagtctggcatcatcaagggcaccatgacaacaactcactcgtacactggtgaccagaggctgcttgatgctagccaccgtgatctcagacgtgcacgagctgctgctctgaatatcgtcccaacttcgactggtgcagcaaagccagtggcgcttgtccttccaactctcaggggaaagcttaatggcattgccctgcgtgttccaaccccaaatgtatcggttgttgatttagtcgtccaggtctccaagaaaacctttgcagaagaagtgaatgctgctttcagagagagtgctgacaaggagctcaagggtatcctctcggtgtgcgatgagccccttgtttctgttgatttcaggtgcagggacgtgtcatcaacagttgattcatcactgaccatggtcatgggagatgacatggttaaagtgattgcttggtatgacaatgaatggggttactttcaaagagtggtggatctggctgacgttgttgctgagaaatggaagtagattgagatatttatattttagccttttatgagcccgcatcctacaatgtaatttttgattttcattttgtgtacctttggttcggctttaaggtttcaatttttgtaagacttgtacaatcataaatgcggactgatttcccattccaaaaaaaaaaaaaaaaaaaaaaaaaaaaa

SEQ ID NO: 9410 - DNA, 1356 bp, Mangifera indica
ttcctcccataatcaacatggcttcggctactttctctgtagccaaaccatcacttcaggctaatggaaagggatttacagatttctctggtctgcgcaactcagcaagccttcccttttccaggaaaacctctgaggatttcctttcagtcattgctttccagacctctgcggtgggaaacagtggatacaggaaaggtgcagctgaggcaaagctaaaggtggccataaacgggtttggtagaattggcagaaacttcttgaggtgctggcacggacgcaaggactcccccttggatgtcattgccatcaatgacaccggaggtgtcaagcaagcctcccaccttctaaagtatgattccactctaggcatctttgatgccaatgttaaacctgttggtgacaatgccatctccgtagacggcaaggtaatcaaggttgtcactaaccgcaacccccttgatctaccctggggggacttgggtgtggatcttgttatagaagggactggagtgtttgtagatagggatggtgcaggcaagcacattcaagcaggtgccaagaaggtgctcatcactgcccctggcaagggtgacattccaacctatgttgttggagttaatgctgatgcttacaacccggatgagcccattatcagcaacgcttcttgtacaactaattgtcttgccccttttgtcaaggtccttgaccagaagttcggtattatcaagggaaccatgactaccacacattcatacactggtgaccagaggctacttgatgctagccaccgcgatctcagacgtgcaagagcagctgctctcaacattgttccaacttcgactggtgcagcaaaggctgttgcccttgtcctcccatctctcaaaggcaaacttaatggcattgccctacgtgtgccaaccccaaatgtgtcagttgttgatctagtggtccaagtctccaagaaaacgtttgcagaagaggtgaatgcagcattccgagaaagtgcagacaaggagctaaagggtatcctttctgtttgtgatgagccccttgtttcagttgactttaggtgctctgatgtatcgtcaactgttgattcatcactcacattggtcatgggagatgatatggttaaggtgattgcctggtatgataatgagtggggttactcccaaagggttgtggatttggctgatatagttgccaacaagtggaagtgatgagattgggtgtaatttgcactgtcgtttttcattttttgttgcctccgctttaaaagttgtatttttgtcaagaatgtataactatatgaaggaaccaaccatttctcttgaaaaaaaaaaaaaaaaaaaa

SEQ ID NO: 9411 - DNA, 1218 bp, Arachis hypogaea; identical to SEQ ID NO: 9403

SEQ ID NO: 9412 - DNA, 2056 bp, Glycine max
tatttttccgctctgggcttcactactataaaacacttttttttctcgtttccctttcgctcacacaacacaactcctaccaacaaggtgctctgctcgttcactcctctctcatacagcctctggctcctcctccggtgaaagagggtgagaagaggagttagcaagcaatttttgtttcttttgggagttgggacccctcactcacatggacgcatcaacggctttaatgatcctatccgcaatagcggcctatttaatatggttcaccttcgtcactcgctccctaaaaggtccacgtgtctggcccctattcggcagcctccctggcctcatccaacacgccaaccgcatgcacgactggatcgccgacaacctccgcgcgtgcggcggcacgtaccaaacctgcatctgcgcccttcccttcctcgcccgtaaacagtgcctcgtcaccgtcacgtgcgaccccaaaaacctcgagcacatcctcaagctccgcttcgacaactaccccaaaggccccacgtggcagtccgcgttccacgatttgctcggcgaaggcatcttcaactccgacggcgacacgtggctgttccaacgtaaaaccgccgcactggaattcaccacgcgcactctgcgccaagccatggcgcgttgggtgaaccgagccataaagcacaggttctgccccatcctagccacggctcagaaagaaaacaaatcagtggatcttcaagacctcttgcttcggctcacttttgacaacatatgcggcttggctttcggccaagacccgcaaaccctagccgtggggctcccagataacgctttcgctctctccttcgatcgagccaccgaggccactctacaacgctttattttacccgagatcttgtggaagctgaagcgatggctcaggctcggaatggaagtgagcctgagccggagcctgaaacacatcgacaattacctctcccacatcatcaagaaccgcaagctggagcttctgaatggcactgggtcccaccacgacgacctcttatcccgcttcatgaggaagaaagaatcctactctgaagagtttctccaacacgtggcactcaacttcatcctggcagggcgcgacacgtcatcggtcgctctaagttggttcttctggctctgcattaagaacccgcatgtggaggaaaagatcctccacgagctctgcagtgtcctcaagtttacacgtggagatgatatctccacgtggctcgaggagcctctggtgttcgaggaggtagaccgcctggtctatctcaaggcagctttgtctgagacgctgcggctgtacccctccgtcccggaggattccaagcatgtcgtgaaggatgatgttttgcctaatgggactttcgttccggcgggttcggcagtgacctattcaatttactcggttgggaggatgaagttcatttggggagaggactgcctcgagttcaagcctgagcggtggctctctccggaaggggacaaaattcaggtgcaagactcctacaagtttgtttcgttcaatgcgggacctaggctttgtttggggaaggacttggcttacttgcagatgaagtcaatcgccgctgcggtgctcctgcgccaccgcctcgccgtcgcgccgggtcaccgtgtcgagcaaaagatgtcactcacactgttcatgaagtacggtctcagggtgaatgtgtacccaagggatctcaaaccggtgctggaaaagttaaccaccaccgagggtgctattactgttggtcaaaagtgattttgatttggttaattaaacagatagatacatcatcggtttaaataaagaaataatattaattataagaaatttatatattacttaatatagaatattgacgatgatgtatcatttcatctgtgttagtttaatttacgttgtctgtatagatgaaatttccctttactcacaagtttctcatctgatgatgaatactatttatgtttttgtaaacattttgatgattaaaaagtaatgctgctgcagttcgggaagcta

SEQ ID NO: 9413 - DNA, 2381 bp, Vitis vinifera
gccccccatattgattgctcctccttcccctattcttctgtaaataactctttatatatatgcatctcttctctcctcatccctcacacccttcttctccttctccagcttcttcgtcttctgcgtttttcctcccacgttccagggaaaagtttcagtttttctctctcttgtctttctcgtgccagcacactgttgggctcgatctcaactgtttgcagaagaacatttcatctgggttttctcagtggagcaccccattttggttttgggtttggaagctacccatgccttagaaggtgtttctggtttctggtttctggtttctagtttctagtttaccggcggtggagtgagtttaaaacaggtggggtccgcagatcagatggatgcatccacggttttattgctcttagcgataattacggcttatttaatatggttcagatcaatcacacggtctctgaagggtccacgtgtctggccggtagtaggtagtctcccgctccttattcagaacgccaatcgcatgcacgagtggatcgccgagaacctccgctcatgcggcggcacgtaccagacctgcatttgcccaattccgtttttagcccggaagcagggtctcgtgaccgtcacgtgtgacccgaagaatctggagcatattctcaagatccggttcgataattaccccaagggtccgacatggcaggcagtgttccatgacctgctcggtgaggggatcttcaattctgatggcgaaacgtggcggttccagcgtaagaccgccgcactggaattcaccacccggactctgcgccaagccatggctcgctgggtcacccgcgccattaagctgaggttttgcccgatactgaagaaggctcaactcgagggcaagccggttgatctccaagatctgctgcttcggctcacttttgacaacatctgcggcttggcttttgggaaggacccgcagacgctggctccggggctccccgagaacagtttcgctacggctttcgaccgagccacggaagccaccctgcagcgctttattctgcctgagtttatatggaaattgaagaaatggctccggcttgggatggaagccagcttgacccacagcctggggcacgtggacaagtacctgtccgacgtcatcagcacacgcaagctcgagttggtgagtcagcagcaaggtgggtcccctcacgatgacctcctctcacggttcatgaagaaaaaggaagcctactctgacaatttcctccaacacgtggcgctcaacttcatcctagctggacgtgacacgtcatcagtagctctgagctggttcttctggttggtcattcaaaacccaagggtggaagagaaaattttgaccgaaatctgcaccgttctaatggagacacgtggcagtgacacctcaaagtgggttgaagaccccttggtatttgaagaagttgaccgattgatataccttaaggcagcgttatctgaaacccttaggctatacccctcagttccagaagactcaaagcatgtagtcgtcgacgacgtcctgcccgacggcacattcgttccggcaggatcggcaatcacctattccatatactcgaccggacgaatgaagttcatctggggcgaagactgcctagaattccggccagaaagatggttatcagcagatggtaaaaaaattgagctacaagattctttcaaatttgtcgccttcaatgcaggtccaaggatttgcctcggcaaggacttagcttatctacaaatgaagtccatagcagcggcggttttgctccgccaccgcctcacggtggcaccggggcacagggtggagcagaaaatgtcactgacattgttcatgaagtatggcctcaaagtgaacgtgcaacctagagacttgaccccaattttagccaacattcccaaggccaaacccaacactaaggtcaatggtaacgtccacaatgtttatgaggttgaaaaccttactggggttgcatattagggttggcattatggatttgttttcgggtctgttctacaatatttttcttctggggtttggatgtgatttgtgaatatgatgccatgttatagtaattaatttggtagcatcacatacatgtcttcatgatttatggtcccttaaagtctgcatgtcattacctacatactatcaaacttcgtcaacaaggaggctgctcagagaagaaggtgatcagagattgggtttttcatgcctatgcaaatttacgtttttcttttctttttcttttttttgtaattctctttccatatgtactactttcctccaaaaatgaataatgaataagatatgaaagtcgattatatatattccatta

SEQ ID NO: 9414 - DNA, 4280 bp, Vitis vinifera
ggatgcatccacggttttattgctcttagcgataattacggcttatttaatatggttcagatcaatcacacggtctctgaagggtccacgtgtctggccggtagtaggtagtctcccgctccttattcagaacgccaatcgcatgcacgagtggatcgccgagaacctccgctcatgcggcggcacgtaccagacctgcatttgcccaattccgtttttagcccggaagcagggtctcgtgaccgtcacgtgtgacccgaagaatctggagcatattctcaagatccggttcgataattaccccaagggtccgacatggcaggcagtgttccatgacctgctcggtgaggggatcttcaattctgatggcgaaacgtggcggttccagcgtaagaccgccgcactggaattcaccacccggactctgcgtcaagccatggctcgctgggtcacccgcgccattaagctgaggttttgcccgatactgaagaaggctcaactcgagggcaagccggttgatctccaagatctgctgcttcggctcacttttgacaacatctgcggcttggcttttgggaaggacccgcagacgctggctccggggctccccgagaacagtttcgctacggcttttgaccgagccacggaagccaccctgcagcgctttattctgcctgagtttatatggaaattgaagaaatggctccggcttgggatggaagccagcttgacccacagcctggggcacgtggacaagtacctgtccgacgtcatcagcacacgcaagctcgagttggtgagtcagcagcaaggtgggtcccctcacgatgacctcctctcacggttcatgaagaaaaaggaagcctactctgacaatttcctccaacacgtggcgctcaacttcatcctagctggacgtgacacgtcatcagtagctctgagctggttcttctggttggtcattcaaaacccaagggtggaagagaaaattttgaccgaaatctgcaccgttctaatggagacacgtggcagtgacacctcaaagtgggttgaagaccccctagtatttgaagaagttgaccgattgatataccttaaggcagcgttatctgaaacccttaggctatacccctcagttccagaagactcaaagcatgtagtcgtcgacgacgtcctgcccgacggcacattcgttccggcaggatcggcaatcacctattccatatactcgaccggacgaatgaagttcatctggggcgaagactgcctagaattycggccagaaagatggytatcagcagatggtaaaaaaattgagctacaagattctttcaaatttgtcgccttcaatgcaggtccaaggatttgcctcggcaaggacttagcttatctacaaatgaagtccatagcagcggcggttttgctccgccaccgcctcacggtggcaccggggcacagggtggagcagaaaatgtcactgacattgttcatgaagtatggcctcaaagtgaacgtgcaacctagagacttgaccccaattttagccaacattcccaaggccaaacccaacactaaggtcaatggtaacgtccacaatgtttatgaggttgaaaaccttactggggttgcatattagggttggcattatggatttgttttcgggtctgttctacaatatttttcttctggggtttggatgtgatttgtgaatatgatgccatgttatagtaattaatttggtagcatcacatacatgtcttcatgatttatggtcccttaaagtctgcatgtcattacctacatactatcaaacttcgtcaacaaggaggctgctcagagaagaaggtgatcagagattgggtttttcatgcctatgcaaatttacgtttttcttttstttttcttttttttgtaattctctttccatatgtactactttcctccaaaaatgaataatgaataagatatgaaagtcgattatatatatattccattaccaaaaatgcaaaaacaaagtcaacatcacaccattagattaaccatcgacccatccacaaattttaattttagtacgttatgaacaactttattttgatgatgatttaatattgacaaaatacatactttcgtgacttcataatttatggtttctgtcaacgtacacmykagggtgaactaatttagatgttcttgattttatatctatcttaccgatgacctcaaaaatcattatacacctataatttcggtgttttgaatgtgcatctcataaatgtgccgctcatattatgaagtatgtttggttgtcatgcctatgggattgattgtcatgacattgcctacgtgagttggctttgtcggagggaggcataacccattaataagtccaattactccaaatgtggaaaattttgaaagattgagactgccaaccaactcaatttgataggccttttatttaattttgtaagacaaattagtgaaataaatattatgatcaagaaattaggcaaaggtccaagagaaaacattttattttataatccttgttgctatgtcactttcgcaccttccttgcaagttaaaatgttttcatgacaaagatgtgataacatcacacaattaaagctaatcttctttctaattacaatttacatctaatcaaatcataattctcaagatcagtctcatgaaaaccttatattccttgaggaggttctatcatgtggaaacattctttattcaactttagctttaagcagtcgtaaccaagaaaccatcgatttcgcttggtggataggaatgtccgacttgtcaatttatttggtaaactacttggggctcatgtagaccatgtcatattactcatattctagattgaagcaataaatctatttgaaatgactcatttcataccagagaaactcatgtatgaacaaagattaattttgcttycycatytagctattctaggttgggggyatatgctggtrgggaagttataaacayttttttttwaaaaaaaaaaaaagaamktagaaaatttarctratacaactttatacattatttatcaagaagttattgtatataatttgcattagttgataaaagattttcttttttttgaaaaaggtttctttgatttacttgaatttgtttctattattaaaaatttatacatcaattccatctaattttagtgttatttaatattgcaggtgttgtatggagagatatgctatcaagaaataagatttataaaaaaattaatataggctttaaggtttaggttttgattcatgagaccttgtgtattgaatgaacattttgtggtggaagaacaattaggttacttgagcacatttacgtgagttgtgaattgtgtgagcacatcacaataaaggggagttggaacttgtttaaaaaaggcttatttaaattgttttagatttagatgagttttaaaatggtaaggatagtttaattcaatatttagtttaattatggtattaaaagtcaaatttcttataattctttraaaaaattttgaaaaaactattttaatttagtgtgattcatattaggaataaagtwagtgtataatraacgaaaattaggtacaaagaatttagtagattataaatagaaattcgctctagatcataaaatcaatgggacttaaatgcataaaataaaacccggaataggmagcyaaatcccataatttcaataaaatattattatacacttcattctctaactcctaattcctacctattatgtactttctctttctatacgtggctttcgattatttctttgtatcatttttattatttcctttaatggataggaggagaatgcattaaattggtgaaggcggagtagcaacgtttgaatcacgggaatctctacctttgtatgcagtctctctctctctctcttttcactggcattatatgttttctttagttatttttacaggttataaattccaaacatttgaaagcttcttccatgcattttgtgctggaagctttggtgtttttgtttgagtctctgtaggtacacgcattgtttcaacttgggattttgattgacaaaggatttgaatgggcctcttctaactataggtgctaagcgaatgaagcagaaaggaaagaaaatggaatattgagaagacttgctttaactagtcgtaaccaataaaccatcgattttgcttggtggatcaagaagacttgtcaatttatccggtaaaccacttggggctcatg

SEQ ID NO: 9415 - DNA, 2006 bp, Petunia x hybrida
ctcatttcttcttctctctacttttttcacattttttctacatactttcctttgtaaatgttgttttgaagctccattattgttaaggtctcttaagttccacagccattcttgcaggaagttggtgttattaaaagatggaagtatcaacaactatgatgattgtagcaattgtagcagcatacttactgtggttcaaatccattaccaaatccatgaaagggcccaaaggcccaacaatgtggcccgtagttggaagtttaccgggcctgattgagaatggaaacaggatgcatgaatggattgcagataatcttcgggcctgtagcggtacttaccaaacctgtatatgtgcaattccgtttttagcccgaaaacagctcgtaacagtcacgtgcgatccaaagaatttagagcatatattgaaggttaggtttgataattaccctaagggtcccacttggcaagctgtgtttcatgatttgcttggtgagggtatcttcaattcagatggcgacacgtggcttttccaacgtaaaactgccgcgttggaattcaccacccggaccttgaggcaggccatgggtaggtgggtgaaccgagccatcaagaatcgattttgcccgattcttgaaatggctcaggttcagggcaagccggttgatcttcaagatcttttgcttcggctcacttttgataacatttgcggcttggcttttggcaaagacccggagacactctctccagagttacctgaaaataactttgccacgtcttttgatcgagccaccgaagccacattgcaccggttcattatgcccgagttcgtttggaagttaaaaaaaatgcttggacttggattggaggtgagcttgaacaatagcttgaaacaagtggacaattacatgactgacgtcatcaatacacgtaagctagagttgctgaatcatcagaacggtgggccccaacacgatgacttgctttcgaggttcatgaagaaaaaagaatcctactcggacaaattccttcaacacgtggcactaaatttcatcctagctggacgtgacacgtcatccgttgctctgagctggttcttctggttggtcagctcgaacccgagggtggaagaaaaaatacttgttgaaatttgtacgattctagccgagacacgtggcaacgacacgtcaaagtggttagaagaaccactagtgtttgaagaagttgaccaattgatgtacctcaaggcagcattatccgagaccctaagactttatccatcagtgccagaggattcaaaacatgtcatttctgatgattatttgcctgatggcacatttgtccctgcaggatccaatataacatattcaatatactcaactggtcgaatgaaattcatttggggtgaagattgtttagaatttaagccagaaagatggatgtcacaagatggtgacaagttccaagttcaagatacatttagatttgtggcattcaatgcaggaccaagaatttgtctaggtaaagacttggcatatttgcaaatgaaatctatagcagcagcagtgctactacgccaccggctcgcggtggcgccaggccacaaggtggaacaaaagatgtcattgacattatttatgaaagatggtctagttatgaatgtgacccctagggacttaactccaattttggccaaaattgagaaatttggcaaagttgaatcatgtgctggagagcatcatttgatcaataatggtattcatcaacctggaagcattgcagtaaatgggattgctgcttgaagattataaatattgcaagtgtttttaatttgttaatgatacagtaacagttatatatagtaacagttttatcttttgataattttatatgacagaatatgtcttcatgaccatctgatcatatgaaaatgtggctgggatgacttaccaataatgtttgaagtggtttttattttcccagtatacctgaaaaaaaaaaaaaaaaaa

SEQ ID NO: 9416 - DNA, 1677 bp, Vitis vinifera
atggacgtgttttgggcttcgctgttttttatggcgatcaccgcttatctgctgtggttcaccttcatctcacggtcgttgaggggtccacgtgtctggcctttattgggcagcttaccaggcttgatcgagaacagtgaacgcatgcatgaatggatcgctgaaaatctacgcgcgtgtggcggcacgtaccaaacatgcatctgcgccgtccctttcttggcgcgaaagcaagggctcgtgacggtcacatgcgacccgaagaatctggagcatatattgaagacccggttcgataattaccctaagggtcccacgtggcaaggtgtatttcatgatctgctcggggaagggatcttcaattctgatggcgacacgtggctgtttcagaggaagaccgccgcactggaatttaccacccggacgctgcgtcaggccatggctcgctgggtcagtcgagccatcaagcacaggttctgccccattctcagggcggctcagctagaagccaagccagttgatcttcaggaccttttgcttcggatcacgttcgataacatttgcggcttgacgtttgggatggacccgcaaaccctagctccaggcctccctgaaaacagcttcgcctctgcttttgaccgagccaccgaagccagcctccagcgatttattttgcctgaggttatgtggaagctgaagaagtggcttgggttgggcatggaggtcagcttgagccgaagcattgtacacgtggagaattacctgtccaaagtcatcaatacacgtaaggtggagctgctgagtcagcaaaaagacggaaacccccacgacgacttgctctcaagatttatgaagaaaaaggaatcctactcagactccttcctccaacacgtggcactcaacttcatcctagctggacgtgacacgtcatcagtagccttaagctggttcttctggttggtaacccagaacccaactgtcgaaaagaaaatcctacacgaaatctgcactgttctgatggggacacgtggcagcgacacgtcaaagtgggttgatgagccgttagagtttgaagagctggaccgtttgatatacctcaaagccgcactctccgagactctccggctctacccgtcggtgccggaggattcaaagcatgttgtcgccgacgacatattaccggacggcactttcgtcccggcgggatcatcaatcacgtactcagtatattcatcgggtaggatgaaatccacgtggggtgaagactggcccgagttcaggcctgagaggtggctatcggccgactgccagcgattcatattgcacgaccaatacaagtttgtggcgttcaatgcggggccgaggatttgtttggggaaggacttggcttacttgcaaatgaagtcgatagccgcgtcggtgttgctgcgccaccgcctcacggtggttgccggccaccgggtggagcagaagatgtcgctgacgttgttcatgaagtatgggctcaaggttaacgtgcatgaaagagatttaacggcagttgtggacggcgttaggaacgagaaagcaagtgaggtgtgtggcgaggaagctgttagagttaaatgtaacggtaactgtcacgccagtggttcggttgttgttgggggtagcgacgtgcggctcggtgtaacttga

SEQ ID NO: 9417 - DNA, 1754 bp, Vitis vinifera
atggcsatcacrgcttatctgctgtggttcaccttcatctcacgstcgttgaggggtccacgtgtctggcctttattgggcagcttaccaggcttgatcgagaacagtgaacgcatgcatgaatggatcgctgaaaatctacgcgcgtgtggcggcacgtaccaaacatgcatctgrgccgtccctttcttggcgcgaaagcaagggctcgtgacggtcacatgcgacccyaagaatctggagcatatattgaagacccggttcgataattaccctaagggtcccacgtggcaagstgtatttcatgatctgctcggggaagggatcttcaattctgatggcgacacstggctgtttcagaggaagaccgccgcactggaatttaccacccggacgctgcgtcaggccatggctcgctgggtcagtcgagccatcaagcacaggttctgccccattctcagggcggctcagctagaagccaagccagttgatcttcaggaccttttgcttcggatcacgttcgataacatttgcggcttgacgtttgggatggacccgcaaaccctagctccaggcctccctgaaaacagcttcgcctctgcttttgarcgagccaccgaagccascctccagcgatttattttgcctgaggttatgtggaagctgaagaagtggcttgggttgggcatggaggtcagcttgagccgaagcattgtacacgtggagaattatctgtccaaagtcatcaatacacgtaaggtggagctgctgagtcagcaaaaagacggaaacccccacgacgacttgctctcaagatttatgaagaaaaaggaatcctactcagactccttcctccaacacgtggcactcaacttcatcctagctggacgtgacacgtcatcagtkgccrtaagctggttcttctggttggtaacccagaacccaactgtcgaaaagaaaatcctacacgaaatctgcactgttctgatggggacacgtggcagcgacacgtcaaagtgggttgatgagccgttagagtttgaygagctmgaccgtttgatatacctcaaagccgcactctccgayactctccggctctacccgtcggtgccggaggattcaaagcatgttgtcgccgacgacatattaccggacggcactttcgtcccggcgggatcatcaatcacgtactcagtatattcatcgggtaggatgaaatccacgtggggtgaagactggcccgagttcaggcctgagaggtggctatcggccgactgccagcgattcatattgcacgaccaatacaagtttgtggcgttcaatgcggggccgaggatttgtttggggaaggacttggcttacttgcaaatgaagtcgatagccgcgtcggtgttgctgcgccaccgcctcacggtggttgccggccaccgagtggagcagaagatgtcgctgacgttgttcatgaagtatgggctcaaggttaacgtgcatgaaagggatttaacggcagttgtggacggcgttaggaacgagayagcaagtgaggtgtgtggcgaggaagctgttygagttaaatgtaacggtaactgtcacgccagtggttcggttgttgttggcggtygcgycgtgcggctcggtgtwacttgagaggttagttttgggctgtacttgtgggctgacggatatactacagtagcagcccaacagtttttaaaggcccaattacgcttgattcttatagaacacgaggggta

SEQ ID NO: 9418 - DNA, 1212 bp, Glycine max; identical to SEQ ID NO: 9405

SEQ ID NO: 9419 - DNA, 1218 bp, Arachis hypogaea; identical to SEQ ID NO: 9403

SEQ ID NO: 9420 - DNA, 1401 bp, Populus trichocarpa x Populus deltoides
gactagttcgaagagaatttctgcttttgtcagtgtgtttatcctaccataatggcctcggctaccttttctgtagccaaaccatctcttcaggcaagtggaaagggatttacagatttctcaggcctccgcagttcatcagctttccttccctttacgaaaaagacatcagatgactttgtttctgtcgttgctttccagacctctgctatgggaaacagcagtggaggatacagaaaaagtgccgcagaggcaaagataaaagtggccataaacgggttcggcaggatcggcaggaacttcttgaggtgctggcatggacgcaaggattcccctcttgacgtcattgccatcaacgacactggtggtgttaagcaggcctcccaccttctcaagtatgactccacccttggcatcttcgatgctgacgttaagcctgttggtgataatgccatctctgttgatggcaaggtcatcaaggtcgtttctagccgcaaccctctcgaccttccctggaaggacatggaggtcgacctggtgatagaaggtacgggggttttcgtcgacagggaaggtgcagggaagcacattacggcgggggccaagaaggtgatcatcacagcccctggaaagggtgatataccaacctacgttgttggagtcaatgctgacgcctacagccctgatgaacctatcatcagcaatgcttcttgcaccactaactgccttgctcccttcgtcaaggtcctagaccagaagtttggcatcatcaagggcaccatgactaccactcactcatacactggagatcagagactgcttgatgctagccaccgtgatctcagacgtgcaagagctgcagctcttaacattgttccaacatcaaccggtgcagcaaaggcagtggccctcgtccttcccactcttaagggtaaactcaacggcattgccctgcgtgttcccaccccaaacgtctcggtggtcgaccttgttgtccaggtctccaagaagacctttgctgaagaggtgaatgaaggttttagagagagtgctgagaaggagctcaagggtatcctatcagtctgtgatgagccacttgtttcagttgacttcaggtgcagcgatgtgtcctcaacagtcgattcatcactaacaatggtgatgggagacgacatggttaaggtgattgcttggtatgataacgagtggggttactcccaaagggtcgtggatttggctcacattgttgccgatcaatggaagtagcgatattgtaatgtgatttctgatttttgtataattaattattactatatatatttatatgtataattgtggaaccattttctccttgcggttaagcatcaataagaatctcattttggaaaaaaaaaaaaaaaa

SEQ ID NO: 9421 - DNA, 1393 bp, Glycine max
ttttttttttttttttttgcagatttgaattaaaaatactcataacaaatgtgaatcctacacccttattttatccctttacacattcttttttccacgtgaaggactcgattgccaacttcaagctaggataaggggcaatcccctgcatgatcgttagctaatctctagtattaatatatctaaatgcagatattcaagatgaaactgtggatacacttccatatttttttgccactgaattgaaatttcttcttaaatcctcctttattttgctgtctgcgaatatatactcaacagcattccttgatagctcaaacatttccctccttcccagcccaaatgaatcagcagcaattttgtattccttggagagacaggtagagaacacaccagagtcatcggtacacaggactaaaggatgttttgcgttgtataaatgagcaaagtggtgaacatctatagatggaacagtcattgtcctaacgtttgatgtcaagcaaatttcaaccggaatgttcgatgactttagctgtctccagtgttcatcctcaaagaaacaagcatgtccaatcctttgggggcgaaagtcaagcatattttttatctcctttgaattaggtaactcgccacaatgaagtgttacataaagaccttgttctcgagcaaatttcaatgctggcaagtatgtggtccaatcaccaatacttggatttccagagaggtcaattccaactaccccataaggcctcatttccagtgcaagcttgacagtgtccattgcagcttctgttgtctcccttctgtcaatgctcaagagaagcctaacaaagattctttttctcgcatgtccatcaatagccggtgcaggagtaaaaagagtctttgaatcttcacaatgtggaatgaaatccacatcaactgaagtaattgatcttagacctttcagtacagcttcaacataagagcgtttgctcattcccacagaatcatttctctttggagtagtcctcaactccagatagacaacattctctgatgcaaaatcctcaataacttctctggtaattcttgcaacagtgttgtgttcagtggtgagaatgtggattaggtcgaacagcttgaaaacttcttccactgaacggttatatttgaggatgatatgctccacttcggaaaaattaatggcaccctttccaatcaaagccttagtgagttcaagaagtgtggagtctcggatggatccattaaggtgagcatgcagttcaatctttggcattgacacacaccactccatctcttgtttttctatcctcggatgatggcagaaggagcagttttgcaaacagaagggagagtggtgagattcaaaccctcaccaaactgagcaccc

SEQ ID NO: 9422 - DNA, 936 bp, Capsicum annuum
  misc_feature (498)..(498): n is a, c, g, or t
gggataaatggatttggaaggatcggaaggaatttcttgaggtgctggcatggcaggaaggactctcccctagaagtcattgccatcaatgactctggaggtgtcaagcaagcctctcacctcctcaagtacgactctacccttggcatctttgacgctgacgtcaagcctgttggtactgatggcatctctgttgatggaaaggtcatcaaagtcgtctccgaccgcaaccccatcaatctcccctggaaggatcttggagttgacttggtgatcgaaggtaccggagtttttgtggacagagagggtgctgggaagcacatccaagctggagctaagaaagtgctaatcactgcccccggtaagggtgatattcctacctatgttgttggtgtcaatgcagacctttacagccctgatgagcccatcattagcaatgcttcgtgcaccaccaactgtcttgctccttttgtcaaagttcttgacgaaaaattcggnataatcaagggtaccatgacaactacacactcctacactggtgaccaaaggcttcttgatgcaagccacagggaccttagacgtgcaagagctgcagctcttaacattgtaccaacttcaactggtgcagctaaggctgtggcccttgtccttccaagtctaaaagggaagctcaacggcattgccttgcgtgtgccaacccccaatgtctcggtcgtggacctcgttgttcaagtatccaagaagacatttgcagaggaagtgaatgctgcattcagggagtctgctgataaggagcttgctggcattctctccgtctgcgatgaacccctcgtttcagtcgactttaggtgctctgatgtttcatcaactgtggatgcttcacttaccatggtcatgggagatgacatggttaaggttattgcttggtacgacaat

SEQ ID NO: 9423 - DNA, 942 bp, Capsicum annuum
ggaatcaatgggtttggaagaattggaaggaacttcttgaggtgttggcatggtagaaaagactctccccttgatgtcattgccatcaatgacactggtggtgtcaaacaagcctctcaccttctcaaatatgactccacccttggtatctttgaggctgacgtcaagccggttggcactgatggcatctctgtcgatggaaaagtcatccaagttgtctctaaccgcaacccctccaacctcccatggggagatcttgggatagacttggtcatagaaggtaccggagtgtttgtcgacagagaaggcgctgggaaacacatccaggcaggagccaagaaggtgctcatcaccgcccccggaaaaggtgacatcccgacttatgttgttggtgtcaatgctgacctctacaaccctgacgaacctatcatcagcaatgcctcttgcaccaccaactgccttgctcctttcgtcaagattcttgaccaaaaatttggcattatcaagggaacaatgacaactactcactcttacaccggtgaccaaaggcttcttgatgcaagccacagggatcttagacgtgcacgagctgcagctctcaacatagttccaacctcaactggtgctgctaaggctgtggcccttgtcctcccaagccttaagggtaagctcaatggcattgccctccgtgtccccacccctaatgtctcagttgtggaccttgtcgttcaagtctccaagaagacatttgctgaggaagtgaatgctgcgtttagagaggctgctgacaaggaactcaatggcattctctcagtctgcgatgaaccactcgtgtcagttgacttccggtgcagtgatgtgtcatcaactgttgatgcttcactcactatggtcatgggagatgacatggttaaggttattgcttggtatgataacgaatgg

SEQ ID NO: 9424 - DNA, 945 bp, Glycine max
gggagtgcttttgctagctatagcccaccttgtatccccttcccttaaattgtcaattctttccaagattccttctatgccttcagagtagtaaccatggaaacttcccagcctctttctattgaaagcttctcatacagttggttagtgaacctaaggccatcatcactagaaagcctagaaagctccctaagaacctcccttgatgcatctgatgaagcttccttcattgagatggacccaagaatgccaccctctaaaagattcttcaagaactcacaggactccaaatttgacttcccaatttcacagtcccctctcactcttgtccatgcagacgaactcttttccaatggctatctcatgccactctttgttgagtcattgcaaatggaagaatatgagtcctcagactccaacacaagcctggtctcatcatcttcacatgcaccaacgagtgaggctcctacaggcccttctagatgcctttccttaaaaaggtgcagaacattgtcaaggagagtgtttcagaagtatctgaatttcttgaggcctttgtgtagaaagctgagggttcataagtctagtactgaagctgttgctaaaagaggtgaggctgtgaagaataggagatactattcagacactacttcaccgcgaactagtgtagccttttctgctgatgattggcgctactcttgtgattctgaaagctcaatatacgaagcagttctccattgcaaaagatccattggagaatgagttaaggaatctgcaaaaggggaaggagaagatgaagataaatgagaagggattaaagtcgatccactgtcactgtaaaaccttttatactatgagggaaaaaagtatggaactttgttgttatagctaaaagctttttcacttcttgtggaagtttttgaccatattttcagtaggtggcat

SEQ ID NO: 9425 - DNA, 970 bp, Glycine max
tttttttttttttttttttgtgaatttaatttgaatccactgacgtgtactattagtgaaccatcagattcagatgccacctactgaaaatatggtcaaaaacttccacaagaagtgaaaaagcttttagttacaagttacaacaataaaatgccgtatttttcttcctcatagtataaaaggttttacagtgacagtaaatcaaatttaaccccttctcatttatcttcatcttctccttccccttttgcagcttccttaactcattctccgatggatcttttgcaatggagaactgcttcatatattgagctttcagaatcacaagagtagcgccaatcatcagcagaaaaggctacactaattcgcggtgaagtagcagtgtctgaatagtatctcctattcttcacagcctcacctctcttagcaacagcatcaatactaggcttgtgaaccctcagctttctacacaagggcctcaagaaattcagatacttctgaaacactctccttgacaatgttctgcacttttttaaggaaaggcatctagaagggcctgtaggagcctcactctttggtgcatgtgaagatgatgaaactaagcttgtgttggagtctgaggactcatattcttccatttgcaatgactcaacaaagagaggcatgaggtagccattggaaaagagctcatctgcatggacaagagtgagaggggactgtgaaattgggaagtcaaatttggagtcctgtgagttcttaaagaatcttttagaaggtggcattcttgggtccatctcaatgaaggaagaagtttcatcagatgcatcaaggggagttcttagggagctttctaggctttctagtgctgatggccttaggttcactaaccaactgtatgagaagctttctatagaaagaggctgagaagtttccatggatatgatatgctatgctactctgaagatatccc

SEQ ID NO: 9426 - DNA, 1143 bp, Glycine max
ttttttttttttttttttttgtacataattgttctgtagcacacatttctgattccaaaatcagttgaagaataacttaacagaaattggaggcagattctcatctttagtaaaagtgttccttcccatattaaattagatgatcaaacaaaattgtactacatattttttttctcttcagaatttgatcataaagattgaatgtgcctgaccaaccacatctttatttcctattataattcctttatcattcaagcagaggataatggagcagaggagttgctcttggtggtttagccttgatcatctctctcttttcactttatcttctcttttctcttgcatttttgatctccaaacgcaacccttttgcagcatccttaattcattctttcaatggatcttttgcaatggagaactgcttcataaattgagctttcagaatcacaggacttgcgccagtcatcagcagaataagctacactaatccgtggggaagtttcagaatagtatcccctattctttgctgacacggttctcttaacaacagattcaggttttgagcctgatttgccacccctcaatcttctatacaagggccttaagaagttgagatacttgagaaatattctccttgataatgttttgcaccttttcaacgaagggcatctagaatgactattaggaaccacactctttggcacatgtgaagaggaaggtaggcttggaatgacatcagaggcctcaaatgcttccatcttcaatgattcaacaaaaaggggcatgaggtagccattggagaagagctcatcagcatcaacaagagtgcgaggggactgcgagattgggaagtcaaatttgaaatcttgggagtttctgaagaatcttttagaaggtgtcattcttggatccatttcaatgaaggaagaagtttcatcagaagcatcaagagaagttctgagggagccatctaggctttctagtgatggcttcaggttcactaaccaactataagagaagctttcaatagaaagaggatgagaagttcccatggcttctaactttgaaggtgtggaaggaattcttgaaataattcacaatttggacagtgtaaagaaaagccttaagcctctcctcttatcc

SEQ ID NO: 9427 - DNA, 788 bp, Glycine max
gggaagaagaagaagaaaccacgacacaagtccaaagtttgattccaaaatgcgatcctcaagcattcgcagcttcaccatcttcaccctctttctcattgcgatcctcccccacggacacgcaacaactccaacctccaaacttcgcctcaaacctctctcttctcccttttcaaccgccctcgaaaccctccagaaacaactcgggtacaccttcaagagcatcgatcttcttcgtcgcgccgtgacacacgcttccttctccgaagaaaacaacaaagctttcgccattctcggcgccagcgtcatcgaaacctccgtctctttccatctgctctccagagacgttgatctttcttccaaagagctgaaccgtcgattgtcccaaatcaccaacgtcgattcctcctgcgccgtcgacggaacgcgattagggttgcacaaggtggttcgcgtctcgcccaagacaaattcctccgcccccgccgtcgtttgcggcgccttccgagcaatctttggcgctgttgctattgacaccggcaagtccgatgacgcaggcaacgttttctggaaccttcatggcggtggtgacctaggagttgccgtggctctttgaactctgactctgtgagttcagttatcaattttcttctgtttgtgtttgttgctcaagatacttcttaattactcttgttagtaatggaccactaattgtgaagtagcgaatgacagtgtagtgtgtgatgctataactatattaactactgttttatctttttatcggcaaa

SEQ ID NO: 9428 - DNA, 1353 bp, Medicago truncatula
gacatcactcactcttctctctctcaaacaaaaactcttgtttctcttctcatcaatcttccattttcgattcctttcatttcatcaaaaatggccaaagacccagttcgtgttcttgtcactggtgccgcagggcaaattggttatgctcttgtcccaatgattgctaggggagtgatgctcggtcctgatcaacccgtgattcttcacatgcttgatattgctcctgcagcagagtcattgaatggagttaaaatggagttggtggatgctgcatttccacttcttaaaggtgttgttgctacaactgatgttgtcgaggcatgcactggagtcaatattgctgtcatggttggtggattcccaagaaaagaaggtatggagaggaaggatgtgatgtctaagaatgtctctatttacaagtctcaggcttctgcccttgagaagcatgctgctgccaactgcaaggttctggttgttgctaacccagcaaataccaatgcattgatcttgaaggaattcgctccatctattccagaaagaaacatttcttgtttgactagactggatcacaatagggctttgggacaaatttctgaaagattgaatgttcaagtttctgatgtaaagaatgtcataatctggggtaatcattcatcaacccagtatcctgatgtcaaccatgcaactgttaacaccccagctggggagaagcctgtccgcgaacttgtttccgatgatgcatggttgaatggagaattcatttccactgttcaacaacgtggtgctgcaattattaaggctagaaagctttcaagtgctctatctgctgctagtgctgcctgtgaccacattcgcgattgggttcttggaactccccagggtaccttcgtctcaatgggagtgtattctgacggttcctacaatgtaccatctggattgatctattcattccctgttacctgtgccaatggtgaatggaaaatagttcaaggactttcaattgatgagttttcaaggaagaagttggacttgacagccgaagagctgtccgaggaaaagaatttggcttactcttgcctctcttaagctgctttatttttgtctatagaagtagtagcctcaattttgaataatgctccttctagatacatgaactatgagtgtctcgtctttggaattacttgtattgcaagtctaacggattttggtcacagtggtgatacaagaatttcgatgtttgttgggactgcacaagcgtgcagttaaaacacatacatctaatccttgtgattgagtaccatgcaattgtattgcaaaataaagccaccatggacttcattatgaatttag

SEQ ID NO: 9429 - DNA, 1399 bp, Cicer arietinum
cacaaaaacactcttcttcatttccatttcaatattctcttttcgattcatttcatttcttaagaaatggccaaagatccagttcgtgttctcgtcactggtgctgcagggcagattggatatgctcttgtcccaatgattgctaggggagtgatgttgggtcctgatcaacctgtgatccttcacatgcttgatattccaccagcagctgagtcgttgaatggtgttaaaatggagttggtggatgctgcttttcctcttcttaaaggtgttgttgctacaaccgatgtggttgaggcatgcaccggcgtcaatattgcagtgatggttggtggattcccgagaaaggaaggtatggagaggaaggatgtgatgtctaagaatgtctctatttacaagtcacaggcttctgcccttgaacagcatgctgctgccaactgcaaggttctggttgttgctaacccagcaaataccaatgcattgatcttgaaggaatttgctccatctattccagagaaaaacatttcttgtttgactagattggatcacaatagggcgttgggccaaatttctgaaagattgagtgttcaagtttctgaaataaagaatgtcataatctggggtaatcattcatcaactcagtatcccgatgtcacccatgcaactgttaaaactccagctggggagaagcctgtccgtgaacttgtttctgatgatgcctggttgaatggggaattcataccaactgttcaacaacgtggtgctgcaattatcaaggctagaaagttgtcaagtgcactatctgctgctagtgctgcttgtgaccacattcgcgattgggttcttggaactcctgagggcacctttgtttcaatgggagtgtattctgacggttcatacaatgtacccgctggactgatctattcattccctgttacctgtgccggtggggaatggaaaattgttcaaggactttcgatcgatgagttctcaaggaagaagttggatttgacagcagaagagctttccgaggaaaagaatctggcttactcttgcctctcttagactgtttttttttgtctatagaagtagcttcaattttgaataatgctccttctagatacacatgagttatcagaatctcttcctttggaattacttgtattgcaagtctagttctttttgttgtaatggattttagtcagggtggtgatactaagaattttgatgtttgttgagactgcacaagcgtgcagtcaaacacatatatcttttccttgtggttgagtactatgcaaattgtattgcaaaataaagccatcatgaattgtttattatgaagttagagaacttattagaaaggcagaagttcaaattttcataaaaaaaaaaaaaaaaa

SEQ ID NO: 9430 - DNA, 1312 bp, Glycine max
ggcacgaggctcaaatctcttcgttccttcgattcgttccatttcttccaaaatggccaaagacccagttcgcgttctcgtcactggagctgcagggcaaattgggtatgctcttgtccctatgattgctaggggagtgatgttgggtcctgaccagcccgtgatcctccacatgcttgacattcctccggcagcagagtcattgaatggggttaaaatggaattggtggatgctgcattccctcttcttaaaggtgttgttgccacaactgatgtggttgaggcatgcactggggtcaatattgccgtgatggttggtggattcccaagaaaagaaggtatggagaggaaggatgtgatgactaagaacgtctccatttacaagtcccaggcttctgcccttgaaaagcatgctgctgccaactgcaaggttcttgttgttgctaacccagcaaacaccaatgcattgatcttgaaggaatttgctccatctattcccgagaagaacatttcttgtttgactagattggatcacaacagggcattgggccaaatctctgaaagactgaccgttcaggtttctgatgtaaagaatgtcattatctggggcaatcactcatcaacccagtatcctgatgttaatcatgcaactgttgcaacctcagctggggagaagcccgtccgtgagcttatagctgatgatgcctggttgaatggggaattcattactactgttcaacaacgtggcgctgcaattatcaaagctagaaagctttcaagtgcactatcagctgctagtgctgcttgtgaccatattagagactgggttcttggaactcctcagggcacttgggtatcaatgggagtatattctgatggttcctacaatgttccagctggacttatatattcattccccgtcacttgtgccaatggggaatgggcaatagttcaaggactttccattgatgagttttcaaggaaaaagttggacttgactgcaaaagagctttttgaggagaaggcattggcttactcatgcctaaattagaccccattgctttttgtctactgtccttgttagtaggttcccatgttttgcctataaaagtgtagcttcaattttgaataatgctccttttaagatacaaaggaactatcactggagaagagtctgtttttcattggaattacttgtatttcaacatttaatccttttaggaggaggatatttgagcccatgggccgcatattgaattttggattagtcctaaaaaaaaaaaaaaaaaaaaaaaaaaaaaaaaaaaaaaaa

SEQ ID NO: 9431 - DNA, 999 bp, Lupinus angustifolius
atggccaaagacccagttcgtgttcttgtcactggtgctgcagggcaaatcggatatgctcttgtccccatgattgctaggggagtaatgctgggatctgaccagcccgtgatcctccacttgcttgacattccacctgcagcagagtcactgaatggtgttaaaatggagttggtggatgctgcattcccccttcttaaaggtgttgttgctacaactgatgcggttgaggcatgcactggggtcaatattgctgtaatggttggtggattccctagaaaagaaggtatggagaggaaagatgtgatgtctaaaaatgtctctatttataagtcccaggcttctgctcttgaaaagcatgctgctgctaactgcaaggttctggttgttgctaatccagcaaacaccaatgcattgatcctgaaggaatttgctccatctatccctgagaaaaacatttcttgtttgactagactggatcataacagggcactgggtcaaatttctgaaagactgaacgttcaagtttctgatgtaaaaaatgttataatctggggtaaccattcatcatctcagtatcctgatgtcaaccatgcaactgttacaaccccagcaggggaaaagcctgtccgtgaacttgttgctgatgatgcctggttgaattcggaattcatagctactgtccaacaacgtggtgctgcaattattaaagctagaaagctttcaagtgcactatctgctgctagtgctgcttgtgaccacattagagattgggttcttggaactcctgagggcacctgggtctcgatgggagtttattctgatggatcttacaatgtaccagctggactgatctattcattccctgtcaccactcagaatggggaatggaaaatagttcaaggacttgcaattgatgagttctcaaggaaaaaattggacttgacagcagaagaactttctgaggagaaagctttggcttactcatgcctctcttag

SEQ ID NO: 9432 - DNA, 1353 bp, Plantago major
tctcatcctcttcacctcgttatcatcatcttcttcctttctcagaccacagatctcgcgaaaatggccaaagatccagtcagagtcctcgtaaccggtgctgcaggacaaatcggctatgcccttgttcctatgattgccaggggaattatgttgggccctgaccagccagtgatcctccacatgctggatattgcacctgctgctgaggcgctcaatggagttaaaatggaattggtggatgcagcttttcctcttcttaaaggtgttgttgctacaactgatgctgttgaggcttgcaccggtgtgaatgttgctgtcatggttggtggattccccaggaaggagggtatggaaaggaaagatgtcatgtccaagaatgtctctatctacaagtcacaggcttctgctctagagaagcatgctgccgctaactgcaaggttttggttgttgctaatcccgccaacaccaatgcattgattctcaaggaatttgctccatctatccccgagaagaacattacttgtttgaccagactggaccataacagggctcttggacaggtgtcagagagattgagcgtgcaggtatcagatgttaagaattgcatcatttggggaaatcactcatcatctcagtatcctgatgtgaaccatgctaccgtaaaaactcccgctggagataaacctgttcgtgagcttgttgctgatgaccaatggttgaataccgagttcatttcaactgtccagcagcgtggtgctgccattatcaaggctaggaagttttctagtgctctttctgctgctagctctgcttgtgaccacattcgtgattgggtcttgggaactccagagggtacctgggtttccatgggtgtatactctgatggctcgtacaatgtaccagctggattaatttactcattcccagtgacttgcaagaatggagaatggtcgattgttcaaggacttcccattgatgagttctcaaggaaaaagttggatctgacagctcaagaactcagtgaggagaaagaattggcatattcttgcctctcttaaattctttactgtgtggaagcaatcatatgtccagtgtccgtcccgatggtgatactggtgttgttgttttaaataatgccattttgtaatggtggaagctttttccatggattttactcgggcgtgtaacttttatattcggaaagaacttcacttactcctgttacctatttggtctgaggatgagttttcagttttataaacttgaatcatgtctcatttctgagattcatcataatcaatgctcaaccttagttttcagttttaacacattaaaaaaaaaaaaaaaaa

SEQ ID NO: 9433 - DNA, 1220 bp, Solanum tuberosum
gttcatcgctctggttacttctaatcttcaacaaaaatggccaaagatccagttcgcgttctcgttactggtgctgcaggacaaattggatatgccttggtgcctatgattgccaggggagtgatgttgggcgcagatcagcctgtaattctccacatgttggatattccacctgctgctgaggcactgaatggagtgaagatggaattagtggatgctgccttccctcttcttaagggtgttgttgctacaactgatgctgttgaggcatgcactggtgtcaatgttgcggtcatggttggaggtttccccaggaaagaaggcatggaaaggaaagatgtgatgtcaaagaatgtttctatttacaagtcccaggcttctgcacttgagaagcatgcagctcccaactgcaaggtgttggttgttgctaaccctgccaatacaaatgcattgatcttgaaagaatttgcaccatccattcctgagaagaatattacctgtctcacaaggttggaccataacagggccctcggccaaatctcagagagactgagtgtccaagttagtgatgttaaaaatgtcatcatttggggaaaccactcatcatcacagtatcctgatgtcaaccatgcaacagttacaacacctgctggtgataagccagtccgtgaacttgtggctgatgatgcatggttgaacggtgagttcatttctactgtacagcagaggggtgctgccattatcaaggctagaaagctttctagtgccctttccgctgctagttctgcttgtgatcacattcgtgactgggtccttggaactccagagggcacttttgtttctatgggtgtttactctgatgggtcatacaatgtcccagctgggcttatttattccttccccgttacatgcaaaaatggagaatggtccattgttcaagatcttccaattgacgagttctcaagaaagaagttggacttgacagccgaggaactatctgaggaaaaagcattggcttactcctgccttacttaaattgcccaaatatcctgaattgccttttcgacatatgaggagtgtatgtggtaatagaagtggcttcagttttgaataaggccattgttgattcttgagggaagtgatgatgatgggaatactgctttgtcagttgtttatgtactctattttatgccaaaatttcgagatagaactgatgtctt

SEQ ID NO: 9434 - DNA, 2409 bp, Glycine max
gaaatggattggatcggatcgaatcttactcgtttacaaaaaaacattgagggggcaacatacatgccacacaaatataaaaaaaacttgaatcatcattatcttcaccattcatcaattcaaacaacatcatcatcatcatcaccatctccaaaacatttcttcttcatgcttcttaaaagggcttccttcttcccccttcttgtggatccgctcaattgatttttttttctttctttccatcatatcattcattcagaatcactttccatgcttcccatagccttcaaccctcttggtctctgcatccaaaaaaaaagaaaatatataagccgtgtggtatatatacatgcaaacacacaagctatatagaaatttagatctaagtcacaaaaggtaaagtaaaaagcccacaacacaaaaccaccaaccacgtaccttcttgttacttttcttctccctaacttcatatctctcttggcacatatcagtcaaccacgccccgggactcaccaactgtaaccaaaaacaaacaaagacaagataaggtggtgagaataaagatcaacccaaccccaacccaaatcacccaccaaaattaaccccctttttttactataaataaaaacataaaatacccttttttaattaagagagagagagaaacaaaaaacaacttacaagtaagcttctttgaatgattttggccctctttttgggtcgctgaggaagcttgcaacccttcatggccagaaaatcttcctctttctccttgcttgagagagtgatgtagagcttgggccaaactagggctcgttcttcgccgttgatgccttcgccgccggtgaccttgccgttctcctccgccgaaccccgcgtcgtgtagtaccggtcctccttctccggcgacgccgatttccttgtctcgccggccgatgaccggagaatcgccccgtcggaattcctgcacccaaattaaacgtcaaaaaccacaacaaaaaacataaaaatacgtaaatttcagacattatggcagaattaacagatccaatgccctcttgttctaaaaaaagaaaaacaaataaaaaaacggttacaccccaaaaaagtatattcttacggctttaccccatctgggtatgttaaaaaaaacttgattttttacatcatcaaaaacctattttttcctgttaagaagaaacgaatagtgaaatgaaaaaaaaaagaatttttttctcccttagctgcttttcatcctctgagagaattctcagcaactctaaaaagggaaaacaacaccattacaacccatcaatcaaaaccccatttttcttcttcttgaaaccaaacaaaatgaaagaaaattggagacgggcaacatcattacatcccatcaacccaaaatcacatcttctctgggaagccaaccataagccagaaaaaagaaaaagggtagaaaagtgggggaagaaaatcatgaagaaaccaaatccccttagttgatgttgttgttttcagcaccttgtaaggcgattaagttgttgatgatgatgatggtgatgatgttctttttctggcacagtgaggccagagcgatgatgctccattgcagaaccaagtttccttctgattccaccgttgagcctcgctgaaatccgagggtccttcaccctcacacatctcagcctcttcctgttcccccactgcaagaaaaactctggctccgaagccttgcaatctttctggttcctctcttctgtttccataacctacaccacaaaacaaaacacaacacaacacaacaaaaaacgttcatcaagcttcggtttttcgccacaacacaaaaagggggaaggtggcgaatgaagaaacaaaacaataaaaaagaaaaacccaatttgggcttcgagattaggataataccaccaaagtgtgtgaaggattttgcctccaacctcaagatctgtgtctctctgaagagacaacaaccctttgtgaaaaaattgtcctgcgaggtgaaaaccagagatgatggggtcagaacaaggtgagtttgaagaacaacaaaaagagacccttgaatgtgaataagaagaaaacttacaatgataaaaattcagacacgaagaagggtgtgtgtgtgtgtgtgtgtgtgtgcgtttgtgtgattttctctgcaaacaacaacaacaacaaaaagagagagagaaatcacagatcttctttctcagctgttaaatttgcaaagtttcatatcttcctttgcaaaacaatttttctttcagttcttattttccttcacacacctctctcgaagaagtggtgtatgtgtgtattctgcagcactttctctctctatatctctatttttctgtgagtgaaatggagtttgagggttattatgtgctc

SEQ ID NO: 9435 - DNA, 1323 bp, Vitis vinifera
agagctaacaaacgttgaaacagagactgtgagacacagagagaccaagaaaaagcagcttcagagcagatatagagaacgtggagacgatatccaagcgattatcctggattttcgatctggattttctatgtttttcagtattacttgatattttcctggaaaattcgtcttttctcgacgcatttgactctctcacatgaaattttgaggaagatttcctctgtcagagtcgtagatcttgaggttgaagatgatcaccttgacgctgtgtgtggtggctaagaaattgtaggagaacgagtggaaacgtgaactagctgtcgtgaaattgcgagatatggagaaggaagagaagagccagagaacctataaaggtccagaaactgattttttcttacagtggggtaataggaagaggcttagatgtgtgagggtcaaagacccaaatgtttcagttcgatccaatggtgctattcgcaggaaaatcacatctcgtattgatcgctccgtcgtcactggttctgagaaagaaagcgctcatcttcaacccagtcgcttcacaaggaatacagagggtgcgacgcttagatcggtgacaaacgagaaccggaaatcgggttcgtcggagaaggaagatcggtactacacgaccagaggatcggcgggtatggatgataacggcaaagtttcggttgagggtggaggaggaggtgatgacagaggtctggtgtggccaaaactctatatttcactgtccagcaaagagaaagaggaggactttatggctatgaaaggctgtaaactccctcaaaggcctaagaaaagagccaagatcattcagagaagcttacttttggtgagtccaggggcatggttgtctgatatgtgtcaagagaggtatgaggtgagggagaagaagacttctaagaagagaccaagaggattgaaggccatgggaagtatggaaagtgattcagaatgaaagagcagaagggggctttcctttggtttttgaattttgaattttgatttctttcttctatggcaagtggggaagatgagatgaggctggcctgtataggagtcttttctaatttataatgagaaaatacttttatcatttcttcttcttcttcttcttcttctactcccttctttggaatgggccactctagacattgggggcttttgcagctcctagtattagagagagtaccctttctttttaagggcaagttcatatccttcccctgaagaaggtaaagttgcttgtagaatcttcacacattatgacagtaaaagtaattatttgcctttttt

SEQ ID NO: 9436 - DNA, 1437 bp, Populus trichocarpa
acaaggaagagaggctttggttgagagaaaccgagcaaacagagagagacttgcagagccacaaacacaaagaggcagatttaattttcttcttacagagagatactcttgttttgttttatagaaaattttgcttctctctatacagagagcaagtaatatcatattgtgtttgctcttgaaggagtttcatttctcatgctattacctcttgacatggagaaagaagagagaaaccagagagctacttgtaaaggtttagaaccagagtttttcttgcagtggggaaataaaaagaggcttagatgtgttagagttagagaccctcaaatcatttctcagagatctgatggtgtttttcgcaggaaaaccacttctaggattgatagatttgttgtctcttctgctaccacagagaaagacacttatcttcctcaatctaatcgcctcacaaggaattctgaagcagcgatacttaggtccagtgtgactgagaacaggaaatcatcttcaccggagaaggaggaccggtgctatactacaagagggtcagggattctggatgagaatggcaaggtttcaatggatggtaacaatggagatgataaaggacatgtttggccaaaactattcattactttgtcaagcaaagagaaagaggaagattttatggctatgaaagggtgtaagcttcctcaaaggcctaaaaagagagccaaaattatacaaagaagtttacttttggtaagccctggggcatggttgactgatatgtgccaggagaggtatgaagtcagagagaagaagagttctacttctaagaagagaccaagaggattgaaggccatgggcagtatggaaagtgattcagaataacattcgttacattttagcagcagagaggcttattgtttttctattgaattttttgggatttttttgggagaagatgatagttggtggctggaatctgttgcgaggaaagatagagagagtaagcagtctctgcatggattgtatgtttgttgctgtaatgtatagagtaatttttctgctgtcttaccaccaccattctaaccaaagtacagccatccctgtcttttattgaaattgtctcccccccatttctctaatctctagaacgatgtcgagatccagttttccttgtcctgggaaaaagaaatgcaatgagattccttcccttccctaaatccaatgccaaaaaggcaagaacctctcgtaaaggcatgaatgatatcaagcgggcatcgtgttatggtctaaactcgaaataacttgtcgagtatgatggctcaccttgcggcgtcttctgcggatagtttttgggaaatttctttattcttgcaaaatattttcttaaaaatatgtagttttccattatgaaaagccatttgttcggcaaaaaaaaaaaaaaaa

SEQ ID NO: 9437 - DNA, 880 bp, Cicer arietinum; identical to SEQ ID NO: 9367

SEQ ID NO: 9438 - DNA, 828 bp, Glycine max; identical to SEQ ID NO: 9368

SEQ ID NO: 9439 - DNA, 1010 bp, Glycine max; identical to SEQ ID NO: 9369

SEQ ID NO: 9440 - DNA, 820 bp, Glycine max; identical to SEQ ID NO: 9370

SEQ ID NO: 9441 - DNA, 890 bp, Prunus armeniaca; identical to SEQ ID NO: 9371

SEQ ID NO: 9442 - DNA, 871 bp, Vitis vinifera; identical to SEQ ID NO: 9372

SEQ ID NO: 9443 - DNA, 612 bp, Gossypium hirsutum; identical to SEQ ID NO: 9373

SEQ ID NO: 9444 - DNA, 1526 bp, Pisum sativum
gatcattattaggtcaaattcattcacttcaatttccattcacttgaaaaaatgtccgttgcggagctcaaagaacgtcacatagcagcgacggaaacggttaacaatctcagagaacgattgaagcagagacggctttctttgcttgatacagatattgctggatatgctaggtctcaaggtagagctcctgttacttttggtcccactgatattctttgctgtagaacgctccaaggtcataccggaaaggtgtattcattggattggacttcagaaaagaataggattgttagtgcatcccaagatggaagattaatagtgtggaatgctctaacaagccagaaaactcatgctataaagcttccttgtgcatgggtcatgacgtgtgctttctcaccaactggtcaatctgttgcttgtgggggccttgacagtgtttgctctattttcaatcttaattctcccactgatagggatgggaatctaaatgtttcacggatgcttagtggacataaaggttatgtttcatcttgtcagtatgttccaggtgaagacactcacttaatcactggttctggagatcagacatgtgttttatgggatattactactggccttagaacatctgtttttggaggcgagtttcagtctggacatactgcagatgtacttagcatttccattaatggatccaactccaaattgtttgtatctggttcttgcgatgcgactgccagattgtgggacactcgtgtggcaagtcgagcagtgcggacatttcacggccacgagggagatgttaattctgtcaaattctttcctgatggaaatagatttggaactggctcagaggatggaacttgcagattatttgacattaggaccggacaccaacttcaagtatataatcagcaacaccaagacaacgaaatggcacatgtgacgtccattgcattttccatatccggaagacttcttattgctggctatacaaatggtgattgctatgtttgggatactttattggctaaggtggtcttgaatctaggatctcttcaaaactctcatgagggcaggatcacctgtttgggtatgtctgctgatggaagtgctttatgtacaggaagttgggacacaaatttaaagatatgggcatttggagggcataggaaggtgatttgactccattgttagggcttcaccttgttaatgatgcttgtgatattgactttgatccagaattggaaggcaaagtttatctccatgtttataacctttagcagtggaactagtgcagcctttatttatctccatgctcattggttcgtgtgtgtgatttaggtatatatatacctttaaaccaaaacagaggactatttaattttctgtctcctcaatttaactatttgaagtatgtgtttggttcacattggaagaactaaatgtactagtatgtttatagtggttgaatcagatttggatcaggtaagggggtgtttggatccccattgtaaaaaaaaaaa

SEQ ID NO: 9445 - DNA, 4090 bp, Pisum sativum
atgtccgttgcggacgtcaaagaacgtcacatagcagcgacggaaacggttaacaatctcagagaacgattgaagcagagacggctttctttgcttgatacagatagtgagtttttgtttttgattctttttaactcttcaattcgattttgttgttgctaattcattagatctatctaactgaataaaccctagttgctggatatgctagatctcaaggtagagcccctgttactcttggtcccactgatattctttgctgtagaacgctccaaggtcataccggaaaggtaaattcaattcaattccaacttctttttttaatttctaataatatttttgctgtttttaacactttatttgattctcgaaattttgttagttagtatctaaattagttagtaagaaatatttcgagattaatcatttgaatcgaaatatgattctggatagaacaatatggagccacaagtaaattcagcgcattccatgtggctacaatctgtctagtgtccatcatctgtgtccagattctcgatgcttcttagttaacaatttgacagaagtgtaaaaaattattgtaacatttagggattttttttgtttcgattctttgtttaacagagtgtaacggtgtgagagttagacgaggtgagtgcccaattgtttgtgttgttttggaaaaccttagggaaggttattattataatttgcttttttttttttcaatataaggatttccatgttaatattgttatatctcagtctttaatgcctctcattagatttgtattgtatgctttttattaccacgtgcttcgtcaataagtttcaacggaactgatggaaatcaaagttgttaatgaatggttgcaacggggtaacgccacacacataacgataaagcaaagtgctagaagcagtaagcaccccatggcggttatgtatgactttggcatacaagacacgtacgccttgtttgtaacggttttagaaagttataaaacgctataaagggtaaaatagtataaatgttaaacaactataattgtcagcttttggagtcatctagcctgagcaagagtcatttactattttgatcacttattttgatagatatcaaggatagcttgagttttgatttgttgtgagatatgtgtgattgcttttatttactacgtagcaacattgataactcgttaactctgcattcatttaaatttgacaggtgtattcattggattggacttcagaaaagaataggattgttagtgcatcccaagatggaagattaatagtgtggaatgctctaacaagccagaaaactcatgctataaagcttccttgtgcatgggtcatgacgtgtgctttctcaccaactggtcaatctgttgcttgtgggggccttgacagtgtttgctctattttcaatcttaattctcccactgatagggatgggaatctaaatgtttcacggatgcttagtggacataaaggttatgtttcatcttgtcagtatgttccaggtgaagacactcacttaatcactggttctggagatcagacatgtgttttatgggatattactactggccttagaacatctgtttttggaggcgagtttcagtctggacatactgcagatgtacttaggtacattaggagattactggataagtttgaatcagaatttgttctcaattcttagacagatacttgcaactgaatagcaaatcgagactgcttaaatgtcaataaaactgtttgtaacaatctttatacactgataaaataacgtaatctcactggtaggaaacacgctggctaaatgttaaaactattccatcttcctaaaatatagaatacccctatccggcactccattgccaaaatatattgtagcaagtatagaatgtaatttgttggatgacatgctgtatatgttgttttaataatagcaaaatctatgtatgagatgaaaatcagtagcatagttttttttagtatggaatcattgctaagaaatattttttctttgtccactcagcatttccattaatggatccaactccaaattgtttgtatctggttcttgcgatgcgactgccagattgtgggacactcgtgtggcaagtcgagcagtgcggacatttcacggccacgagggagatgttaatcctgtcaaattctttcctgatggaaatagatttggaactggctcagaggatggaacttgcagattatttgacattaggaccggacaccaacttcaagtatataatcagcaacaccaagacaacgaaatggcacatgtgacgtccattgcattttccatatccggaagacttcttattgctggctatacaaatggtgattgctatgtttgggatactttattggctaaggtaattgttgctttaatgtagttatgtaaaaacaaaattagggtgttttctttcttttcttatagcctcacaccactgtaaactggggattactatgtttagaacacttttcgcaaaagtgattgattcttcagtttaaccttaaaatgacagcagggtgtttttttctacttataatgcttagggaaactttattgcgaaaggtaaccagtgctttagtgtaatccagaacacagtaggattttttctttctacttattgcttcctaccatagtcgaaacaaacttggctttttagtggaacatatgcttctttatggttgtttattttcactatgaatccaactgtcaaatagaaatttcttattgagtaggtcaactttacaaattgtcataaaaatttcaaaactatttgatactttatcttcaattgaacgtgtaataagcttttcaaaagtaaaagcaaatgttcactgtaagattatatagctactaatttaaagttttatgaaatgttgtatggttgatcattaaatataatgtgataataacccacggttggatgggtaaatatagaaatatcgtcatggaagtgatgcattctgttctttaaaagtttaaaaactggttttttcaacacaacttctatcatgttaaaaagcacctgatctttctggcttggcagtgtagaactggcttggcagtgtagaactggcttggcagtgtagaactggcttatgtagaaaataagatactctgtggtacataacaacatcatcagttcctaataattagttgtttgctttacttctacatgcgatttgggggtgacttctggttccattttgcttttcaacatttcaacctgtggtgagcttgtgtgggaacaggtcttgagtctattaatcatgaaaagttcacttagcattatcttatttataaattggcccataactttctgatattcttttcgttatcacaacataatgcctttgatgtaaagttgttataaagctgtttattttgttttgtacttcgaagggctgtagtagatgtctcattattggcttcttgagttggatggtctttctgtctcaagtcattgcctaaaactttgttttgcgagccagtaaaaggagttaatgtttaaaaaagaaacctgaacaaaaataaaatggaactctgtcttgtaacatctagtcatagcattatatttctgacactgctttctttttccaattatttgtacttgtacttctgtggttgtgcgccttgtgcagcttttgtcggtaagactaactatatctgcttcctcatttgattgtaggtggtcttgaatctaggatctcttcaaaactctcatgagggcaggatcacctgtttgggtatgtctgctgatggaagcgctttatgtacaggaagttgggacacaaatttaaaggtgagcaatcattttagtctgataattaaaacttgtagcttatctgtggcataggatgattctaggattgaacttaaaaagaactatgcttttattaatgtgttttgttagtttataagctttccttcctctaaagttaaacctttaaaaagaatcaggaatgaagcaaaaatagaaagcaataatatatttatgatgccattcgagctatatgggcatttggagggcataggaaggtgatttga

SEQ ID NO: 9446 - DNA, 1611 bp, Pisum sativum
ctttcattcactttttctcccctaacaactaaccgtctttgtttctatctgaaaatcaaacaacaataatggaaagtatagttgtagattcatatcattattaggtcaaattcattcacttcaatttccattcacttgacaaaatgtccgttgcggacgtcaaagaacgtcacatagcagcgacggaaacggttaacaatctcagagaacgattgagcagagaccggctttctttgcttgatacagatattgctggatatgctaggtctcaaggtagagctcctgttacttttggtcccactgatattctttgctgtagaacgctccaaggtcataccggaaaggtgtattcattggattggacttcagaaaagaataggattgttagtgcatcccaagatggaagattaatagtgtggaatgctctaacaagccagaaaactcatgctataaagcttccttgtgcatgggtcatgacgtgtgctttctcaccaactggtcaatctgttgcttgtgggggccttgacagtgtttgctctattttcaatcttaattctccactcgatagggatgggaatctaaatgtttcacggatgcttagtggacataaaggttatgtttcatcttgtcagtatgttccaggtgaagacactcacttaatcactggttctggagatcagacatgtgttttatgggatattactactggccttagaacatctgtctttttaggcgagtttcagtctggacatactgcagatgtacttagcatttccattaatggatccaactccaaattgtttgtatctggttcttgcgatgcgactgccagattgtgggacactcgtgtggcaagtcgagcagtgcggacatttcacggccacgagggagatgttaattctgtcaaattctttcctgatggaaatagatttggaactggctcagaggatggaacttgcagattatttgacattaggaccggacaccaacttcaagtatataatcagcaacaccaagacaacgaaatggcacatgtgacgtccattgcattttccatatccggaagacttcttattgctggctatacaaatggtgattgctatgtttgggatactttattggctaaggtggtcttgaatctaggatctcttcaaaactctcatgagggcaggatcacctgtttgggtatgtctgctgatggaagcgctttatgtacaggaagttgggacacaaatttaaagatatgggcatttggagggcataggaaggtgatttgactccattgttagggcttcaccttgtaatgatgcttgtgatattgactttgatccagaattggaaggcaaagtttatctccatgtatacttagcagtgactagtgcagcttattatctcatgctcattggttcgtgtgtgtgatttaggtatatatatacctttaaaccaaaacagaggacttataattttgtgtctcctcaatttaactattgaagtagtgtttggttcacattggaagaactaaatgtactagtatgtttatagtggttgaatcagatttggctcaggtaagggggtgtttggatccccattgtaaaaaaaaaaaaaaaaaaa

SEQ ID NO: 9447 - DNA, 1503 bp, Glycine max
ggggaacatgtagtagaatagaagagaagagaagattgttaattgaagcagaggaagacctaacatgtccgttacggagctgaaggagcgtcacttggcggcgacggaaaccgtcaacagtctcagggagcgcttgaaggagaggcgtctttcattgctcgatacagatattgctggctacgccaggtctcaaggtagatcccctgtcacctttggtcccaccgatctcgtttgttgtagaactctccagggtcatgcgggaaaggtgtactcattggattggacttcagaaaagaatcgaattgttagtgcatcccaagatgggagattgatagtgtggaatgctctaacaagccagaaaacacatgccataaagcttccctgtgcgtgggtcatgacctgtgctttctccccaaccggtcaatctgttgcatgtgggggccttgacagtgtttgctccctttttaatcttaattcccccactgacagggatgggaatctagccgtttcacggatgcttagtggacataaaggttatgtttcctcttgtcagtatgttccagatgaagatactcacttgattactggttctggtgatcagacatgtgttttatgggatattactactggccttagaacatctgtttttggtggtgaatttcagtctggacatactgcagatgtacttagcatttccattaatggatccaactctagaatgtttgtatctggttcttgtgattcaactgcccgattgtgggacactcgtgtggcaagccgagcagtgcagacatttcatgggcaccagggggatgttaatactgtcaaattctttcctgatggaaatagatttggaactggctcagatgatggaacttgccgattgtttgacattaggaccggccaccaactacaagtatatcatcggcaacatggggacaatgaagctgcacatgtgacctccattgcattctccatgtctggaagacttctttttgctggatatacaaatggtgattgctatgtttgggacactttgttggcaaaggtggtcttgaatttaggatctcttcaaaacactcatgagggcaggatcagctgtttaggtttgtcagctgatggaagtgccttgtgtacaggaagttgggatacaaacttaaagatatgggcatttggagggtataggagggtgaattgagcccttaagggggggcaaagtcttttttttaccacctttgtctaggcctctcctttcactgtattgtggttcagtacaacccaatagcgatgctttcgatggtgaatgtgaagaaaaattggaagccaaaggctatatatagcctttaacaatggaactagtgcggcggtttttttctccccgtacctattggtccgtgtatgtgatctagtagtttttccattgtactcatcgctttgatacctgtatcttgaaccaaaatgaaggactgtttactttcttgtcaaaaaaaaaaaaaaaaaaaa

SEQ ID NO: 9448 - DNA, 1683 bp, Vitis vinifera
accacaactgcgccctcacgaggaaacgaaccacctggtacagcgtgggagctggcggcgtcagtcaacaacctcaccaccaccaccaccacctccaccacctcctcctcttccgtcacctataaatcttacttcgctttgcgctttctgtacattaatctaaattttgctcaaatctcctcatcagcaaaacctaaatttcatttctcagaaattaagacttaaagcgaagctttctttaatggcgaggggaaactgttaagagtattaaatatgtctgtagcggaactcaaagagcgccacatggcggccaccgagactgtgaactctctcagagaacgcttgaagcagaagcgacttttgcttctagacactgatgtggcgggatacgcaagggcacaggggaagagtccggtgacctttggaccgacggatctggtgtgctgcaggacgttgcaggggcatacggggaaggtgtattcattggactggactacagaaaagaaccgaattgtcagtgcttcgcaagatggccggttaatagtttggaatgccctgacaagccagaaaactcatgccataaagctgccttgtgcatgggtcatgacatgtgctttttctccgagtgggcagtctgttgcctgtggcggtctagatagtgtatgctcaatcttcaatctgaattcccccacagacaaggatggcaatttagcaatgtcaaaaatgcttagtggacataagggttatgtgtcctcttgtcagtatgtcccagatgaggacactcacctaataaccagttctggtgatcagacatgtgttctatgggatattaccacagggctcagaacttctgtgtttggaggtgaatttcaatctggacacactgctgatgtattgagtgtctcaattagtggatcaaactcaagaatgtttgtatctggttcatgtgatgcaactgcccgtttgtgggacactcgtgctgcaagtcgagctgtgcgtacatttcatggccatgagggagatgttaatactgtgaggttctttccagatgggaatagatttgggactggctcagacgatggaacttgcagattatttgacatcaggacaggtcaccaactccaagtatattatcaagaacatggtgataacgaagccccacacgtgacctccattgcattctccatatcaggcagacttctctttgctggatactcaaatggggattgctatgtctgggatactttattggcaaaggtggttctgaacctgggatctctccaaaactcacatgatagtcggatcagctgtttaggtttgtcagctgatgggagtgccttatgtacaggaagttgggacacaaaccttaagatttgggcttttggaggacacaggagagtgatttgagttgttaaaggagaaaatggcctccaagttaccttctgtccctggtctgtggttcttattgtattttcaatgcagtgtagtccctggggtcccattttgtatcgagtcgcttactgtgggctgaggaaccataaccgtgtactgcttcttgtaatcctcatttgaaaaattgacagttggattattagagagaaaaaagggggaatgttgctggagaacttggaactggaggggttatttgtttgtttatgtgcatctacaaaaaaaacttgcctg

SEQ ID NO: 9449 - DNA, 1089 bp, Medicago truncatula
gatctaacaaaaacaaaacactcatttcattatttctatctattttcttttctgtaagtaaattatctttcaaattttcttcttgttgtttgcaacaatggcttcaacagcttcaagattcatcaagtgcgtcacagttggagacggagctgtaggcaaaacctgcatgctcatttgctacaccagcaacaaattccccactgactatattcctacagtgtttgataattttagtgcaaatgtggttgtggaaggcattactgtcaatttaggtctctgggatacagctgggcaagaggattacaataggctgaggcctttgagctacagaggggcagatgtctttgtcttggctttttctttagttagtcgcgcaagttacgaaaatgtgttcaagaagtggatccctgaactccagcattttgcccctggcgtccctgttgtacttgttggaaccaaattggatctccgagaagacagacattatttggctgatcatcctggcatggtgccggtgactactgagcaaggtgaggaactccgtaagcagattggagctacatattatattgagtgcagctcaaaaactcagcagaatgtgaagggagtttttgatgctgcgattaggatggtcatcaagcctccacaaaagcaacacgagaaaaggaaaaaagctcgtcgaggctgtttcctaaatgtcctctgtggaaggagcatcgttcgtcataaatgaaactcttcaatattcaatcccaaatttcaaaagctttatgtgccatggggaagtagtttgcagaaattttaagcttgacgtaaaatcattttgttggagtttgcagtatagtatatagcattatagctacttacatttgaccgttttcaattttagtttcttgataggtttatatggtttgaggaattatgaaatatttgcagcttatatattgtaaagaaatgacacaatttcttgaccagctaccattttgtttgaattactatgtacatatagcttagcagttgtttggtccagacagactaatatttttcaagcatttcaattgagattttctccggccaaaaaaaaaaaac

SEQ ID NO: 9450 - DNA, 781 bp, Glycine max
ggaatccatcacacaacaaaacacccacacttctggtttgttttgttttgtttaaattattttgagagagtttcttcttcctcttcttattgttgttgttccaatggcttccgcaactgccccaagattcatcaagtgcgtgaccgttggtgatggggctgtagggaagacctgcatgctcatttgctataccagcaacaaattccccacggactatatccccactgtgtttgataatttcagtgcaaatgtggttgttgaaggcataactgtcaacttaggcctttgggatacagctgggcaagaggattacaacaggctgaggcccttgagctacaggggggcagatgtctttgtcttggctttttctttagttagtcgcgcgagctatgagaatgtgctgaagaagtggatccctgaactccagcattttgcccctggcatcccgttggtgttagttggcaccaaatcggatctacgagaagacaagcactacatggctgatcatcccagcttggtgccagtgactactgatcaaggtgaggaactccgtaaacacattggagctacctactatattgagtgcagctcaaaaactcagcagaatatgaaggcagtttttgatgctgctattagaatggtcatcaagcctccacaaaagcaaaacgagaaaagaaagaaaaaaccacgtggctgtttcctaaacgtcctctgtcgaaggaacattgttcgccttaaatgaaacacttgatcagtatctcatccaaagctttcacgtgct

SEQ ID NO: 9451 - DNA, 1235 bp, Aquilaria microcarpa
  misc_feature (243)..(243): n is a, c, g, or t
ctttcacaggttgcctagcgaaaagtacccaaatgaaaaatttgttaagagacagcaaattgagcgagaatcatgtgatccaccatcactcttctctctcccccctctgtctctgaatcgaaatgccataaatttgtccaccgaacaaactgacaaccaattgggggttttctgcttgttcttgattttcgttccacttttcctttctacctttgttcctgattcttattttggcctttgctntcctttttggttccaatggcttcaagcgcctcaaggtttatcaagtgtgtcacggtgggggatggagctgttggcaagacgtgcatgcttatctgctacactagcaacaagttcccgactgattatgtaccaacagtctttgataacttcagtgcaaatgtgatagttgagggcaccactgtcaacttaggcctctgggacacagcaggacaagaagactacaataggctgaggcctttgagctatagaggagctgatgtctttgtcttggctttctccttagttagtcgagcaagctacgaaaatgtattaaagaagtggatcccagaacttcagcattatgctcctggtgtccctgtagtgcttgtcggcaccaaactggatcttcgtgaagacaagcattatttggccgatcatcctggatcagtgcccgtcaccactgcacagggtgaggaactccgcaaacagattggtgctgcttattacatagagtgcagctcaaagactcagcagaatgtgaaagcagtttttgatgctgcaatcagggtcgtgatcaagccaccacagaaacagaaggaaaagaagcaaaagcaaaatagagggtgcctcataaatgtcttctgtgggaggaacctggtgttctcttaacaggttcacatgccggcatgtctcgatgctgatggagctggtaaatttagctggggcaagggtttttgataaacagcttgtactcaatagtgtgtgagattgctataacagtttaaagattgatttttgcgtggtggtgctgtaacgtattgatgccaggcaaccacatcttatacatacgaatattcttcagagcacctgattatttcgctgttgaaggataacctacgtcttgtttgtaatatttgtattgccaccgttattacaattatcgatgaaacatattgctgggaagcgaaggaacaaactataatggaccgtgttttaggaaaaaaaaaaaaaaa

SEQ ID NO: 9452 - DNA, 1246 bp, Oryza sativa Japonica Group
actctctaggcaggcaacggcagcacaggcacagcagcagcgtggtggtgagagtgagaagcatgtgacccctcttaaaaacacttcgccgagaagtcacgcaccaaacaccaccaagaacgaacaactcttctccccctctccccctccttccttgctcctcctcccatcttgtctcctccctctctctcgcaaagtcgcaacgcgctcctcctcggtgaaacgggagtgaggtgcgtgcggccatggcgtccagcgcctcccggttcatcaagtgcgtcacggtgggcgacggcgccgtgggcaagacctgcatgctcatctgctacaccagcaacaagttccccactgactacataccaacggtgttcgacaatttcagcgcaaacgttgttgtggacagcaccacggtgaatctgggcctctgggatactgctgggcaagaggattacaaccggctcaggcctctgagctatcgtggtgctgatgttttcgtgcttgccttctctcttgtgagccgagctagctatgaaaatattatgaagaagtggataccggagctacagcattatgcacccggcgtgcccattgtgttggttggcacaaaattggatctccgtgaagacaagcactacttgttggaccatcctggcatgatacctgttaccacagcacagggtgaagaacttcgaaaacaaataggtgctgcttattacattgagtgcagctcaaagacacaacagaatgtcaaaggtgtgtttgatgctgctatcaaggtagtaatccagcctccaactaagcagagggaaaagaagaaaaagaaatcacgacaaggatgctctatgatgaacatgttccgtggaaggaaaatgtcatgcttcaaatcctgattgatcgagatgtcccttacatgatgcaatgttctgggtgcaacctcaagctggcaacctttggagtctgaatgtgctggtagagttagatgcaaagttcttgtgtatatttgcatcttttggtaattaattactagagttagatggttaaactagtctgcttatgtaccgcacaatgctcttattattagctcttgttggtctagaaagtctgatagatgccaaaggaacaaggagacaccgttctgtcaggacaaaatcacagattttgtaatcgatctgaagtctcagtatcgtcattagaacattttatgattcgatggtagaactgaaagcagcaactacaaagctcgccg

SEQ ID NO: 9453 - DNA, 985 bp, Arabidopsis thaliana
actcctctttttaagtaatctcacttcatttatctctctctctctctctatttcttttgcttccttttggtatttgctttgtatgtttgttttgagatcaaaatggcttcaagtgcttcaaagttcatcaagtgtgtgactgttggtgatggtgctgttggtaaaacctgtatgctcatctgctacaccagcaataaattccccactgactacataccaacagtttttgacaactttagtgcaaatgttgttgttgaaggcaccactgtcaatttggggctttgggacactgctgggcaagaagactataacagattaaggcctttaagttacaggggagcagatgttttcgtcttgtctttctcattagtcagccgagctagctacgagaatgtttttaaaaagtggatccctgaactccaacactttgctccaggagttccccttgtccttgttggtaccaaattagatcttcgtgaagataagcattatttggctgatcatcctggactatcccctgtaactactgcacagggagaggagttgcgtaagctaattggtgcgacgtattacattgagtgtagttcaaaaactcaacagaatgtgaaagcagtttttgattctgcgataaaggaagtgatcaaacctctggttaaacaaaaggagaagactaagaagaagaagaagcaaaagtcgaatcacggctgtttatcaaatgttctgtgtgggaggatagtgactcggcattgatgacgatgacccaactcagtctgatgattttaaactccacttttgagattgtgtgataaacgagagactttatattatatagattgaatcatgtaagagattattagcctctaatcaatcaatagttaccttgaagagagaaagagggggaggtagagagcttattattaattcaattgtgtttatttgtttcaaacctgttattgcaatatattagccattttgatacaacaga

SEQ ID NO: 9454 - DNA, 959 bp, Arabidopsis thaliana
atctctctattatctctctcacaatctctctggtttttgggcgtttcttcgttgaaagttgtttgcttttggtgagttagaatggcttcgagtgcttcaaaattcatcaaatgtgtgactgttggagatggtgccgttggaaaaacttgtatgctcatctgctacactagcaacaaattccctactgactacataccaacagtttttgacaactttagtgttaatgttgtggttgaaggcatcactgtgaacttaggcctttgggacactgccgggcaagaagactataacagactaaggcctttaagttacagaggagcagatgtttttgtgttggctttctcattgatcagccgagctagctatgagaatgtgtttaaaaagtggatccctgaactccaacactttgcaccaggagtccccattgtgcttgttggtaccaaaatggatcttcgtgaagatagacattacttgtctgatcatcctggactgtccccggtaactacatcacagggagaggaactccgcaagcatatcggagcgacttattacattgaatgtagctcaaaaactcaacagaatgtgaaagccgtatttgatgctgctattaaagtagtaattaaaccagcagtgaaacaaaaggagaagaagaagaagcagaagcctcgcagcggatgtctctcaaacattctgtgtgggaagaattgatgagtcaattccatctgatgattgttcacttctttttttttcttttcttttctaattggccagtttgtgattctgataagtcggaattacatagactctggcagagatgagcctcaattagtagcttcttcgattctgtttgtatatgtgaccctgatgtttgtttgtttcgatttggtttgacccttatagaattgttatagccattttgtagccaaaacttggagtagttcacgacttaacgtggttaa

SEQ ID NO: 9455 - DNA, 1057 bp, Nicotiana tabacum
ggcacgagaagctattaattccaagctatctccacaccctctccccaaacaagaaaattattaaatgtaaaacgtactactagacccccagttacatacataaacacacatcatctgcagaattttggtatgcaattttacgtactttcttgaggtatttttttttttatgttcaatggcctcaagtgcttcaagattcatcaaatgtgtcacggttggtgatggtgccgttggaaagacttgtatgcttatttgctataccagtaacaagttccccactgattatgttcccacagtgtttgacaacttcagtgccaatgtggttgtcgaagggaccacagtaaatttaggtctttgggatactgcaggccaagaagattataacagattaaggccactgagctaccgaggagcagatgtttttgtcctagcgttctccttggttagtcgcgcaagctacgagaacatacttaaaaagtggattcctgaacttcagcattatgctcctggaataccggtggtattagctggcaccaaacttgatcttcgtgaggataagcacttcttggctgatcatcctggattagttcctgtcaccaccgcgcagggagaggagctacggaaacaaattggtgctgcctattacatcgaatgtagctctaaaacacaacagaatgtgaaagctgtctttgatgctgcaatcaaggtcgtcatcaagccaccgcagaagcaaaaggagaagaagaaacaacgtcgaggatgtctcatgaatgtgatgtgcggaaggaagctcgtttgtttgaagtgacatttcaatgtacatatttcccatctgttcggcctctaacatgatttatatccatggctttagcgtgctgcctataaaacttacatttctatcagaacttttgtgacgagcataatgtatttgtttttccataacccaacttactgctggacggccttgatttgtctgtaaaatacgttacttgctaggtttatatttcaagtacatgtattaattctattaaaccaacaaaaaaaaaaaaaaaaaaaa

SEQ ID NO: 9456 - DNA, 927 bp, Glycine max
atgcaattccctcaccaatttggaaccacaacaaactcacctttccctcacccatctttccaaaaccagcaacaccagatgatatcatttgggtcttcccaacaacataataatctcgcatatccacccatcatagccagtgattcttcttcacttctacatcaacatcatcatcatcaacagcagcatcagcagcaccagcagcaacttcttcagtattggagtgacgcgttgaatctaagtccaagaggaatgttaacaagattgggaccagatggaaggccattgtttaggcttccaacacagcccataaacacaacaaaactctatagaggagtgaggcaacgccattgggggaaatgggtcgctgaaatccgtcttccacgaaacagaacgcgtctctggctaggcacatttgacacggccgaagacgccgccatggcctacgaccgagaagccttcaagctacgaggagagaatgctagactcaatttcccagaattgttcctcaacaaggacaaaaaagaagaacaacaacaacaagaacaagaagcttcttcgccagttctttcagctattgcaaagcagcatgagccttctagtgaacaccgtgacgtccccatagaagagtctaatgagaatgattcgggtgacgccacggtgagcgatgaccaggttcatgctactactgagagttccgaaggagtttctcaggaaatggtttggggagaaatgtctgcatggttcaatgctattcctgctgcttggggtcctggtagtcccatgtgggatgatttggatgccaccaataatcttctttgccaatcacacattcctttttccaatcccaatcaacaagaactcaatgatgctgagagacaagaacaaaacactggaccaggttacttgtggaaggatcaggattga

SEQ ID NO: 9457 - DNA, 924 bp, Glycine max
atgcaattccctcaccaatttggaaccacaacaaactcacctttccctcacccatctttccaaaaccagcaacaccagatgatatcatttgggtcttcccaacaacataacaatctcgcatatccaccaatcatagcccgagattcttcttcacttgtacatcatcatcatcaacaacaacaacagcatcagcagcaacttcttcagtattggagtggcgcgttgaatctaagtccaagaggaatgttaacaaggttggggccagatggaaggccattgtttagtcctccaacacagcgcataaacacaacaaaactctataggggagtgaggcaacgccattggggcaaatgggtcgctgaaatccgtcttccacgaaacagaacgcgtctctggctaggcacatttgacacggccgaagacgccgccatggcctacgaccgcgaagccttcaagcaacgaggagagaatgcaaggctcaatttccccgaattgttcttcaacaaggacaaaaaagaacaaggagaagaagaagcttcttcgccggttctttcggctattgcaaagcagaatgaacctcctcctgcccaccaccgtgacgtcacgatagaagagtctaacgaaaatgactcaggtgacgccaccgtgagcgacgaggttcatgctcctgctgctacagcgagttccgaaggggtttctcaggaactggtttggggagaaatgtctgcatggttcaatgctattcctgctgcttggggtcctggtagtcccatgtgggatgatttggatgccaccaataatcttctttgccaatcacacattcctttttccaatcccaatcaacaacagttcaatgatgctgatgatgctcagagacaggaacaaaacacaggaccaggttacctgtggaaggatcaggattga

SEQ ID NO: 9458 - DNA, 924 bp, Glycine max
atgcaattccctcaccaatttggaacctccccaaactcacctttccctcacccatctttccaaaaccagcaacaccagatgatatcatttgggtcttcccaacaacataacaatctcgcatatccaccaatcatagcccgagattcttcttcacttgtacatcatcatcatcaacaacaacaacagcatcagcagcaacttcttcagtattggagtggcgcgttgaatctaagtccaagaggaatgttaacaaggttggggccagatggaaggccattgtttagtcctccaacacagcgcataaacacaacaaaactctataggggagtgaggcaacgccattggggcaaatgggtcgctgaaatccgtcttccacgaaacagaacgcgtctctggctaggcacatttgacacggccgaagacgccgccatggcctacgaccgcgaagccttcaagcaacgaggagagaatgcaaggctcaatttccccgaattgttcttcaacaaggacaaaaaagaacaaggagaagaagaagcttcttcgccggttctttcggctattgcaaagcagaatgaacctcctcctgcccaccaccgtgacgtcacgatagaagagtctaacgaaaatgactcaggtgacgccaccgtgagcgacgaggttcatgctcctgctgctacagcgagttccgaaggggtttctcaggaactggtttggggagaaatgtctgcatggttcaatgctattcctgctgcttggggtcctggtagtcccatgtgggatgatttggatgccaccaataatcttctttgccaatcacacattcctttttccaatcccaatcaacaacagttcaatgatgctgatgatgctcagagacaggaacaaaacgcaggaccaggttacctgtggaaggataaaggatga

SEQ ID NO: 9459 - DNA, 1089 bp, Medicago truncatula; identical to SEQ ID NO: 9449

SEQ ID NO: 9460 - DNA, 691 bp, Glycine max
ggggggctctctccgaaatttcttagattgcttctgtgtcagagaaatcagtgcaacaaaaatggacgacaccgaaaccaaaggaagaatcgaagagactgtgcgtaggattttgcaagaatcggacatggacgaggttactgagtctaagattcgaaaacaggcctccgaacaccttggcctcgacctgtctcagccttatttcaaagcctttgtcaaacaggtcgtgaaggcttttctccaagaagaagaacaacgacagaaacaacaacaacaagatgaagatgaagaagaggaactaggaggagcttccaagggcaaggagtacgatgatgaaggcgatctcatcatctgcaggctttcagataagagaagggtgacgattcaggatttcagagggaaaacattggtctccattcgggagtattataaaaaggatggcaaggaacttcctacttccaaaggaataagtttgacagaagagcagtggtcagcctttaagaaaaatgtgcctgccatagaaaaagccattaagaaaatggagtcaagttgacacatggctttgcttgtttctttttgttgaatatatcctgcaccgcaccatggtgtctctttgatattggaccattttgttaaaggacttggagtcactgtttaagtgttttgcaacctgagtgcctaaagccatttc

SEQ ID NO: 9461 - DNA, 750 bp, Glycine max
ggatccccccgtttccgtatctctccgaaatttctgttagattgtttctgttctgtgtcagagaaatcagtgcaacaaaaatggacgatgccgaaaccaaaggaagaatcgaagaaactgttcgcagggttttgcaagaatcggacatggacgaggttactgagtctaagattcgaaaacaggcctccgaacaacttggcctcgacctgtctcagccccattttaaagccttcgtcaaacaggtcgtgaaggcttttctccaagaagaagaacaaagacagcaacaacagcaacaagatgaagatgatgatgatgaagaagaagaacaaggaggagtttccaagggcaaggagtacgatgatgaaggcgatctcatcatctgcaggctttcagataagagaagggtgccgattcaggatttcagagggaaaacattggtctccattcgggagtattataaaaaggatggcaaggagcttcctacttccaaaggaataagtttgacagaagagcagtggtcaacctttaagaaaaatgtgcctgccatagaaaaagccattaagaaaatggagtcaagttgataccgagttgacctctcaactctcaagtgatgtggctttgcttgtttctttttggtgaatatatcctgcaccatggtgcccctttgatactggacctttttgttaaaggacttgaagtcactgtgaatgtttttttgtgttttgcagcctgagtggctagagagccatt

SEQ ID NO: 9462 - DNA, 3111 bp, Arachis hypogaea
atgactgatactactgatgatattgctgaggaaatctccttccagagctttgatgatgattgcaggctgcttggtaatctcctcaacgacattctccagcgtgaagttggaaccactgttgttgacaagcttgagaggattcgtgtgcttgctcagagtggctgtaatatgaggcaggcagggattgtggacatggctgagatgcttgagaagcagttggcttccgagctatcaaagatgacactcgaagaagctcttaccctagctcgcgccttcagccactatcttactctcatgggaatagctgaaactcatcatagggttcggaaaagagggaataatatagcacaaactgcaaaatcatgtgatgatatctttaaccagcttgtgcagggtggagtttcccctgatgaactttatgacacagtctgcaagcaggaggttgaaattgttcttacagctcatcctactcaaattaatcgccgtaccttacaatacaaacacattagaattgctcatcttttggattataatgatcgacctgatcttaccattgaagatcgagaaatggtgattgaggacctggtgagagagataacttcaatatggcagaccgatgagcttaggcgtcagaaacccactccagttgatgaagctagagctggtttgaatattgtggagcagtcactctggaaagctgttcctcattatttacatcgagttagcaatgccttgaagaagcatactgggaagccacttccattgacttgtactcccatcaagtttggatcttggatgggaggcgatagagatggaaacccaaatgtgacagcaaaggtcacaaaagatgtatcccttctatccagatggatggcaattgatctctacatccgcgaagtggatagcctccggtttgagctatccatgaaccagtgcagtgagagtttgtcaagactggcacatgaaattctagaagaagctaaccttgagaatcgccatgaaaattggaatcaacctgtgagtagaagtcagtcacttccaaaacaacttccagcaagagcacatttaccctcttttgctgaaaatggtgaagctcaacatcccagactagacattccaggacctgatcactcacaacacaatcacaaggaaggtgaggtttcttcaactctattcaaaatcggcgaaacttcagcgaactccggggcttctgcagctgcaatatcaccttcttcttcattcaactccattcaacaacttggtcaaaggaaatcatctgcagggtcccagataggaaggtccagttttcagaagcttatggagcctaagctccctcagcttcctggaattgctccttacagagttgtcctaggaaatgtaaaagataagcttgagagaagtcgtagacggttagaacttcttcttgaggatgtttcatgtgacaatgatcctttggattactatgaaaccactgatcagcttttggaacctcttctcctgtgttatgaatctctgcaatcatgtggatctggggtgctagccgatggtagactcgctgatctgattcgtagagttgctacctttggaatggtgttaatgaagcttgacttgcgtcaggaatctgggagacatgctgaaacaattgatgcaattactaagtacttggatttgggaacatacagtgaatgggacgaagaaaagaaactcgagttcttaacaagagagctgaaagggaagaggccactagttcctcatagtatagaggttcctcatgaagtcaaagaagtcttggacaccttccgaattgctgctgagctagggagtgattcacttggagcctatgtgatatccatggcctcaaatgcaagtgatgtccttgcagtagagcttttacagaaggacgcacggctttctgttgctggagacttgggaagagaatgtcctggtggaacgttgcgggtggtccctctatttgaaactgtgaaggacctgcgaggagctggttcagttatccgaaaacttttatcaatagattggtaccgtgaacacgtcattaagaaccataatgggcatcaagaggttatggttggatattcagattctggcaaagatgccggccgctttactgctgcttgggaactttacaaagctcaggaggatgttgtagctgcttgcaatgagtatggtattaaggttacactgttccatggccgtggagggagtattggtcgcggtggtggcccgacgtatctggctattcagtcccaaccacctggctccgtgatgggaacactaaggtctactgagcagggagagatgatagatgccaagtttgggctgccacaaatagccgtgagacaactggaaatatacacaacagcagtgctacttgcaactcttcggccgcctcatccgccgcgtgaagagaaatggcgtaaagtgatagaagagatctcgaatatcagttgccagtgttaccgcagtgtagtgtatgaaaatcctgaattcctttcctacttccacgaagccacgcctgaagcagagcttggcttcctcaacataggcagccggccggcaagaaggaagagctcgaaaggaatcggacaccttcgcgccataccgtggctatttgcgtggacacagaccagatttgtgcttcctgcatggctaggtgttggtgctggattaaaaggtgcatgcgagaaaggccacactgaagagctaaaagaaatgtacaaagagtggccattcttccaaagcacaatagaccttattgaaatggttttggggaaagcagacattcctattgccaagcattatgatgaagttcttgtgtccaaggagaggcaagaactcggccgcgaactacggagtgagctcatgacggcggagaagtttgtgctggtgattagtggccatgagaaacttcaacagaataataggagcttaaggaggctcattgagaatagacttccatttctcaatccgttgaacatgttgcaagtggagatactcaagaggttaaggcgtgaggacgacaaccgaaagatcagagatgctttgctaatcaccattaatggaattgctgctgggatgaagaacacgggttga

SEQ ID NO: 9463 - DNA, 3099 bp, Glycine max
atgactgacatcactggtgatattgctgaggaaatctccttccagagcttcgatgatgactgcaggttgcttggtaatctcctcaatgacattctccagcgtgaagttggcaccaacttgcttgacaagatcgaaaggactcgagtccttgctcagagtggttgtaatatgaggcaggcgggtattgtaaacatggcagagatgcttgagaagcagttggcttcggagttatcaaagatgacactagaagaagctttcacccttgctcgtgccttcagccattatcttactttgatgggtatagctgagacccaccatagggttcgtaaaggagggaatatggcacaaattgcaaaatcttgcgatgatatatttaaccagctggtgcagggtggagtccccccagaagaactttatgacacagtctgcaagcgggaggttgaaattgttctcactgctcatcccacacagattaaccgtcgaaccttacagtttaaacacattagaattgctcatcttttggattacaatgatcgacctgatcttagcactgaagatcgagaaatggtgattgaagatctggtgagagagataacttcaatatggcagacagatgagcttaggcgccagaaacccactccagttgatgaagctagagctggtttcaatattgtggagcagtcactctggaaagctgtccctcattatttacgtcgtgtcagcaatgcattaaagaagcatacaggaaagccacttcctttgacttgcactcccataaagtttggatcttggatgggaggtgatagagatggaaacccaaatgtgacagcaaaggtcacaaaagatgtttcacttctatctagatggatggcgattgacctctatattcgggaagtggatagcctcagatttgagctatccatgaaccagtgcagtgataggttgtcaagattggcacatgaaattctagaagccaagcatgagaatcgccgtgagaattggaatcagtctgcgaatagaagtctcacacttccaacacaacttccagctagagctcatttaccttctattgctgaaaatggtgaatctcggcatcccagactagacattccagcacctgattacatgcaatccaatcacaaggatggtggggtttctgtaagttcaactacatcaaaacttgccaatcccaatactcgattaccaggaacaagttcagcaaattccagtgcttcttcagctgcacttggtcaaaagaaattgtatgcagaatcccagacaggaaagtccacttttcaaaagcttttggagccaatgcttcctcaacttcctggaattgctccttatagaattgtcctggggaatgttaaggataagcttgagaaaagtcgtagacggttagaaattcttcttgaggatgttgcatgtgactatgatcctttggattactatgaaacatctgatcagcttttggaacctctgctcctctgttatgaatctctgcaatcgtgtggatctggggtgctagctgatggtcgacttgctgatctgattcgtagagttgctacctttggaatggtgttaatgaagcttgacttgcgtcaggaatctgggagacatgcagaagcacttgatgcaataacacagtacttagatatgggtacttacagtgaatgggatgaagaaaagaagttggacttcttaacaagagaacttaaagggaagaggcctcttgttcctgttagtatagaggttcatcctgatgttaaagaagtcttggatacattccgaattgccgctgaactggggagtgattcacttggagcttatgtgatctctatggcctcaaatgcaagtgatgtccttgcagtagagcttttacagaaggatgcacggcttgctgctattggggagttgggaaaagcatgtcctggtggaacgttgcgggttgtccctctgtttgaaactgtgaaagacctgagaggagctggttcagttatccggaaacttttatcaatagactggtaccatgaacacatcgttaagaaccataatggacatcaagaggttatggttggatattctgattctggtaaagatgctggtcgctttactgctgcttgggaactttacaaagctcaggaggatgttgtagctgcttgcaatgattatggaataaaggttactctattccatggtcgtggaggcagtattggtcgtggtggtggcccaacatatctggctattcagtcccaaccccctggctctgtgatgggaacgcttcggtctactgagcagggagagatggtagaggctaagtttgggttgccacagatagctgttagacaacttgagatatacacaacagctgtactacttgcaacccttcgtccacctatcccaccccgagaagaaaaatggcgtaatgtcatggaagagatctcaaacatcagttgtcagtgtgaccgcaatgtagtgtatgaaaatccagaattcctggcctacttccatgaagccacaccagaggcagaacttggcttccttaacataggtagccgccctacaagaaggaagagctcagtaggaatcggacaccttcgtgcaattccctggttatttgcatggacacaaacaagattcgttcttccagcttggcttggagtcggagcaggtttaaaaggagcttgcgagaaaggttacaccgaagagctaaaagccatgtacaaagaatggcccttctttcaaagtaccatagatcttattgagatggttttggggaaagctgacattcctatagccaagcactatgatgaagtccttgtgacaaaggagaggcaagagcttggccatgaactaagaagtgagctcatgacagctgaaaagtttgtcatggttattagtgggcacgagaaacttcagcagaataataggagcttgaggaggctaattgagaatagacttcccttccttaatcccttgaacatgttgcaggtggagatactcaagaggttaagacgtgatgatgacaaccgtaagatcagagatgctttgcttatcaccataaatgggattgctgcagggatgaagaatacaggttga

SEQ ID NO: 9464 - DNA, 3159 bp, Ricinus communis
atgacggacaccacagatgatattgcagaggaaatctcatttcagagttttgatgatgattgtaagcttcttggcaatttgttaaacgatgttttgcagagagaagttggttctaaattcatggagaagcttgaacgcaatcgcatcctagctcagagtgcttgtaatatgagattggcggggatagaagataccgctgaattgctggagaagcagctggcattggagatatcaaggatgacattagaggaagcattgacacttgctcgtgcctttagtcattaccttaatttgatgggcattgctgagacccatcacagggttcgtaaggcacggagtatgacacatctatcaaaatcttgtgatgacatatttaatcagctgctgcagagtggcatatctgcagaggagctttatgacacagtttgcaagcaggaggttgaaattgtgctcactgcacatcctactcaaattaatcgtcgtaccttgcaatataagcacatcagaattgctcatcttttagattataatgaccggcctgatcttactcatgaagatcgagaaatgctgattgaagatctggtgagagaaattacttcaatatggcagacagatgagcttaggcgccacaagcctacaccagtagatgaagctagggctggcttgaacattgtggagcagtccctgtggaaagctcttccccattatttacgtcgtgtcagtactgccctaaagaagcatacaggaaagccacttcctttgacttgcacgccaataaggtttgggtcttggatggggggtgatagagatggtaatccgaatgtaacagcaaaggtcacaagagatgtttctcttttatctaggtggatggctgttgacctttacattcgagaagttgatagcctgagatttgaactatccatggttcaatgcagtgatagattgttgaaagtggcaaatgacattttaatagaagaaacttcatctgaagatcaccatgagagttggaatcaacctgcaagcagaagtcaaacaaagtttcctagaaaatctcttcctacacaacttccacctagagctgatcttcctgcttgcactgaatgtaatgatggtgaatctcagtatcccaaactagaacttccaggaactgattacatgccctttaatcgccaggaagctctaggttcttcatattcagaatcttcatcccaggatatcaatcatggtttacctaaaacaactggaaatggaagtgttgctaattctagtggatctccgcgggcatctttcagctctgctcaactggttgcacagaggaaactatttgcagaatccaagataggaagatctagcttccagaagcttctagaaccaagtctgcctcaacgtcctggaattgctccttatagaattgttcttggaaatgtaaaagataagcttatgaggacaagaagacgtctggaacttcttctagaggatcttccttgtgaatatgatcaatgggattactatgagacaacagatcaattattggatccactgcttctgtgctacgagtctcttcaatcatgtggagctggggttctagctgatggtcggctagctgacctgataagaagagttgctacatttgggatggtgttaatgaagctagacttgcgccaggaatctggtagacatgctgatactcttgatgcaatcaccaaatatttggaaatgggcacgtatagtgagtgggatgaagaaaagaagctggaatttctgacaagagaactgaaaggaaaacggccactggttcctcctactattgaggttgctcctgatgttaaagaagtcttggatgctttccgtgttgctgctgagctggggagtgattcacttggagcttatgtgatttctatggcatccaatgcaagtgatgtccttgctgtggagcttctgcagaaggatgcccggcttgctgttagtggggagctaggaagaccatgccctggtggaacgttgcgagtagttccgttgtttgaaactgtgaaagacctgagaggtgctggttcggtgatcagaaaactgttatcaattgactggtatagagaacacataattaagaaccataacgggcatcaggaggtgatggttggctattctgattctggtaaagatgctggacgctttactgctgcatgggaactttacaaagcccaagaggatgttgtggcagcctgtaatgattttggtatcaaagtaacactattccatgggcgtggagggagtattggtcgtggtggtggccccacatatcttgccattcaatcccaaccacctggttcagttatgggtactcttcggtcaactgagcaaggagaaatggtgcaggccaagtttgggctgccacatactgccatcagacaactagagatatacacaactgctgtgctgcttgcaacccttcgtcctccacatccacctcgagaagaacaatggcgcaatgtcatggaggagatttcaaaaatcagttgccagaattaccggagcacagtctatgaaaacccagaattcctcgcctacttccatgaggctactccccaggctgagcttggctttcttaacataggaagccgccccacaagaagaaagagctcaactggtattggacatcttcgtgccattccatgggtattcgcatggacccagaccagatttgttcttcctgcttggcttggagttggagcaggtttaaagggtgcttgtgagaagggatttactgaagacttgaaagcaatgtacaaagaatggcctttcttccaatctactattgatcttatagagatggtactagggaaggcagacattcctatagccaagcactatgatgaagttcttgtatctgagagcaggcgagagcttggagctgagcttaggagtgagctcttaacaacagaaaagtatgtgttggtggttagtgggcatgagaaactatctcagaacaaccgcagcctgcggaggctaatagagagcaggctgccttatctcaatcctatgaatatgttgcaggtggaggttctaaagaggttgaggcgggacgacgacaacaataagctcagagatgccctgcttattaccataaatgggattgctgctggaatgaggaacacaggctga

SEQ ID NO: 9465 - DNA, 3426 bp, Vitis vinifera
atgacggacaccacagatgatattgctgaggaaatctcttttcagagctttgatgacgattgtaggttgctgggtagtcttctcaacgaggtgttgcagagggaagtgggaagcaatttcatggaaaaagttgaaaggaatcggatccttgctcagagtgcatgcaatatgagggcgtcagggatcgaggacactgctgagctgcttgagaagcagctcatatcggagatatcccaaatgaatttggaggaagcgttaaccctcgctcgagcattcagccattatcttaatctgatgggtatcgccgaaactcaccatagattacgtaaggcacgaaatgtggcacatatgtcaaaatcttgtgatgacatttttaatcagctgttgcagggtggagtttctcctgaggagctttataatactgtttgcaagcaggaggttgagatcgttcttactgcacatcccacacagatcaacagacgtactttacaatacaaacacatcagaattgcccatcttttagactataatgaccgacctaatcttggtcatgaggaccgggaaatgctgattgaagatctggtgagagagataacttccatatggcagacagatgagcttaggcgccagaaacctactgttgttgatgaagctagggctggattgaacattgtggagcagtctctttggagagctgtacctcattatttacgccgtgttagcaatgctctaaagaagcacactgggaagtcgcttccattgacttgcacaccaataaaatttggatcttggatgggaggtgatagagatggaaatccaaatgtaactgcagaggtcacccgagacgtatctcttttatctaggtggatggctattgatctctacatccgggaagttgatagcctcagatttgaactttccatgaaccgttgcagtgatagcttgtccagattggcacatgaaattttagaaaaagaaacttcatcagttgatcggaatgagagtcggaaccaaccactgaacaggagccaactgaaaccttacagtcagctaggtcctacccttccaagacaacttcctgcaggagctgacctaccctcttgcacagaatgcaaggatggggaatctaagtatcccaaattagaatttcctggaactgattacatgccattgaatcgtcaggatgttaaggctgcttcaagttcagatacttcattccaggattccaataaggactttggcaaaacatatggaaatggaactgtagctaattctagcaattctcagtcagctgcgacaccccgaactgtttctttcagctctggtcaactcctttctcagaggaaactattttcagaatctcagttgggaaggtccagcttccagaagcttctggagccaagcctacctcaacgtcctggaattgctccttataggattgttcttggaaatgtaaaagacaagcttatgaaaacacaaagacggttggagcttcttcttgaggatcttccttgcgaacatgatcctggggattactatgaaacagcagacgaactcttggaaccactactgctgtgccatgaatctatgcaatcatgtggatctggtatcctagctgatggtcggcttgctgatctcatccgaagagttgctacctttagaatggtattaatgaagcttgacttgcgccaggaatctgctaggcatgctgaaacactagatgcaattacaagttacctggatatgggtatatatagtgagtgggatgaagaaagaaaactggattttctgacaagagagctgaaagggaagaggcctctggttcctccaactatagaagttgttgctgatgttaaagaagtgttggataccttccgagttgctgctgagatagggagtgattcatttggagcatatgtgatttctatggcctccaatgcaagcgatgtccttgctgtggagcttctgcaaaaagatgcccgacttgctgtttgtggggagctgggcagaccatgttctggtggaacgctacgggtggttcctctatttgaaactgtgaaggacttgaggggagctggggcagtgatcaggaaattgttatcaatagattggtaccgggagcatattataaagaaccataatgggcaccaggaggtgatggttggatactctgactctggtaaagatgctgggcgcttcactgctgcttgggaactttacaaagcacaagaggatgttgtagctgcatgcaatgagtatgggattaaagttactctcttccatgggcgtggagggagtataggtcgtggtggtggccctacatatcttgccattcaatcccaaccacctggttctgtaatgggtactctccggtcaactgagcaaggagagatggttcaagctaagtttgggttaccacacacggctgtgcggcaactagaaatatacacgactgctgtgctgcttgcaaccatgcggcctccacttccacctagggaggaaaaatggcggaatctaatggaggagatctcgaaaatcagtggccaatgttataggagtacagtttatgaaaacccagaattcctagcctacttccatgaagctacaccacaggctgagcttggtttccttaacataggaagccgacccacaagaagaaagagctcaacaggaattggacatcttcgtgcaattccatgggtatttgcatggactcaaaccagatttgtccttcctgcctggcttggagttgggtcaggtttaaagggtgtttgtgagaaggggcataaagaagacctaatcgcaatgtataaagaatggcctttcttccaatctaccattgaccttatagagatggtcttagggaaagcggatattaccatagccaagcattatgatgaagttcttgtgtcaccaagtaggcaagagcttggtgctgacctaaggagggagctcttgacaacagggaagtttgtcttggtggttactgggcatgataaactctctcagaataatcgaagcttgaggagactgattgagagccggcttccttttctcaatccaatgaacatgttgcaggttgagatactgaggaggttgagacgtgacgatgataacaataaactcagagatgccttgcttatcacaataaatgggattgctgcggggatgaggaacacaggttgagtgaaactgctgcactccaacgaggctcactgtcagctgaaagtctttctttttgtttccaaaacagcaatcatgttaagagtttgtctactgtatccctatcagtcattaggttttgttaaaaaacataaacatatagcacaaccgaagtggaacttgctcatcaggatggaaaagtgtcgcattatctgaagcggacatgaattctctattatcttatacgaggaggttgttgacata

SEQ ID NO: 9466 - DNA, 3102 bp, Arabidopsis thaliana
acaatgacggacacaacagacgatatcgcagaggaaatctcattccaaagcttcgaagatgactgcaaattgctcggtagtctcttccatgatgtgttacaaagggaagttggcaacccattcatggaaaaagtcgaacgcattcggattcttgctcagagtgcgttaaatttgcgtatggctggtattgaggataccgcaaaccttttggagaagcaattgactagtgaaatatccaaaatgccactagaagaagccttaacgttggctcgtacattcactcattctcttaacttaatgggcattgcagacactcatcacagaatgcacaaagtccataacgttacacaacttgcaagatcttgtgatgatatattcagccagctattgcaaagtggaatctctccagacgaactttataaaactgtttgcaaacaggaggtcgaaattgttcttactgctcatcctacccaaataaatcgaagaaccttgcagtacaagcatattagaattgctcatcttctagaatataacactagatcagatctaagcgttgaagatcgcgaaacgctcattgaagatttggttagagagattacttcactgtggcaaactgatgagcttagacgtcagaaacctactccagttgatgaagctagagctggtctaaacatagtggagcaatccctttggaaagcagtaccacaatacctgcgtcgtgtcagcaattccttgaagaagtttacagggaagccacttccactaacatgcactcctatgaaatttggttcttggatgggaggtgatagagatggaaatccaaatgtcacggcaaaggtcacgaaagaagtatctctcttgtctagatggatggctattgatttgtacataagagaggttgatagcttaagatttgaattatctacggatcgatgcagtgataggttttcaagattagctgataaaattcttgaaaaggattatgatagaggaaaatcaaatttccaaaagcaacaaagttcatcatgcttgccaacacaacttccagctagagctcaccttcctgcttgcattgactttggtgaatcacgacataccaaatttgaaattgcgacgacagattatatgccacccaatctccagaagcagaatgaacaagacttttcggaaagcgactgggagaaaattgacaatggttcgcggtccggtcttacttctcgaggttctttctcatctacttctcaacttcttctccagagaaaactatttgaggaatctcaggttgggaagactagtttccaaaagctactagaaccacctccacttaaacgagctggaagtgctccttatcgtattgttcttggagaagtaaaagaaaagcttgtgaagacaagaagacttcttgaacttcttattgagggtcttccttgtgagtatgaccctaaaaactcctatgaaacatcagatcagcttcttgaaccattgctcctctgttacgaatctctgcaatcatcgggtgctagggtactagctgatggacgacttgctgatctgattcgtagagtttctacctttggaatggttttggtgaaactcgacttacgccaggaagctgcaagacattctgaagctttggatgcaattacaacatacttggatatgggtacttatagtgaatgggatgaagagaagaaattagaatttttgacaagagaactaaaagggaaacgacctcttgttcctcaatgtattaaggttggtcctgacgtcaaagaagtattggacacattccgagtcgctgctgaacttggaagtgaatcacttggcgcttacgttatttctatggcttcaaatgcaagtgatgtcctcgctgtggaacttcttcaaaaagatgctcgacttgctttaactagcgaacatggaaaaccatgtcctggtggaacgctacgagtggtacctctttttgaaacggtgaatgatttaagagccgctggtccttcgataaggaaattgctctcaatcgattggtatagggaacacatccaaaagaaccacaacggtcaccaagaggtgatggttggatactctgattctggaaaagatgctggacgttttactgcagcatgggaactctacaaagctcaagaaaatgttgttgctgcttgtaatgaatttggaatcaaaataacattatttcatggacgaggaggaagcattggtcgtggtggtggtccaacctatctcgctattcagtcccaaccaccaggctctgtaatgggctctttgcgttcaactgagcaaggtgagatggttcaagctaagtttgggataccacaaacggctgttaggcaactagaggtatacacaaccgcggttctactcgctaccttaaagcctcctcagccacctcgagaggaaaaatggcgaaacctaatggaagaaatctctggaatcagttgccaacactatagaagcacagtgtatgaaaacccagagtttctatcttattttcatgaggcaacaccgcaagcagaacttggtttcctcaatataggaagccgaccaacacgaagaaagagctctagtggaataggacatctccgagctatcccttgggtctttgcttggactcaaacaaggtttgttcttccagcttggcttggtgtaggggctggtttaaagggagtttctgagaagggtcatgcggatgatcttaaagagatgtacaaagaatggccattttttcagtccacccttgaacttatagagatggtgttagctaaagcagacattccaatgaccaaacactacgacgaacaacttgtgtctgagaaaagaagaggacttggcactgagctaagaaaagaactaatgactactgagaagtacgttcttgtgataagtggtcacgagaaactcttgcaggacaataagagcttgaagaaactcattgatagtagacttccgtatctcaacgcaatgaacatgttacaagttgaaattcttaagaggctaagacgtgatgaagataacaataagctaagagatgctttgcttatcacaatcaatggtattgctgcaggaatgagaaataccggttaa

SEQ ID NO: 9467 - DNA, 3334 bp, Brassica napus
cgttttccaaggtctactcgaaggtcaaagcagtctttcgatgacggatacgacggacgatatcgcggaggagatttcgttccagagcttcgaagatgactgcaagctgctcggcagtctcttcaacgacgtcttgcagagagaagtcggctccgatttcatggagaaaatcgaacggactcgtgttctcgctcagagtgcgttaaatcttcgtctggctggtatcgaagacacggccgagcttttggagacgcagctgacttctgaaatatcaaacatgtcactggaggaagcactgacgctggctcgtgccttcagccattttctcaacttgatgggaattgccgagacacatcacagagttcgtagagtccgtaaccttccacagctttcaagatcatgcaacgatgtattcagtaacctattgcaaagtggtgtttccccagatgagctttatgataccgtttgcaagcagggggttgaaattgttcttactgcacaccccactcaaattaaccggagaaccttgcagtacaaacatatcagaatggctcatcttcttgaatataacgatagaccagaccttggatttgaagatcgagaaacggtcattgaggatatggttagggagataacttcgctgtggcagactgatgaacttagacgtcagaagcctactcctgttgatgaagctagagctggtttgaacattgttgagcaatccctttggaaagctgtaccacattacttgtgtcgtgtcagcagttctttgaagaagttaacggggaagccactcccattaacttgcaccccaataaagtttggctcctggatgggtggcgacagagatggaaatccaaatgtcactgcaaaggtcacaaaagaagtatcgcttatgtctaggtggatggctatcgatctatacataagagagattggtagcttaagatttgaattgtcaatgaatcgatgcagtgatagattgtcaagattggcagatgaaattcttgaaaaagaaattgctgcccaagaaagttggggtacgaatgttggtagaagccaaccaaaatttccaaaccagcagggcttatctctacccactcaacttccacctagagctgaccttcccttatgtgctgaatgtggtgaatcacagtatcccaagcttgaagttcctgtgacagattatattccactcagtcgccaggatgttcaaggcatttcaagtgatggatatggcccaaatttgcaaataaagacaggaaatggacattccgtcaactctaatggttgtcagcaaagtattactccccgaggttcttcctcctcgagttcacagcttctccttcagaagaaactacttgctgattctcagattgggaggaccagctttcagaagctactagaaccaactccacctaaacgagctggaattgctccttatcggattgttcttggggaagtaaaggaaaagcttttgaagacacgaagacttctggaacttcttcttgagggtcttccttgtgaatatgatccttgggactactatgaaacatcagaccaacttctggaaccattacttctctgctatgaatctctgcatgcatctgattccggagttctagctgatggccggcttgctgatttgatccgtagagttgctactttcggcatggttttgatgaaacttgatttacgacaggaagctgcaaagcattctgaagctttggatgcaattacaacatacttggacatgggcacatatagtgaatgggatgaagagaagaagctcgagttcttgacaagagaattgaaagggaaacgtcctcttgtccccccaaatattgaggtcggtcctgaagtgaaagaagtactagacacttttcgagttgctgctgagctaggaagtgaatcacttggagcttacgtgatttccatggcttcaaacgcaagtgatgtcctcgctgtggaacttctacagaaagatgcacgtcttgccgtcactggagagctgggaagaccatgtcctgctggaacactgcgagtggttcctctctttgaaacggtgaaggatttaagaggtgctggctccgtgataaggaaattgctatcaattgactggtacagagaacacatcgagaagaaccacactggacaccaagaggtgatggtcggatattctgattctggaaaagatgctggtcgctttactgcagcatgggaactatacaaagcccaggaggatgttgtggctgcttgcaatgaatttggcatcaaagttaccttgtttcatggacgaggaggaagtattgggagaggtggtggcccaacttatctcgccatacaatcccagcctccaggttcagtgatgggtactctgcgttccacagagcaaggtgagatggtgcaagccaagtttgggataccacagacggctgttaggcagctagagatttacacaaccgcagtactgcttgctactttggaacctcctcagccgcctcgagagaaaaaatggagaaatctaatggaagaaatctcaacaatcagttcccaaaactacaaaggcacagtctacgaaaacccagagtttatctcatatttccatgaggcaacaccacaagccgagctcggttacctcaacataggaagccgaccagctcgaagaaagagctctactggcataggacatctcagagctatcccttgggtctttgcttggacacaaacaaggtttgttctaccagcttggctcggtgtaggagctggtctaaagggtgtctctgagaagggttacgcagacgatattcaggagatgtataaagagtggccgttttttcagtcaactattgaccttatagagatggtgttagctaaagcagacatccccattacaaaactctatgacgaacaacttgtctctgagaacagaagaggacttggtgatatgctgaggaaagaattgatgactactgaaaagtatgtgcttgtgataactggccgcgagaaactcttggagagcaacaagagcttgaagaaactcatagagagtagacttccgtatcttaacgctatgaacatgttgcaagttgaagtacttaagaggctaagacgcgatgaagataacaataagcttagggatgctttgctaatcacaatcaatggtatcgctgcaggaatgagaaacactggttaagaaagtagcacaacacactaaacggagatttacaataatctattatttggtttcttttggtctgttcttttgtttcttgttgaacaacaaggtaatcgtacagaagagagcgtcggggattttaatttatcattgacc

SEQ ID NO: 9468 - DNA, 3798 bp, Picea sitchensis
cccggcggcgtagtttaattcagcgatcggcggtccagagttcgaatctggctagacgccatgacggacaccacggatgacattgctgaagagatctcattccaggccttcgaggacgactgccgtctgcttggcagtctccttaacgatgttcttcaacgtgaagttggccaacaatttacggagaaagtcgagagagaacgaattctcgcgcagagtgcatgcaacatgagaattgcgggcatcgaggatgcagcagaagtgcttgagaagaagcttgcgttagaattgtcaagcatgacgttggaagaggcagcgtctttagccagggctttcagccattatctcaacctgatgggcatagcagagactcatcatcgggtacgccgaataaaaaatactgttcagttgtcaaagtcatgtgatgacatattcagcaagatgatccagagtggaacatctcctgaagatttgtacagtgctgtttgtgaccaggaggttgaaattgttttgactgcacatccaacacaaataaacagacggacattgcaatacaagcacctgcgaattgcacatctgttggaatataatgatcgagcagacctgagccatgaagagagggaaatgttgattgaagatttgaggagagaggttacttccttatggcagacagatgaattgagacgtcataagcccacacctgttgatgaagctcggtctggcttgcatattgtggaacagtccctttggaaagctgtgcctcactatctacgtagagttagtgctgccttaaaaaagcatactggtaggcctcttcctttgacatgcactcctatcagatttggttcctggatgggaggtgatagagatggcaatccaaaagtaactgctaaggttaccagggatgtttgcttcttagcgcgttggatggcagcagatctctatattcgagaaattgatagtcttcgttttgaactttcgatgaacagatgtaatgatgaactggcaaagtttgcatatgaaatcttagaagcagaaaatcaatatgaggagcggcatcaggaaagtgggtttcatcagactagtcatagggtgcatgcaaagcattcagtctcccatagtccagccctaccaacccaacttccagctggtgcagatatgcctgcatgtacagaatgcaatgatggagaatcccagctacccatcttagagttcccagtgacagaccatagtgattcttttgagtctggtcacaatgctgagagttcagtgacactgttgaagagttccccttcaagaacttcagagaagtatgaagatggaaagctggatgtagatgtcagaacaattaatatttctacaaatgcatcttcaactggaacagggactggaattgcttctgccagtagtacagcaggttttggtttttccagccctcgaaagaaaacgtcagaatttaatgtgggtaaatccagctttgataaaattattaatccaagcattccacagcgcccagatattgctccttatagaattgtccttggacatgtaagagagaagcttatcagtacacgtaggcggattgaagagatcttggagggcattccttgggattatgacccttctcagtactatgaaaaatcagcacaacttttagaacctctgatgctttgctatgaatcaatgcaatcatgtgggtcagaaatcctagctgatggacgcctggcagaccttattcggcgggtttcaacatttggaatgatattgatgaaacttgatctgcgtcaggaatctggaaaacattcagaaactttagatgccattacagagtatttagacatgggtacctatagtgaatgggatgaagaaaagaaactggaatttcttgtaactgagctcaaaggcaagcggccccttgttcccccaactattgaggtttcagctgaagtaagggaggttctggatacattccgtgtagctgcagaattaggcagtgaatcacttggagcttatgttatttcaatggcttcaaaggctagtgatattctggctgtggagctgctacagaaggatgcacgtctagccgtaagtggagaactaggacgaccttgccctcataccaccttgcgtgttgtgcccctatttgagactgtcaaagatttgagaggtgccggctcggtaattcggaagttattatcaatagattggtaccgaaaccatattattgaaaatgataatggacatcaggaggttatggttggttactctgattcaggaaaagattcagggcgtttcactgctgcatgggaattatataaagcacaggaagatgttgtagctgcttgtaaagaatttgggattaaagttaccctattccatggccgtggaggaagtattgggcgtggtggtggacctacatatcttgccattcaatctcaaccacctggttctctcatgggaactctccgatcgacagaacagggagaaatggtccaggcaaagtttggcttagcacaaacggcagtgcgacaactagaaatctatacaactgctgttttgcttgcaactttacatccccctgatccgcctcgtagtgcgaattggcgagaggtaatggaaaagatatcagaaatcagtcggcaatattatagaagcaccgtttatgaaaatgaacagtttttagagtacttccgtgaagccactcctgaagcagagcttggtaatctaaatattggtagccgtccaacaaggaggaaaaaatcttctgggattgggcatctccgtgcaattccttggatatttgcatggacacaaactaggtttgttttacctgcatggcttggtgttggagcaggcctcgaagcagcctgtgcgaaaggatacaaagaagaattacaagccatgtacagagaatggccattctttcaatgcacaattgatttaattgaaatggtacttgcaaagtcagatatatccattgctaagcactatgatgaagttttggtctctccttgtagacagaagttaggtggggagttgcgagaagccttttgcatgacagagaaatatgtgttgcttgttagtggccatgaaaaactcacagaaaacaacaaaagtctgaagcgtttgattgaaagcagacttcctttcttaaatcccattaacatgatccaagtggaaatattgcgtcgtctgcgaagagacgtgaataaccccaaactccgtgatgcattacttatcaccatcaatggcatagctgcaggcatgaggaacactggctgagcagcttgtttagggatgcgattgttcctacttttgagattgtttatgattcagagagttccgattcctgactgatgcatgtacacatcccacctgggaatttaccctattcagattgatatttgcataagttacagaaagcaagcagtgtggtgtgacatttctttaagcaagtgcattggattgatacctaataggttgagtttaagactgaaaggaagattggtcaataaaatattagtatgtgctgggcagaaactaaaagaaaagtctgtacttttctttgttgaaaaaaggagtgaaaagacagcggataatgttcattaggtgatgagcttttctgttatggaggttaaagaactggcaattaagaaaatagagttctatttttcctgtgcactgtcctggaaatcagtgcactgttcttgtatatctataagagtaatatgtttagtgaagttttgaacttacatgactatatgttgttcatattgggaagcaaaaaaaaaaaaaaaa

SEQ ID NO: 9469 - DNA, 1400 bp, Glycine max
ttttttttttttttttttttcaactctctctagacgtaaaataaaatcaagagtattcatcaaacatttttccatgtaaaatgaacaacgacaaataaagagggattatattttgacatccaaaaatttcaaacactcaatcaacaactttcttttctctctatctctctcttcctatcacactaaatcatcaatcaaaccaatcacttgtctatcctcttttcctttctctctcaagttctagagaactcaagttgtgcaagaaacacttttcaacaaacacaaatttaatgtcattcattcttatctcttttggtgtctaggtattagttattaccagaagaagaagaagaagaagaataggaattggaagatgatgaagctgaagaagagtgtcttcctggaaccccattagggtaataactataactaatgaaacacttgtgcaaatagacctggcctgaaatggagcttccacattcaacctgagccctctggacagcacttttgacacactccccacaatcagaatcaccaacatctccctcacattgccccatcacatacaaagactggtagctggtggcatagaagccatggccagtgaccaccccattctccatcacagagaaagcagtgtccctcctctcctcaaaccctctcccagcagcgttggttcccccacaggtcttgtacaaaatctgcatccccgagatttgcgtgaaccctacaacctcgtacagcatgtagcaacccaggagctggattctggcggcggtggtcttgccgcagagcttgtcggacaggaccgggagcctgctcacgcagttgtagcagtcggagttggagaggtcatctctgcattggaagagcccagtcatggaggattggccactccctgcagtggccttaaagaacttggctttggtggattgtgagaccaatgagccaaagagtgatgaaagggcttgtgagtataccccatttggatctgtgaatgtttccttggagcaacccttgtagaccaaggtggtgtagtcagaagcagattcagcaaggtttgtgaagagaatcaggaacagaagaaggaatagtgattttctgggaaaccccatttgggtgtgtgtggtggtgacagctgagagggatcaaatcatggcaattttggggggaaaggaaaaacctttaagtgtttgtgtgtgtgtggtgatatcagattcagagagagtctgactaaggaaaagaagaaagaatcgagggttgaggttaaactttggatttttcttctgcttttttgctaaatcaggagggaaaaaggaaagggatttgagggttgctgtgctctgctgtggtggagtgactctacgttctggtttttgtgtccttgggattcactttcc

SEQ ID NO: 9470 - DNA, 1211 bp, Glycine max
tttttttttttttttttttttgtgagaatcaaaacacaaaattattagtaagagcataaagtatatataaataataacaaagtgagtgttttccctggacagcacttcttattgccgcacataactcataccatcatgtttcttcttcaaactccttgcaaatagcaacaatataaccagaaaagccaccgcaactgcacctcctaatattatagcagctgttttccctggattttgccctgaagaagatgaagagtatgaagctgatgatgaaaaaaatgatctagaaggaaccccatttgggtaatagctataactaatgaagcacttgtgcaaaaacacttgtcctgaaatagagctaccgcattcaacctgagctctctgcacagcattcttcacacactccccacaatctgagtcaccaacatctccctcacactgccccatgacatacaaggactggtagctggtagtgtagaagccatggccactaaccaccccattttccatcactgagaaagcagtgtccctcctctcttcaaaccccctcccagcagcatttgttgccccacaggtcttgtacaacatctgcatacctgagatttgggagaaccctgcaacctcatagagaatataacatcctagaagttggactctggcagcagtggttttgccacaaagtttgtcacacagaactgggagcctgctgacacagttgtagcaatcagaattggtgagatcccctctgcattggaagaggccagttatggtgttctggccagagccagaagtggttttgtagaacttggctttggtggattgtgaaaccaatgagccaaagagtgctgaaagtgcctgagagtacaccccattgggatctgtgaaaggctcctttgagcagcccttgtagaccaaagtggagtaatcagaagaagtagattctgcaacatggggcggctcaagaagacttgtgatgaacaaaaccagcaacacaggaaacatgggtttcctagtaaaacccattttaactacgtgtgtgtggggtgttgaggaatcaaatcatggcaatttgaggaaaaccctttcaatgctcaaaggctataagagggatcaagaaactgttgtagattcttcggtctttttctgctgctttttcttcatcaaaggatttagcttttttgaggttgagtcactcgaagttctggtttccc

SEQ ID NO: 9471 - DNA, 759 bp, Glycine max
gaagtggtctaatggcagattcagaaaagtacaacaagaaaccctcttcatcatctttcttcagttctccgaggttgttcaccaatttcactccgaaaggtttccatgaaaccgaaaccatgatgagccctacctccacactcgacagcaagcctttctctggcttcaagaaccctttttggtccgaaactaacagccccagaaccccagtgagtgaacacaagcgttactgggacaaattgggttccaaagggattggtcttggccttgttgatgctcttgttgacgaagagaaacacggtgaagtgagttcgaaatcggagtctcgaatggttgtgtttggatctcagctcaagattcagattcctccactgtctccatctgaatcttccaaattcgtagctgagaagggaaattcttcttctggggttgctgatgctaattctcagcgtgtctttatggggtgtctctctgcgagcgaaatggaactctctgaggactacacgcgcgtgatttcacgcgggcctaacccgagaacaactcacatatttgataattgcatcattgagagtagctgctttgaacttgggtgttctgcttcttctgttaaggaaaatggatgttttcttgatcaaaccagctatcactctcggagctttctcagtgtctgctttcactgcaagaaaaatcttgggcagggtaaagacatctacatgtacaggggtgagagagcattttgcagcaatgaatgccggtaca

SEQ ID NO: 9472 - DNA, 1990 bp, Medicago truncatula
ggaacagaacgagttatctatttagatctcagaaactgaatcagatttttatatcaaagttagggtttcaacaattcagttagaaacatagaaagagtattaacaatggtggaacgaaaggttatccctatcgctatcgcggtgctctttttcttcattgcttcctcttccttcgttcacgcttccgatgaagctgacgatgcgatcttctacgaatcgttcgatggggattttgatagccgttggattgtatctgaaaaggaggaatacaatggtgtctggaagcattctaagagtgaggggcacgacgattttggacttcttgttagtgaaccagcaaggaagtacgccatagttaaagaacttgacgaacctgtcattcttaaggatggatcagttgttcttcggtttgagactcgcctacagaatggccttgaatgtggtggtgcatatatcaaatatcttcaaccccaggagagtggttggaaacccaagggatttgacaacgaatctccatattctgtcatgtttggtccagacaggtgtggggcaacaaataaggttcacttcatcttcaggcataagaatccaaagaccggaaagtatgttgaacaccatctcaagttccccccttctgtcccatctgacaaactatctcatgtgtacactgccattctaaagcctgataatgagttgagaattctagttgacggcgaggagaagaaaaaggctaacttcctatccgaggaggattttgagccttctcttatcccttccaagacaatccctgatcctgatgataacaaacccgaagactgggacgagagagccaagattcctgacccagaagctgtaaagccagaggactgggatgaggatgcacccatggaaattatcgatgaagaagctgagaaacctgaaggatggctggacgacgagcctgaggaaatagatgacccggaggcaacaaaacctgaagattgggatgatgaggaggatggtgaatgggaagctcccaaaattgaaaacccaaagtgtgaaacagcccctggttgtggtgagtggaagaggccaacgaagaggaacccagcttataagggaaaatggagtgcccccttcattgataacccagcttataagggtatatggaagcctcaggagattccaaacccagagtactttgaacttgagaaacctgactttgagcctattgctgctattggtattgaaatttggacaatgcaggacggcattctatttgataatgttcttatagctaaggatgataagattgcagaatcctatcgtgaaactacatggaaacccaagtttaacattgagaaagagaagcagaaggctgaagaggaggcagcagctgagtcagagggtattgctggctaccagaagaaggcatttgacctcttgtacaagatcgcagacattcccttcctgagtggccagaaagataagattattgaaatcattgaaaagggggagaagcaaccaaatctgactattggaattcttgcatctgttgtggttgttttcgtaacaattttctttaggctcatattcggcgggaagaaacctgctaaggtggaggcgaaggtagagaagaagaccaacacagaacgcacagaaacttcccaagctggtggagagaatgaagacaacaaagagaaggaagaaacagccaatgctccacgtaggaggccaaagcgagacaattgaaagcattgaaacttatagtggctgcccattaagtatcatcatgagtggttaattttggggggcttagttggattttaggtgcacttcgttttcatttttccttttacctttttcgaaagattatatacttaaggagtatattttctccttttggatactcttgagtgtttgacctaattgtagttgtacaattattttttgtcctcttttttctagtaatgaattatgtttttcacatagccaaaaaaaaaaaaaaaaa

SEQ ID NO: 9473 - DNA, 1919 bp, Glycine max
gattagggtttgccgattgagagagaaagagaaatgggagaacgaaaaggaatcccaatggctttggggctcttggcgatgatcctcttcttcattgcttcctcttcctctcacctcgttcgcgcttccgatgacgccgacgacgcgatcttctacgagtcgttcgacgaggattttgatggacggtggattgtatccgacaaggaggattacaatggtgtctggaagcatgccaagagtgatgggcatgatgattatggacttcttgttagtgaacaagccaggaaatatgctatagtcaaagaacttgccgagtctgtcagtcttaaggatggaacagttgttcttcagtttgagactcgccttcagaatggcctcgaatgtggtggtgcatatattaaatatcttcgaccccaggagagcggatggaaaccaaaggaatttgacaacgaatctccatattctatcatgtttggtcctgataagtgtggtgctacaaacaaggttcacttcattttcaagcataagaacccaaagagtggggagtatgttgagcatcatctcaagtatcccccttctgtcccatcggacaaactaactcatgtgtacactgcaattctgaagcctgataatgaattgcaaatcttgattgatggggaggagaagaaaaaggcaaatttcttgtcttctgaggactttgagcctcctcttataccttccaagacaatccctgatcctgatgataagaaacctgaggactgggacgaaagagccaaaatcccagacccaagtgctgtgaagccagatgactgggatgaggatgcacccatggaaatcttagatgaagaagcagagaaacctgaaggatggttggatgatgagccagaggaaattgatgacccagaggcaactaaaccagaagactgggatgatgaggaggatggtgaatgggaagccccaaagattgaaaacccaaagtgtgaggccgcccctggttgtggtgaatggaagaggccaacgaagaggaatccagcttataagggaaagtggagtgctccttacatcgataaccccagttacaagggcatatggaagcctcgcgagattccaaaccctgaatactttgaactcgcaaaacctgattttgagcctattgctgctattggcattgagatttggacaatgcaggatggcatcctatttgacaatgttctgatagctaacgatgataaagttgcagaatcctatcgggagactacatggaagcccaagtttaccgttgagaaagacaaactgaaggctgaagaggaggcggcaacgggttcagatggtatttcaggcttccagaagaaggtatttgacctcttgtacaagattgcagatattcccttcttgagcgagcacaaatctaagattttcgatctcattgagaaagctgagaaacagccaaatctcacaattggaattcttgtagctgttgtggttgtcttcgtgtcaattttcttcagactcatatttggtggcaagaaacctgcaaaggtggagaagaaaccagaacgcacagaagcttccaataaccaaggtagtggagagaatgaagaaaacaaagagaaggagaaacagaaagaggaagcatctaatgctgcgcgtcggaggccaaggcgagaaacttgaaatggttgaatctttattttaaagtggcgccctgtttagtatcatcatcaccacagataaattttgggcttagtttcattttaggtgcactctgttttcagtattttcttttttcttccttttaagaaaaggaaaagattatttgcttcaggggtgtagatcttctcctgtttttggagactcgagtgtttgagctagttgaagttgtacaattatttttctattaatggattctgtttttaacc

SEQ ID NO: 9474 - DNA, 1786 bp, Glycine max
aagagcgagatatctatttaaatctctgaaaaacagagtttcatttcaattcagtcttattattagggtttgccgattgagagagaaagagaaatgggagaacgaaaaggaatcccaatggctttggggctcttggcgatgatcctcttcttcattgcttcctcttcctctcacctcgttcgcgcttccggtgacgccgacgacgcgatcttctacgagtcgttcgacgaggattttgatggacggtggattgtatccgacaaggaggattacaatggtgtctggaagcatgccaagagtgatgggcatgatgattatggacttcttgttagtgaacaagccaggaaatatgctatagtcaaagaacttgccgagtctgtcagtcttaaggatggaacagttgttcttcagtttgagactcgccttcagaatggcctcgaatgtggtggtgcatatattaaatatcttcgaccccaggagagcggatggaaaccaaaggaatttgacaacgaatctccatattctatcatgtttggtcctgataagtgtggtgctacaaacaaggttcacttcattttcaagcataagaacccaaagagtggggagtatgttgagcatcatctcaagtatcccccttctgtcccatcggacaaactaactcatgtgtacactgcaattctgaagcctgataatgaattgcaaatcttgattgatggggaggagaagaaaaaggcaaatttcttgtcttctgaggactttgagcctcctcttataccttccaagacaatccctgatcctgatgataagaaacctgaggactgggacgaaagagccaaaatcccagacccaagtgctgtgaagccagatgactgggatgaggatgcacccatggaaatcttagatgaagaagcagagaaccctgaaggatggttggatgatgagccagaggaaattgatgacccagaggcaactaaaccagaagactgggatgatgaggaggatggtgaatgggaagccccaaagattgaaaacccaaagtgtgaggccgcccctggttgtggtgaatggaagaggccaacgaagaggaatccagcttataagggaaagtggagtgctccttacatcgataaccccagttacaagggcatatggaagcctcgcgagattccaaaccctgaatactttgaactcgcaaaacctgattttgagcctattgctgctattggcattgagatttggacaatgcaggatggcatcctatttgacaatgttctgatagctaacgatgataaagttgcagaatcctatcgggagactacatggaagcccaagtttaccgttgagaaagacaaactgaaggctgaagaggaggcggcaacgggttcagatggtatttcaggcttccagaagaaggtatttgacctcttgtacaagattgcagatattcccttcttgagcgagcacaaatctaagattttcgatctcattgagaaagctgagaaacagccaaatctcacaattggaattcttgtagctgttgtggttgtcttcgtgtcaattttcttgagactcatatttggtggcaagaaacctgcaaaggtggagaagaaaccagaacgcacagaagcttccaataaccaaggtagtggagagaatgaagaaaacaaagagaaggagaaacagaaagaggaagcatctaatgctgcgcgtcggaggccaaggcgagaaacttgaaatggttgaatctttattttaaagtggcgccctgtttagtatcatcatcacc

SEQ ID NO: 9475 - DNA, 1907 bp, Brassica napus
ggcacgagctttttccgatctactctccggtgaaccaccgttaagattcccgatgatgagagaccggcagctattctccgccgttttgcttgtcttagctttcgtttctctccagaagctttgctactgcgacgatcaaacggtgttgtatgaatcgttcgatgaggcatttgatggccgttggatcgtttcgaagaatggcgattacgaaggtgtgtggaagcatgagaagagtgagggacatgatgactatggacttctcgtaagcgagaaggctcgtaagtatggtatagtgaaagttctcgacgagccactaaaccttaaggacggaaccattgttcttcagtacgaggttcgtttccaggaggggcttgagtgtggtggtgcttacttgaaatacctccgtcctcaagaagctggatggacacctgagggattcgatagtgaatctccttactctatcatgtttggacccgacaagtgtggagctacgaacaaagttcatttcattttgaagcacaagaaccccaagagcggcgagtacgttgagcaccacctcaagttccctccctctgttccttatgacaagctttcccatgtctacaccgccatcttgaagccagacaacgaggttaggattttggttgatggagaggagaagaagaaggccaacttactctctggagaagactttgagcctgctttgatccctgacaagaccatccctgaccctgaagacaagaaaccagaagactgggatgagagagccaagattcctgaccctaacgccgtgaagcctgaggactgggacgaggatgcacccatggagatagaagacgacgaagctgagaagcccgaaggatggttagatgatgagcctgaggaggtggacgacccagaggcgaccaaacctgaagattgggatgatgaggaagatggtatgtgggaggcaccaaagattgacaaccccaagtgtgaagcagcaccaggatgcggtgaatggaagagaccgatgaagaagaacccagcttacaagggcaaatggagtgcacctatgattgataaccctgcttacaaaggaatctggaagcccagagacatccctaaccctgactacttcgagctagacagacctgattacgaacccattgcagctatcggtatagagatctggacgatgcaagacggtatcttgtttgacaacatattgatagcgaaagacgagaaggtcgctgagagttacagacagacaacgtggaagcctaagttcgatgttgagaaagagaaacaaaaggaggaagagaaggctgctgaatctgcagatggtctcaagagctaccagaaggttgtgttcgatctgttgaacaaggttgcagacatttccttcctaagtgcctacaagtccaagatcacagaattgattgagaaagctgaggaacaaccaaacttaaccattggtgtcctagtctccattgttatagtattcttctcgctcttcatcaagcttatcttcggtggcaaaaaggcgtcgccggcggcgagtgtggagaagaagaaaccagaagtaggagagagctcaaagagtggagatgagtcggagaagaaggaagaaaccgctgctgctccccgcaaaaggcaaccgagacgtgataattagaaggaagtgttttagaattgagaagaacagtgtttgaaaggaaagataagattttcttttatgttgtttttgattttatttgtgttttctgctgtagcatattaagatagaattgtgctgtgtttcggatcaactgttatcggtcatcgctgaaaacttatttttatcgtttactttccactaaatttggagaggaaacatttgatatttgtagattcattcgagttgaatagacatctgttcagtgttc

SEQ ID NO: 9476 - DNA, 2034 bp, Arabidopsis thaliana
attgaatatataatttattcagagaaaccgaaaaatacatatcactctttctccttcacgagggatttttgttccgatctacttctccggcttatcaccgatttagatctaagcctgaggtttccttttgcattttagagattccgagaatgagacaacggcaactattttccgtgtttttgcttctcttagctttcgtttcgttccagaagctttgctactgtgacgatcaaacggttctgtatgaatcgttcgatgagccttttgatggccgctggatcgtttcgaagaatagtgattacgaaggtgtatggaagcatgcaaagagtgaaggacatgaggattatggacttctcgtgagtgagaaggctaggaagtatggaattgtgaaagagcttgacgagcctctaaacctcaaggaaggaactgttgttcttcagtacgaggttcgtttccaggaaggacttgagtgtggtggtgcttacttgaagtacctccgtcctcaggaagctggatggacacctcagggattcgatagtgaatccccttactctatcatgtttgggcctgacaagtgtggaggtacgaacaaagtgcatttcatcttgaagcacaagaatcccaagagtggcgagtacgttgaacaccatctgaagttccctccctctgttccttatgacaagctttcccatgtctacaccgccatcttgaaacccgacaacgaggttagaattttggttgatggagaggagaagaaaaaggccaatttactctctggtgaagactttgagcctgcattgatccctgccaagaccatccctgaccctgaagacaagaaaccagaggattgggacgaaagagccaagattcctgatccaaatgccgtgaagcctgaggactgggatgaggatgcacctatggagattgaagatgaggaagctgagaaacccgaaggatggttagatgatgagcctgaggaggtcgacgaccccgaagcgaccaagcctgaagattgggatgatgaggaagatggtatgtgggaggctcctaaaattgacaaccccaagtgtgaagcagcacctggttgtggtgaatggaagagaccaatgaagaggaatcctgcttacaagggcaaatggagctcacctcttattgataacccggcttacaagggaatctggaaacccagagatatccctaaccctgactactttgagctagacagacccgattacgaacccattgcagccatcggtattgagatctggacaatgcaagatggtatcttgtttgacaacatcttgatagcgaaagacgagaaggtcgctgagacttacagacagaccacttggaagcccaaattcgatgttgagaaagagaaacaaaaggcagaagaggaagctgctggctctgcagatggtctcaagagctaccagaaggttgtattcgacctcttgaacaaggttgcagatttatctttcctaagtgcctacaagtctaagatcacggaactgattgagaaagccgagcaacaaccaaacttaaccattggtgtcctcgtcgccattgtggttgtattcttctcgctcttcctcaagcttatctttggtggcaaaaaggcggcggcacctgtggaaaagaagaaaccagaagtagcggagagttcaaagagtggggatgaggcggagaagaaggaagaaaccgcggcaccacgcaaaaggcaaccgagacgtgataattagaacaagattttaaagtagttttcgaagatgtgaaagaaaagttcagatttatttttctgtttttggttttgggttgaatgttgttttctgctgtagcctataatggtgtaacaccaagtttgagaaatttttgtctttgggcgaagaaaagaaaggaggaatatgtatgtgaagacggtttgttgacagccaaattgtagcttctatttctttttcatccccttcagtagtaacaactggttgcttgaaacattagagttttcttatttgaatcaaaagagtttttataacg

SEQ ID NO: 9477 - DNA, 2002 bp, Vitis vinifera
gtagaagagcaaacgagagaaaaaaagtaggttgagggtttgggagtttgagagatgggagaagggaaacgagtttctctgctacccctatatgttgtgtttgctgtaatagcttgcgcatcacttcagctatgcgcttctgattctatcttctacgagtctttcgacgacgattttgaagggcgttggatcgtttctgagaaagaagactataaaggtgtatggaaacatgcaaagagtgacggacatgaggatcatgggcttcttgtgagtgagaaagctaggaagtatgctatagtgaaagagcttgatgaggcagtgagtctaaaggatggaactgctgttctccagtttgagactaggctccagaatgggcttgagtgtggtggtgcatatctaaaatatcttcgacctcaggatgctacatggaaatccaaagaatttgacaatgaatctccctattctatcatgtttggacctgacaaatgtgggtctacaaacaaggtgcactttatcgtaaagcataagaacccgaagagtggggaatacattgaacaccatctcaagtatccaccctctgttccatctgacaaattatctcatgtctatactgcgattttgaagcctgatcatgaggtgcgaattctgattgatggtgaggaaaagaagaaggcaaatttcctctcatctgaagattttgagcctccatttatccctgctaagaccattcctgacccagatgataagaaaccagaggattgggatgagaggccaaaaattccagaccccaatgcggtaaagcctgatgactgggatgaggatgcacccatggaaattgaagatgaagaagcagtaaaacctgaaggatggttggatgatgaacctgaggagatagatgatcccgaagcctccaaaccagaagattgggatgatgaggaggatggtgaatgggaggcaccaaagatagataacccaaagtgtgagattgcacctggttgtggtgaatggaagaagccattgaagaggaatccagcttacaaggggaaatggcatgcccctcttattgacaaccccaattacaagggtatttggaagcctcagcagattccaaaccctgactattttgaacttgatcatcctgacattgagcctgttgctgccattggcattgagatttggacaatgcaggatggtatattgtttgacaatattttgataactagtgatgagaagactgcagaatcatatcgggagaccacatggaagccaaaatttgaagttgagaaagagaaacagaaagctgaggatgcagctgctggttttgatgttccctcaggcttccagaagaaggtatttgacctcctctacaagattgcggatatttccttcttaaatgcatataaacccaagcttttggatctaattgagaagggagagaaacaaccaaacctcacgattggaatccttgtctccattgtcatcgttttcttgactattatctttaagatcatttttggtgggaagaagccggtgaaaatcaccaggcaaacaaataactcaacagttgctgagacatcaaatgatcaaggaagcagcagagagaaagaagaagagaatgaggaggaagatactaatgctcctcctcgaaagaggtctacgaggcgcgaaaattgatttaaaaggaaaaaattaggacaagaggatattattttctcacttttggtaaattttgggatagtaggctttactggctgaacatcttgtttgtgatttttgttaagcttttattttggaatgttacatgaattagagtgtaaatgaaatgacccatcagcaggctgatgccatgatcattgttcttttccgcctgaaccaggccttttcaattcagatgtttgagtttcacaaaaggaagaccttgtcactatgctggaagttggaagaacttaaattatgaatcttttaatctttgataacagaagggtgtaccttttatccagga

SEQ ID NO: 9478 - DNA, 2971 bp, Vitis vinifera
ggagaagggaaacgagtttctctgctacccctatatgttgtgtttgctgtaatagcttgcgcatcacttcagctatgcgcttctgattctgtaagatttgcaccattttcaacccttctctgtatgattatttttcattttttgtttttatgtattatttttggttttcagatcttctacgagtctttcgacgacgattttgaagggcgttggatcgtttctgagaaagaagactataaaggttagtttatggatatgcattctgtcctctttgatctgctcttccacttccaccaaatttagaatttttttttcctttcgtatatatttgctgaattctgatcggtgttcaaaattttttttctaagatgctaaaattacaaaataaaaaaataaaaatatcggggtctgagtttatcactcagctcattcagttgcggttaacaggtattgaccatgattgttttataagaaaacacatttgcgcacgtttaacgtattaattgtaatgttctaataataacccatttccgtccaaacatgtttcggattaaatacattatatattcatggagtttagttcaatgtagagaaaaagcaacttaaacctttcaaggaattttgtttatttcaatttagagataactcttcctttatttctcaaaactagataataattcttcttgtgtgctgatttttggttttatgtattaattgttcgtgcttgttgattgttcttacatatatattaattaggattatttcctaaaatctgctatctactttttctattgacatatgtcattgaaaactaaatctaacttggatggtaagtatttgcatggctgacttcatatgttcagatcccaaacttcagtatcaggtcgaacagggattgctactgggttctatacatgtgcatgcacacacgtgtgtctatctatgtttgtttttctatatacctttttccagatgattagggattgggtttaatggggacaatgctcgctgtcccagttttttctacttcgacaatagtttggcattatttatgtgtttctattttaacaatattttttggtgttcactgccttttcagaacctttagatatgttccacatctttaatccttcacacactagcattttcttgcctgatttaatttaattcatttcctttttgagcttgcacatttgtgttaatttgcttctggggttttaggtgtatggaaacatgcaaagagtgacggacatgaggatcatgggcttcttgtgagtgagaaagctaggaagtatgctatagtgaaagagcttgatgaggcagtgagtctaaaggatggaactgctgttctccagtttgagactaggctccagaatgggcttgagtgtggtggtgcatatctaaaatatcttcgacctcaggatgctacatggaaatccaaagaatttgacaatgaatctccctattctatcatgtttggacctgacaaatgtgggtctacaaacaaggtgcactttatcgtaaagcataagaacccgaagagtggggaatacattgaacaccatctcaagtatccaccctctgttccatctgacaaattatctcatgtctatactgcgattttgaagcctgatcatgaggtgcgaattctgattgatggtgaggaaaagaagaaggcaaatttcctctcatctgaagattttgagcctccatttatccctgctaagaccattcctgacccagatgataagaaaccagaggattgggatgagaggccaaaaattccagaccccaatgcggtaaagcctgatgactgggatgaggatgcacccatggaaattgaagatgaagaagcagtaaaacctgaaggatggttggatgatgaacctgaggagatagatgatcccgaagcctccaaaccagaagattgggatgatgaggaggatggtgaatgggaggcaccaaagatagataacccaaagtgtgagattgcacctggttgtggtgaatggaagaagccattgaagaggaatccagcttacaaggggaaatggcatgcccctcttattgacaaccccaattacaagggtatttggaagcctcagcagattccaaaccctgactattttgaacttgatcatcctgacattgagcctgttgctgccattggcattgagatttggacaatgcaggatggtatattgtttgacaatattttgataactagtgatgagaagactgcagaatcatatcgggagaccacatggaagccaaaatttgaagttgagaaagagaaacagaaagctgaggatgcagctgctggttttgatgttccctcaggcttccaggtaatggatggcacacattttttttcctgtgcttgttatctgattgtttctatttataatctaagtgtttgattaattcttgcagaagaaggtatttgacctcctctacaagattgcggatatttccttcttaaatgcatataaacccaagcttttggtaagttattaggacatcatctccccttttctgcaaattgtgggtgtttttgggaaaatatcttgaaatctgagctcatttgacaggatctaattgagaagggagagaaacaaccaaacctcacgattggaatccttgtctccattgtcatcgttttcttgactattatctttaagatcatttttggtgggaagaagccggtgagtttgaactttctatcattgtaccatccattgatgatttatttgagctttcaaagcttccatgggagctcatgaagatatcagttcactttgtccttattatatgtgttgcgtcaccacagktgaaaatcaccaggcaaacaaataactcaacagttgctgagacatcaaatgatcaaggaagcagcagagagaaagaagaagagaatgaggaggaagatactaatgctcctcctcgaaagaggtctacgaggcgcgaaaat

SEQ ID NO: 9479 - DNA, 852 bp, Glycine max
ggactcaaacaatgattagtacagcataataaaaacatcgatcagtatcaatatcagcacacaacatatccacatccagagtttgagaattattctgatttttgagaattgaagttcatagaactaatggcttttagagggtttgccttgtgtctagttgcggtcatagtggccactatgtggagtcaaaatgctgcccaatcgggttgcaccaatacactaacaagcttaagcccttgtctgaactacataatgggaagttctccaaccccatcagcttcatgctgctcacagctctcaagcatagtccaatcttcaccacagtgcctttgctccgtgctcaatggtggaggttccacttttggaattaccattaaccaaactcttgctctgtctctccctggcgcttgtgaagtacaaactccccctgttagccagtgccaagcgggcaatggaccaacaactccttcgactgctccagttggttctccttctggctcttcagctgaatcacctcaaggctcaattactccttctgctttagactttccctcaggtgcaggatctaaaactgtgccatcaatagacggtggttcatctgatggaagcgctattaaagtccccttccacttggtgctctatcttcttgcccttgtgtcttgtgccttaaccttcaccaagttctgattattattttgagtcaacagagatttgagtgctgaaattttatgtttaccgtttgctgccgtagaagatatatatttgttattgtataaataaaggaatattgttgaatacatgcatttgatatgaagttacttgttcgtgctgatggactgctattttgttagt

SEQ ID NO: 9480 - DNA, 1089 bp, Glycine max
atgggtgaggaggcaatggagggtgtaatttcttctaaagggatgggttttggagagaatacaagtagtagtggggtttgtccaatgatgatgatgcctttagtgacttctcatcatgttggtcatcatccattaaatcatcctattcttaataatcccaatcctaatgaacacacaaacactctcttccttcccatgccttgtactaataataatcaccacccgaaccgcaataaccacaactccaacgccactgagttagggtatttcatggagatccccaacaacaacaacgatggaagctcctcttccccttcttcagctgtcaaggccaagatcatggcccatcctcactatcaccgtctcttggcagcctacgtcaattgtcaaaaggttggggctccgcctgaagtggtgggaaggttagaagaagcatgtgcatctgctgcagtgataatggcaggtggaacagccagcataggcgaggatccagcgctggatcagttcatggaggcttactgtgagatgctgatcaagtacgagcaagagctctccaaacccttcaaggaagccatgctctttcttcagaggatcgagtgccagttcaaatctctcactatttcttcttctttggacactactgcgtgtaatgaagctattgataggaatgggccatctgaagatgttgatgttcagaccaacataatagatccgcaggcagaggaccaagaactgaaaggtcaactcttacgcaagtaccgtggatacctaggcagtttgaaacaggaattcaccaagaagagaaaaaagggcaagctgcccaaagaagcaaggcaacaattactcgaatggtggagcagacactacaaatggccttacccatctgaatctcagaagctggctcttgcagagtcaacaggcctggatcagaagcaaattaacaactggtttatcaatcaaaggaagaggcactggaagccttcagaggacatgcaatttgtggtggtggatccaagccatccacactactacatggaaaatgttctgggcaatccctttcccatggatctctcccacccaatgctctaa

SEQ ID NO: 9481 - DNA, 1778 bp, Pisum sativum
tatggcagcagggttatcagtggcagtgcagaaaaaggaagggagagttttcattgggaaggtaaaacctttttttggcaccaatgtcttacactaacccttgttcctgtaactcaaccttcattcatattcatctctctatctctatcactaccccgcgtgcactcttctgtttcttctctcttgttcctcagtttatatcataagtaaccttttattatccactagagagactctcagtttcattaaatgctctaaatgggtggaaagaaagattaacactcattttccaaaggaaatctctgcaggcttttgccagtatagtagaatccaaatttttacctcttcactccttcttcatctaactgactctaactatacctagccaccacttttatcactttcactatttcttttttaccataaaacccgggtgaccctttcatatatactactactattgaaagaaagagaaagagagagagagagtgaatggtgtgtgtgtagagattcattcattcattcaatggagggtagttctaatggaagctcttcttatgtcatggctgcttttggagaaaacagtggtggcctatgtcctccaatgatgatgatgcctttagtcacttcttctcatcatcatccaataaattccaacaataataatgcaaacaacacaagctgtctcttccttcctatccctaattccactaataataataatcactacaccaacaacaacaactctaataacaccatgcttcaaaataatcaccacaccacacaaaacactcctggattaggctactatttcatggacaaccacaataacaatggagcctcttcatcttcttcttcttctgctgtcaaagccaagatcatggctcatcctcactatcaccgtctcttggaagcctacatcaattgtcaaaaggttggagcaccgagtgaagtggtgacaaggttagaagaagcttgtgcatctgcagtgagaatgggtggtgatgcagttggatcaggttgcataggggaagatccagctctggatcagttcatggaagcttactgtgagatgcttatcaaatacgaacaagaactctctaaacccttgaaagaagccatgctttttcttcaaaggattgaagtccagttcaaaaatctcactgtttcttcctcttcagacaatattgcttgtaatgaaggtggagataggaatggatcatctgaagaagaccaagttgatctatacaacaacatgatagatcctcaggcagaagacagggaattaaagggtcagcttttgagaaagtacagtggttatttggggagtctgaagcaggaattcatgaagaaaaggaaaaaaggaaaacttcccaaagaagcaaggcaacaattacttgaatggtggagcagacattacaaatggccttacccatctgaatcacagaaactggctttagcagagtcaacaggtcttgatcagaagcaaataaacaactggtttattaatcaaaggaaacgccactggaagccttcagaggatatgcagtttgtggtcatggatccaacccatcctcattattatatggataatgttctcaccaattcatttcccatggatctatctaacaccatgctctagaaattacattggtgcttgtgatctgaaattctctcgtgttaattaactttatgttacgttgtaaggcattgatatgtcacttccaagttaaaaccttatactatattatatatattaatgtgtgtagaaatttatt

SEQ ID NO: 9482 - DNA, 1515 bp, Glycine max
aataagagaattgtgtgtcgtgtttgtttttgtttggtttgttgtaaggttagctagtgagtattctacacaagggtggtggtagggcaaaaaggataagacagtgaatgtgtgtgtgtgtgtgtgtgtgtgtgtgttgttgacaagcaaaagctatggagggtggtagtagtagctctaatggcacttcttatctgttggcttttggagaaaacaacagtggtgggctatgcccaatgacgatgatgcctttggtgacttcccatcacgctggtcatcatccaataaatcctagtaataataataatgtaaacacaaactgtctcttcattcccaactgcagtaacagtactggaactccttctatcatgctccacaataatcacaacaacaacaaaactgatgatgatgataacaacaacaacactgggttagggtactatttcatggagagtgaccaccaccaccatcaccacggcaacaacaacaacaatggaagctcctcctcctcctcctcttctgctgtcaaggccaagatcatggctcatcctcactatcaccgtctcttggcagcttacgtcaattgtcagaaggttggggccccgcctgaagtggtggcaaggttagaagaagcatgtgcttctgcagcgacaatggctggtggtgatgcagcagctggatcaagctgcataggtgaagatccagctttggatcagttcatggaggcttactgtgagatgctcacaaagtatgagcaagaactctccaaacccttaaaggaagccatgctcttccttcaaaggatcgagtgccagttcaaaaatcttacaatttcttcctccgactttgctagcaatgagggtggtgataggaatggatcgtctgaagaggatgttgatctacacaacatgatagatccccaggcagaggacagggatttaaagggtcagcttttgcgcaagtatagcggatacttgggcagtctgaagcaagaattcatgaagaagaggaagaaaggaaagctacctaaagaagcaaggcaacaattacttgaatggtggaacagacattacaaatggccttacccatccgaatcccagaagctggctcttgcagagtcgacaggtctggatcagaagcaaatcaacaactggtttattaatcaaaggaaacggcactggaagccttcagaggacatgcagtttgtggtgatggatccaagccatccacactattacatggataatgttctaggcaatccatttcccatggatctttcccatcccatgctctagaaaattatccctcgtttgtgggctgctgataatagattcataaactcgtgctgtcacttattaaaaccttacaattattaatattaattaatatgcattctaagaaatcctagattgctatactataatatagtacgcaggtgtatcccttgctagctttttagacggtcctttgtgtggatcatctagttgaaggagttatgaataaataaaattccat

SEQ ID NO: 9483 - DNA, 1112 bp, Populus tremula x Populus alba
actcgagatggagggtggtgatggtggttcaagtaccacttcatgtatgatggcttttggagacaacagcaatggactatgccctatgatgatgacgcctctcatgtcttcgtcttctgctcatcatcatcatcgggctaatgagggcgattcgtcagtatcaaataccttattccttcctctacctcctacaaacaatcaaggccataaccgtatccatagtaatgctagtggctcttcttctatgattattgacgatcacaaccacaacaacactgtcactgctactgggtgttatttcatggataacaatgatggtagtagttcttctgtaaaggccaaaattatggctcatcctcactaccatcgtctccttgctgcatatgctaattgtcagaaggttggagcaccacctgaagtggtggctaggctagaagaagcttgcgcatcggctgcttctatggcccccgctaacacaggctgcatcggtgaagatccagcccttgaccaattcatggaggcttactgtgagatgctgaccaagtatgagcaagagctctctaaacccttaaaggaagccatgctttttcttcagagggttgagtgtcaattcaaagctctcactgtttcctctccaatttctggttgtggtgatggcaatgataggaatgtgtcatctgaagaagaggttgatgtgaataacaacttcatagatcctcaagctgaagatcaagaactgaagggtcagctacttcgcaggtacagtggatatttagggagtcttaagcaggagttcatgaaaaagagaaagaaagggaagttaccgaaagaagccaggcaacagctgctggattggtggagcaggcattacaaatggccatatccatcggagtcgcagaagctggcccttgctgaatccactggtctggatcagaagcaaataaacaactggttcattaaccaaaggaaacgacactggaaaccgtcggaagacatgcagtttgtggtgatggatgccggccatcctcattactacatggataatgttttgggcaatcctttcccaatggacatctctcccacactgctttgaagatcatgcatgggatcca

SEQ ID NO: 9484 - DNA, 1122 bp, Populus trichocarpa x Populus deltoides
atggagggtggtggtggtgatggtggttcaagtaccacttcatgtatgatggcttttggagacaacagtaatggactatgccctatgatgatgatgacgcctctcatgtcttcttcgtcttctgctcatcatcagcatcctcatcatcatcatcgggctaatgagggcgattcgtcaatatcaaataccttattccttcctctacctcctacaaacaatcaaggccataaccgtatccatagtaatgctagtggctcttcttctatgattattgacgatcacaaccgcaaccacaacaacaacactgtcactgctactgggtgttatttcatggataacaatgatggtagtagttcttctgttaaggccaaaattatggctcatcctcactaccatcgtctccttgctgcctatgctaattgtcaaaaggttggagcaccacctgaagtggtggctaggctagaagaagcttgcgcatcggctgcttctattgcccccgctaacacaggctgcatcggtgaagatccagcccttgaccaattcatggaggcttactgtgagatgctgaccaagtatgagcaagagctctctaaacccttaaaggaagccatgctttttcttcagagggttgagtgtcaattcaaagctctcactctttcctctccaatttctggttgtggtgatggcaatgataggaatgtgtcatctgaagaagaggtcgatgtgaataacaacttcatagatcctcaagctgaagatcaagagctgaagggtcagctacttcgcaggtacagtggatatttaggcagtctcaagcaggagttcatgaaaaagagaaagaaagggaagttaccgaaagaagccaggcaacagctgctggattggtggagcaggcattacaaatggccatatccatcggagtcgcagaagctggcccttgctgaatccactggtctggatcagaagcaaataaacaactggttcattaaccaaaggaaacgacactggaaaccatcggaagacatgcagtttgtggtgatggatgccggccatcctcattactacatggataatgttttgggcaatcctttcccaatggacatctctcccaccctgctttga

SEQ ID NO: 9485 - DNA, 1134 bp, Medicago truncatula
attcattcaatggagggtagttctaatggaagttgttcttatgtgatgggtgcttttggagaaaacagtggtgggctatgtcctccaatgatgatgatgcctttagtcacttcatctcatcataatgctcatcatccaataaattccaataacaacaatactaatgcaaacaacacaaccggtcttttccttcctatccctaattccactaacaataataacaatcactacaccaactgtaataacaacacctcttctatcatgcttcaaaataaccatcaaaacactcctggtttaggttactatttcatggacaacatcaacaaccatggaagctcttcttcctcttcttcttctgtcaaatccaagatcatggctcatcctcactatcaccgtctcttggaagcctacatcaactgtcaaaaggttggagcaccaagtgaagtggtggcaaggttagaagaagcatgtgcaactgcagtgagaatgggtggagatgcagttggatcaggttgtttaggtgaagatccagctctagatcagttcatggaagcttactgtgagatgcttatcaagtatgagcaagaactttccaaacccttaaaggaagctatgctttttcttcaaaggattgaagtccagttcaaaaatcttacagtttcttcatcttcagataatattgcttgtagtgaaggtggagataggaatggatcatctgaagaagatcatgttgatctatacaacaacatgatagaccctcaagcagaagacagggaattaaagggtcagcttttgagaaaatacagtggatacttaggcagtctgaagcaagagtttatgaagaaaaggaaaaaaggaaagcttccaaaagaagcaaggcaacaattgcttgaatggtggagcagacattacaaatggccttacccatctgaatcacagaagctggctctagcagaatcaacaggtcttgatcagaagcaaataaacaactggtttattaatcaaaggaaacggcactggaagccttcagaggacatgcagtttgtggtgatggatccaagtcatccacactattacatggataatgttcttaccaattcatatcccatggatctatctaacaccatgctctag

SEQ ID NO: 9486 - DNA, 1260 bp, Prunus persica
tggggtataatagcaaagccaagtgaacaaaataactttaggaaagttgtaaattggaagacaagatagcaagagagagagagagagagagagagagagagagagagaatggaaggtggttctaatggcacttgtagtatgatggcttttggagaaaatagtagtagtaatggaggaggactatgtcccatgatgatggtgccagctctaatgacttcccatcactctcatcaccatcatcatcaacatcaccatcctactaatcctactaatgcagacccaaacaccactactccgtttcagcttccccagctacctccatccaaccacaaccgcaatagcagcacctcctctttcattttcaacgaccaccaccccaacaacaacaacaaccaccctgcagcagctgccgcctgttatttcatggacaacaacaacagcaaccatgatggcagtagctcttcctcttcttctgtcaaggccaagatcatggcacaccctcactatcaccgtctcttggcctcctatatcaactgtcaaaaggttggggcaccgcctgaagtggtggcaagactggaaagagcgtgcgcgtcagcagcgtcaataggtcaaatgatgagtagcagcagcggatcagggtgtctcggtgaagatccagctctggatcagttcatggaggcctactgcgagatgctcaccaagtatgagcaagagctttccaaaccctttaaggaagccatgatcttcctgcagaggattgagtcccaattcaaagccctcactctttcttcttcttccgattctgcagtttgtggcgatggactcgataggaacggatcatctgaggaagaagttgatgttaataacaacttcatagatccacaagcagaagatagggagctaaaaggtcagctgttgcgcaagtacagtggatatctaggcagtttgaagcaggagttcatgaaggagaggaagaaagggaagctgcctaaagaagccaggcaacagttgctggattggtggagcagacactacaaatggccttatccatcggagtcgcagaagctggctcttgcagaatcgacagggctggaccagaagcaaataaacaattggttcatcaaccaaaggaagaggcattggaagccttcagaggatatgcagtttgtggtggtggatgctacacaccctggccactattacatggacactgtcttgggcaacccatttcccatggatatctctcgcacattgctctga

SEQ ID NO: 9487 - DNA, 1161 bp, Medicago truncatula
attcattcaatggagggtagttctaatggaagttgttcttatgttatgggtgcttttggagaaaacagtggtgggctatgtcctccaatgatgatgatgcctttagtcacttcatctcatcataatgctcatcatccaataaattccaataacaacaacaacaacaacaacaacaatactaatgcaaacaacacaaccggtcttttccttcctatccctaattccactaacaataataacaatcactacaccaactgtaataacaacacctcttctatcatgcttcaaaataaccatcaaaacactcctggtttaggttactatttcatggacaacatcaacaaccatggaagctcttcttcctcttcttcttcttctgtcaaatccaagatcatggctcatcctcactatcaccgtctcttggaagcctacatcaactgtcaaaaggttggagcaccaagtgaagtggtggcaaggttagaagaagcatgtgcaactgcagtgagaatgggtggagatgcagttggatcaggttgtttaggtgaagatccagctctagatcagttcatggaagcttactgtgagatgcttatcaagtatgagcaagaactttccaaacccttaaaggaagctatgctttttcttcaaaggattgaagtccagttcaaaaatcttacagtttcttcatcttcagataatattgcttgtagtgaaggtggagataggaatggatcatctgaagaagatcatgttgatctatacaacaacatgatagatcctcaagcagaagacagggaattaaagggtcagcttttgagaaaatacagtggatacttaggcagtctgaagcaagagtttatgaagaaaaggaaaaaaggaaagcttccaaaagaagcaaggcagcaattgcttgaatggtggagcagacattacaaatggccttacccatctgaatcacagaagctggctctagcagaatcaacaggtcttgatcagaagcaaataaacaactggtttattaatcaaaggaaacggcactggaagccttcagaggacatgcagtttgtggtgatggatccaagtcatccacactattacatggataatgttctcaccaattcatatcccatggatctatctaacaccatgctctagaaattc

SEQ ID NO: 9488 - DNA, 1380 bp, Vitis vinifera
atggagggtggttctagtagcactgcttgtttgatggcttttggagacaacagtagtaatggactatgtcctatgatgatgatgcctctcatgactacatctaatcctaatgctgcagacgcaaataccctatttcttcctctgcctcccaaccacaatcacgaccttaaccgcaacagcagtagaggctcctctctgatactggagaatcacaaccataaccagcacaccaccaccacctccaccaacaaccaccacggcagtgaccctgggtgttatttcatggaaacccatggcaacaacgatggcagcacttcttctgtcaaggctaagatcatggctcatcctcactaccaccgtctcttggccgcctatgccaattgccaaaaggtcggagcaccacctgaagtagttgcaagattagaggaagcttgtgcatctgaggctgccatggttcgcactggaacaagctgcataggcgaggatccggctctcgatcaattcatggaggcctactgtgagatgctgaccaagtacgagcaagagctctccaaacccttcaaggaagctatgctttttctctcaagggtcgagtgccagttcaaagccctcacagtttcttcttctgattctgctggtggcgagggccttgatagaaatggatcatctgaagaagaagttgatgtaaataacaacttcattgatcctcaagcagaggacagggaactgaaaggccagcttctgcgcaagtacagtggatatctaagcagtctcaagcaggagttcatgaagaagagaaagaaaggaaagctacctaaagaagcccggcagcagttgctggattggtggagcagacactacaaatggccatacccatcggagtcgcagaagttggctcttgcagaatccacaggcctggatcagaagcaaataaacaactggttcattaaccaaaggaagcggcactggaagccctcagaagatatgcagtttgtggttatggatgccacacatccaggccactattacatggacaatgtcttgggcaatccctttcccatggatctctccccaactctcctctgaagatggaagatggccggcttaaactattgaaaatgcaactgcatttctgaatctgtagctttatatattattgaatggtgttatatatattactgtactcttaccacttgtatctatgttttgcctatttaatactaaatcagactgctaaatgcagctcgtcctcccttaaaaatgtttttcaagtgatgggtttgtgttgtggttcttgtacttggggtgaatccactttggaatggctgagatttcatagccaagaagtttgaaatgtacatggttcctggttttaacctc

SEQ ID NO: 9489 - DNA, 1592 bp, Vitis vinifera
cagtcacagcttcatcacagtctccacaaaaaaagagaagaaccattaaatttcagagcttttttcgtgctaaattcagctaaaccccccaaaacccgcttcagggaattcggattcggagctctttttggggtctcaacatgtccatggatgcgagctctggttctggggatggtggcaacatcaaaggagtgcccacacatggtggccgctacgtacgctacaatgtgtacggaaactttttcgaggtctctgcaaagtatgttcctccgattcgtccggttggtagaggtgcatatggcattgtctgtgctgcagtaaattcagaaacacatgaggaggttgccattaagaagattggtaatgcatttgacaacagaatagatgccaaaaggaccttaagagaaattaagctccttcgtcacatggatcatgaaaatgttattgccatcaaggacattatacgaccaccaaagaaggaaactttcaatgatgtctacattgtttatgaattgatggacactgatcttcatcagatcatttgttctaaccaatccctcaccgatgatcattgtcagtactttctgtatcagctgttgcgaggattaaaatatgtacactctgcaaatgtcttgcaccgtgatctaaagcccagcaatttgcttctgaatgcaaattgcgatcttaagattggagactttggactggcaaggacgacatctgaaacggatttcatgactgagtatgtggtcactcgttggtatcgggcaccagagttgctccttaattgttcagaatatactgctgcgattgatatatggtctgttggttgcatactaggtgaaatcatgaccagagaaccattattccctggcaaagattatgttcatcagctgaggcttatcacagagcttctcggttcacctgatgatgcaagtcttggctttctccgaagtaataatgcccgacgatatgttaggcagcttccacaatatccaaagcaacaaatctctgctagattccccaatatgtcacctagtgctgttgacttgctagagaaaatgcttgtctttgatcccaccaagcgtataacagtcgacgaggcactatgtcacccatatttgtcatctctacatgatatcaatgatgagcctgtttgtcccagtccttttagttttgatttcgagcaatcatcaatcactgaagagaacatcaaggagctcatctggagggaatcagtgaagtttaatcctgacccaactcactaggagaaatgtggtcataatgctttgtcgtatgctatagaaacatattgggagataactttccccacttgaatacaatgtatgtccataacgataaccatccagagtaggtagaaacagcattagagtttgcttattctttgaaacttgttaactcatgtatatggagaaaaatgttggaagggattagctgtcccctatgtatcagcaaaaccctaaaccaatattggttttggttcttatatgagctggtaaacctccatattggttttggatcaaagattgtgaatgttgtaatgttggtcaatctaagtttcttatttttcg

SEQ ID NO: 9490 - DNA, 1734 bp, Petroselinum crispum
cacgagaaaaaaagttatgcattcacacgtgaaattgtcacccttcacggatgatcatgtcttttttagttcaaaaagagtggccctttttcacaattcacagtttctttctttacttttcttgattttcctattttttcagtgtaaaaaatgtcacacccgtcttcattttccaccataatccactaaagaaatgtcaacaacttgattggaaaatacccttcctcttcttccctaaatttagtagcttcttgttcttgttttgttctaaattgtcttctttgttgagtttctgagtaattttcttgttttggggtttaatttttttggtaagtagaggaatctatggagtcaagttctgcagctacagctgatcatacacatatcaaaggtgtgcctactcatggtggacgctatgttcagtacaatgtgtatggtaatctctttgaagtttctcgaaaatatgttcctccaatccgccctgtcggccgtggcgcttatggtatagtttgtgctgctatgaactctgatacgcgtgaggaagttgccatcaagaaaattggtaatgcatttgacaatcgaatagatgccaaaaggacacttcgggaaattaaacttcttcgtcacatgaatcatgaaaatgtaattgcaattaaagacatcataaggcctccacagattgaaagtttcaatgatgtttacattgtttacgaactgatggacacagatcttcatcaaataattcgctctaaccagcaactcactgatgatcattgtcggtattttctttaccaactattgcgaggactgaaatatgttcattctgcaaatgtcctgcatcgtgatttaaagccgagcaatttgctcctcaatgcaaattgtgacctaaaaattggagatttcggccttgcaaggacaacttctgaaactgattttatgactgaatatgttgttactcgctggtaccgagcaccagaattgctccttaattgctcagagtatactgcagcaattgatatctggtcagttggttgcatacttggtgaagttatgaccagacagcccctgttccctgggaaagattatgttcatcagctgagactaattactgagctcataggttcacctgatgatgccagtcttggatttctcagaagtgataatgctcgaagatacgtgaggcagcttccccagtatccaaagcaacaattctctgctagatttcttaacaaatctcctggagctctagatttgctggaaaaaatgctaatctttgatcccaacaggcgcattacagttgacgaggcactttgccacccatacttggcagctcttcatgacataaacgaggaacctgtttgtcctcgcccttttagttttgactttgagcagccaacgtgcactgaagaaaatatcaaggaacttatctggaaggaatctgtgaagttcaatcctgacccgattctctgagtatcatgttatagtgattgttatcaaatgaatattatagatgttgcaacatgaattaatattgtatcaaaactaattaagaatgatcctcaagtagaattgatcaaataaatagaatggatatactgagggtcaaccaggttgttcccactattgaaattaagattcatttgtcattcttaacttgaaatattccaatgctgcagctctgagttgcagattatttttaagtcttttactttggtgcaaaaaaaaaaaaaaaaa

SEQ ID NO: 9491 - DNA, 1757 bp, Vitis vinifera
ttcatataaaatcttttcctctacagtcctttctctctctagaaaaaggccaagaaatgtcaaaaaggccgagcagctgtggttccaaggtctccacggacttggcttttacgccaaattgggagtggctctgctattaggggctaatccttcttgagtcgttctcgtttcgggttttgtgagtggaattaggggtcgattttctcggacatgtctatggagtcgagcgctggttcagttgaagggaatatcagaggagtgtcgactcatggtggacggtatgttcagtacaatgtgtatgggaacctcttcgaagtttctaggaagtacgtgccgccaattcggcctgtgggtcgtggtgcttatggtatcgtgtgcgctgcgatgaactcagagacacgggaggaagttgccattaagaagattggtaatgcatttgataataggatagatgccaaacggacattacgggaaattaagcttcttcgccacatggatcatgaaaatgttattgtcttgaaagacatcatacggccacctaagagggagaacttcaatgatgtctacattgtttatgaattaatggacactgatctgcatcagataatacgttccaaccaaccactgaatgatgaccactgccggtacttcctgtatcaggtgttacgaggacttaaatatgtacactcagcaaatgtcttgcatcgtgatttgaagccgagtaatttgcttctgaatgcaaattgtgatcttaagattggggattttggacttgcgaggacgacatctgaaacagacttcatgactgagtatgttgttacccgatggtatcgtgcaccagaattgctccttaattgttcagaatacactgcggcaattgatatttggtcagtgggttgtatccttggagaaatcatgacaaggcaacctctgtttcctggcagagattatgtccatcagctgagacttatcacagagcttataggttcacctgatgactctagccttgggtttcttcgaagtgataatgcccgaagatatgttaggcagctaccacaatacccgagacaacaatttcaggctagatttcctaatatgtctcctggagctattgatttgctagaaaaaatgcttgtatttgatccaaacaggcgcattacagttgaaggggcactgtctcatccatacttggcacctcttcatgatatcaatgaggagcccgtttgtccaaggccttttgtttttgatttcgagcaaccatcatttactgaagagaatatcaaagaactcatctggagggaatccgtaaaattcaatccagacccaccagttcattgagaagtatgtgatcatgttgttgtaaacactagaaaagtgctcgtaatattcaaaggctgatgaagaagctgaggcagaaccatttgcagggtttctcagcataatattcatagactccattttcttcttggtgcaggatcttcttcctttgtgtcatagttggcctaggagcagagtttagtgctagaaactaattgcagcgaagagattctgcaatgcaaagttgtatcattgctccccgtatgtttccaggttttgaagtatttagtatgacatgaataatttccaaacaatttgtttctgtttcctagactgatcccatcatcttttctcatcattgttcgtgatggaacttgtaatgatatgtaatattggttctgtgaacttaagccttgacaatctttttctttggttgatcc

SEQ ID NO: 9492 - DNA, 1450 bp, Glycine max
ggatgacggattttcacgagcaacaataagcatagagagaaatttggcattgcagtgcatcatcgcattgattgagttggaagatgggtagcaaaggcaaacgcaaagagcaagaatcaataataacgagggttatggctcacggaggtagatacgtgcaatacaacgtgtacggaaacttgttcgaggtctcctccaagtatgtccctcccattcgccctgtcggtagaggcgcatacggcatcgtttgtgctgctgttaattgcgatacgcacgaggaagttgccataaagaagattggtaacgcctttgacaacatcattgacgctaaacgaactttgagggaaatcaagctccttcgccacatggaccatgaaaatataattgccattagggatatcatacgacctcccagaaaggatgccttcaatgatgtttacattgtttatgaattgatggacactgatcttcatcagattattcgttctgaccaacctcttaacgatgaccactgtcagtactttttatatcagctgttacgggggctgaaatatgtgcattctgctaatatcttgcaccgtgatcttaagcccagtaatttgcttctcaattcaaactgtgaccttaaaattgcggactttggtctggcaaggacaacatctgaaacggatttcatgacggagtatgttgtcacacgatggtaccgagccccagaattgcttcttaattgttcagagtacacctccgcgattgatgtttggtctgttggttgcatatttggtgaaattatgaccagagaacccttgtttcctggaaaagattatgttcatcaactgaggcttataacagagttattaggttcacctgatgatgccagccttggatttctccgaagtggaaatgccaaaagatatgttcgacagcttccacaatataggaagcaaaatttctccgctagattcccaaatatgtctcctgaggcattggatctactagaaaagatgcttatctttgatcccaacaagcgcattacagttgatgaagcactatgtcatccatatctttcatcacttcatgacatcaatgatgaaccggttggtcctgggcaattcaattttgattttgagcagccaacatgcactgaagagcacatcaaggagctcatctggagggaatcggtgaagtacaatccagatccacccagtcagtaattctttcttgaatgatgattcccttattactcttgggtgtagacatccagagagagataagtgattgatatgattagtaatgtattgggacaaaaagagagatattgagaaatgagaggtgtgtaagggtggtgagagaatccttattcttctttcttattagtataaatgtatcaagataaacttctttcaccttaaatacagtgcctgttcattatccaaaaaaaaaaaaaaaaaaa

SEQ ID NO: 9493 - DNA, 911 bp, Hevea brasiliensis
cttctactcgtcgatttttccatggctgctccacctgcgagggctcgagccgattacgattacctcataaagcttctcttgatcggcgacagtggggtgggcaagagttgccttcttttacgcttctcagatggttccttcactactagttttatcaccaccattggtattgatttcaagataagaaccattgagcttgatggaaaaagaattaagcttcaaatttgggatacagctggtcaggaacggttccgaacaattacaactgcttactatcgtggagcaatgggtattttgctagtgtatgatgttactgatgaatcatctttcaacaacattaggaattggattcgcaacattgaacagcatgcttcggataatgttaacaagatattggtggggaacaaggctgacatggatgagagtaaaagggctgtcccaacatccaagggccaagcacttgctgatgagtacgggatcaagttctttgaaactagtgcaaagacaaatctaaatgttgaggaagttttcttttccatagcaagggatataaagcaaagacttgctgatacggactcaaaggctgagcctacaacaattaagatcaatcaaccagaccaggctggtggggctggtcaagctggccaaaaatcagcttgctgcggatcttagaacaaattattttttagtagggcattaattgcaggtaacacttttgtctgaataaggagggaatgtatttaacaaaaaaaaagagagaaaaactaattctgatgaaaggatgatgtgtgctagcaaattatctgtgtcattctttttgaacctggttttagtgtgtgaaaggtaggttgttgttgaagattagatttttatggctttacaaaaaaaaaaaaaaaaaaaaaaaaaaaaaa

SEQ ID NO: 9494 - DNA, 971 bp, Hevea brasiliensis
cgtgctagaactagaagacactttcctccttcattattaatttcctcttattagatctcactctttccttcccgatctgtaattcatcaatggctgctccacctgcaagagctcgtgccgattacgattaccttataaagcttctcttgatcggcgatagcggtgtgggtaagagttgccttcttttgcgtttctcagatggttcctttacgactagtttcattacaaccattggcattgattttaagataagaacaattgagcttgatggaaaacggattaaattgcaaatttgggatactgctggtcaagagcgttttcgaacaattacaactgcttactaccgtggagctatgggtattttgcttgtgtatgatgtcactgatgaatcatcttttaataacattaggaattggatccgtaatattgaacagcatgcttctgacaatgtgaacaagatactggtgggtaacaaggcagacatggatgaaagcaaaagggctgttccaacctcaaagggccaggctcttgcagataaatatggcatcaagttttttgagacgagtgcaaagacaaatttaaatgtggaagaggttttcttttcgatagctagggatatcaagcaaaggcttgcagataccgattcaaaggctgagccacagacgatcaaaattaaccagccggaccaggcaggaggggccaaccaagctgcccaaaaatcagcttgctgtggttcttaaagaagccatcttgaagactgggatcacatggctacattctcaagcatgttgatggaaactaattttgttacaactatgtgattggtgcatgtattgttctccttatcattatttttacagcttctgcacatctgggtgtgaatgctagatcctattttgagaaattaaattatatttagattatttcccctcaaaaaaaaaaaaaaaaaaaaaaaaaaaaaaaaaaaaaaa

SEQ ID NO: 9495 - DNA, 1071 bp, Vitis vinifera
gcgcacgctaaaaaagggggtgtgggagcaatcatagtgcgcatcttagcctccatagtcggagcctgcacgtcggacctgaaccgatcaatccaagtcgtctccattcgggtttgttaatatatattgatcgatggctgctccaccagcaagggctagagccgattatgattatctaataaagcttcttctgatcggagacagcggtgtaggtaagagttgccttcttttgcgtttttcagatgggtccttcaccactagttttatcaccactattggtattgattttaagataagaaccattgaacttgatggcaaacggatcaagctccaaatctgggatactgctggtcaggagcggttccgtacaatcacaacagcctactatcgtggagccatgggtattttgctggtgtatgatgtaaccgatgaatcatctttcaacaatattaggaactggattcgaaacattgagcaacatgcttctgacaatgttaacaagatactggtagggaacaaggctgacatggatgaaagcaaaagggcggtgcctacctccaagggccaagcacttgctgatgagtatggcatcaaattctttgaaactagtgcaaagacgaatctaaatgtggaagaagttttcttttcaattgcaagggatataaagcagaggcttgcggacactgactccagggcagagcccacagcaattcggattaatcaaccagaccaggcatccggggttggtcaaactgcccaaaaatcggcttgctgtggttcttaaagaggtaagatactgctgaattggtgcctgaagcagcatgttatcttggaaatcaaaaagaagaaaactaattctgatgacgatataatggttgcttgtaattttttgcttattgtgattcttttcaaacttgctttagcgtgtgaaaggtagtttcttattatttgagaaatttattttgctgcaagcccagttcctatgtttttcctttctttcttgctctttttttccctctttcatttagcactaatatggttaatctctccttgtagagggtacatggcaaa

SEQ ID NO: 9496 - DNA, 2184 bp, Vitis vinifera
ataagaaccattgaacttgatggcaaacggatcaagctccaaatctgggatactgctggtcaggagcggttccgtacaatcacaacaggtaggttctcttatcttgatggaatctggtttaattttgataactgcttgatgcagtagtgaaagccatcttcccagcttgtggttggttgtatgtcgctatgtagaagaataaattgatggattgtttctgaatgttgtattgtccaccttaggagatcctccaggctgaaaaccaactttttaaacaactctaatatcttatgcatttcactccaaatgtcgagaaaaattgttggacgttcttgaactgggaagtgtaccaagcagaatgaagtgatgaaggaggaaaattgacttgtttttggtttttgggaggggtgggacaagtaaagtaactggagaggaaggttaagagttgagtgtggcagtaatgggcatctccaataccttttagcaatggagaggaacaattcccacactgggaacagcttggaaacataataccctagcataaaagttggcttggaagcaaaggcactaggagatgatgcagaggtgtgacatctgggcatcacatggtatcacaaattgttgttagattgttttaatgttagtcttttgaaactttccagagactctccaacaatggcaggaggtttcatttaataattgtagcatcagtccttgtggcaccacattcatgctccatagtgcacaggaaatatgcaacctacaatcttatcatgaagtgtgctagatcaagttgttggaataatcctgttggatgatatattgaacatgaagtcttttgggttgggctctatcagagtgtcaaatgctaagtgatttttacatgattactgtggcaagcatgttggaatgtgtgatggtaggcaagtgagtcagtgcttccttgtagtggttctcctccaaccaattgcattctatgttgtgttctgcttctatgatgtttgattacttatattttctctagtttgaatctagatcacatatttgcccacatgtaacttctttcctcccttccctttaattttggcagcctactatcgtggagccatgggtattttgctggtgtatgatgtaaccgatgaatcatctttcaacagtacgtttccttctcacttccatcagttgaaattcgggaagctgtacatatttctaaaggactatgtgtccacctatttgatcctctgaaattctactgtttacagtctttcccactatttatgcatattgtttaaggtgctttttctgaagtggatggttgagaaaccacattggttttcaaaactattggatattttgatttctgtattgatttttataaaacttgcttcttacaattttcagatattaggaactggattcgaaacattgagcaacatgcttctgacaatgttaacaagatactggtagggaacaaggctgacatggatgaaagcaaaagggtatgttctggtgtcagttttcccatcatgaagtaacattttagtttatttgtcacatttgatatacattattaagtttgcyggtcaatcctacatactggctttggagggtaaagtttatttttgcttggcattgggaagaaaaygttaatgcttctttgttgaaccaacaacttctccatttcccsctccctcttttgcacgcatatagatcagtgtttttcaccatttttgatcgtatccttttgataaaccctcttcaggcggtgcctacctccaagggccaagcacttgctgatgagtatggcatcaaattctttgaaactgtragtagagcttgtagaaacatttctatttcatgattgttgatacaatgtgtatgctgaaagatcttgtgtacggcagagtgcaaagacgaatctaaatgtggaagaagttttcttttcaattgcaagggatataaagcagaggcttgcggacactgactccagggcagaggtatttggttctgaatgaaagtgaagataaaakagataaaactaagtaattggacctcttaattttcaagtatggagaacttacttctttggttctacttgtgcagcccacagcaattcggattaatcaaccagaccaggcakccggggttggtcaaactgcccaaaaatcggcttgctgtggttct

SEQ ID NO: 9497 - DNA, 998 bp, Nicotiana tabacum
cgatccggttggagatattccccttcatcattttttcctgagaaaattcaaatggccactccacccgctagagctcgagccgattacgattacctaatcaagctcctcttgatcggcgacagcggtgtgggtaagagttgccttcttttacgtttctcagatggctccttcacgaccagttttattacaactattggcattgacttcaagataaggaccatagagcttgatagcaaacgaatcaaactacaaatctgggatactgctggtcaggagcggttccgaacaattacaactgcttactaccgtggagccatgggtatattgctggtgtatgacgtaactgatgagtcatcttttaacaacatcaggaactggataagaaacattgagcagcatgcttccgacaatgtcaacaaaattctggtcggcaacaaggctgacatggacgaaagcaaaagggctgttcctacatcaaaaggtcaagcactagctgacgaatatggcattaaattctttgagacaagtgccaagacaaatatgaatgtggaggaggttttcttttccatagctcgggatataaagcaaagacttgctgaatctgactcaaaggctgagcctcagactatcaggataaatcaaccagaccaggcagcaggagctgctcaaagcgcccaaaaatcagcttgctgtggctcttgaaaaattgacggcaagaaagacaggatgatggggaatacatccttaaagttaccattttagtgggaagggtggaactaatctttgttataacattctcaccatcgattgtatttttctctttacagttattttcttcaatatctattcgtattgggtggcagctcttagtattgcaaaaatcagtatatgctcactactttttggcttatataaatgaagggacactctgccttctcaaaaaaaaaaaaaaaaaaaaaaaaaaaaaaaaaaaaaaaaaaaaaaaaaaaaaaaaaaaa

SEQ ID NO: 9498 - DNA, 736 bp, Hevea brasiliensis
cacgaggatttggaagagaaacgatggccgcaccaccagcaagggctcgtgctgattatgattacttgattaagcttctcttgattggggatagcggtgtcgggaagagttgtctgctgctgcgcttctctgacggttccttcacaaccagtttcattaccacaattggtattgactttaaaattagaacaatcgagcttgatggtaaacgtattaaattgcaaatctgggatacagcaggtcaggagcgttttcgaactatcacaacagcgtattaccgtggagccatggggattttgctggtgtatgacgtcactgatgaatcatcttttaacaatatcaggaactggattcgcaatattgagcaacatgcttctgacaatgtcaacaaaatactggtgggaaacaaggcagacatggatgaaagtaaaagggctgtgcctacatccaagggtcaagcacttgctgatgagtatggtatcaaattcttcgaaactagtgcaaaaacaaacttgaatgtggaggaggttttcttttccattgcaagggatatcaagaaaaggcttgcagaaactgattccaaggctgagcctcaaacaatcaagattaaccaaccagaccaagcagccagtggtggccaagcagctcaaaagtctgcttgttgtggttcataaagtggaatctaagcaacagactgagggggaaggttatgccagtgacatccattggagtcaaa

SEQ ID NO: 9499 - DNA, 949 bp, Nicotiana tabacum
ctccgatccggttggagatattccccttcatcattttttcctgagaaaattcaaatggccgctccacccgctagagctcgagccgattacgattacctaatcaagctcctcttgatcggcgacagcggtgtgggtaagagttgccttcttttacgtttctcagatggctccttcacgaccagttttattacaactattggcattgacttcaagataaggaccatagagcttgatggcaaacgaatcaaactacaaatctgggatactgctggtcaggagcggttccgaacaattacaactgcttactaccgtggagccatgggtatattgctggtgtatgacgtaactgatgagtcatcttttaacaacatcaggaactggataagaaacattgagcagcatgcttccgacaacgtcaacaaaattctggtcggcaacaaggctgacatggatgaaagcaaaagggctgttcctacatcaaaaggtcaagcactagctgacgaatatggcattaaattctttgagacaagtgccaagacaaatatgaatgtggaggaggttttcttttccatagctcgggatataaagcaaagacttgctgaatctgactcaaaggctgagcctcagactatcaggattaatcaaccagaccaggcagcaggagcttctcaaagcgtccaaaaatcagcttgttgtggctcttgaaaaattgacggcaagaaagacaggatgatggggaatacatccttaaaagttaccattttagtgggaagggtggaactaatctttgttataacattctcacagtctgattgaatttttctctttacagttattttcttccaatatctatttgtattgggtggcagctcttagtattgcaaaaatcagtatatgctcactactttttgggttatataaatgaagggacactctgccttctaaaaaa

SEQ ID NO: 9500 - DNA, 1260 bp, Vitis vinifera
gacatctgaggcctcccatgtcgtcgctaacctgcgcagcttaagctctttctcttttctttgtctctctcgatctcaaatactaaagatatagaaacggagatcgcttgctcacttgcgcagattcagatcagtttctagggcttatctccatggctgctccacctgcaagggctcgtgctgattatgattacctcatcaagcttcttcttatcggcgatagcggtgtggggaagagttgccttctcttgcgcttctctgatgggtcctttactaccagttttattaccaccattggtattgatttcaagataagaaccatcgagcttgatggcaaacggatcaaattacaaatctgggatacagctggtcaggagaggtttcgaaccatcacaacagcttactatcgaggagccatgggtattttgctggtgtatgatgttactgatgagtcatctttcaacaatattaggaactggattcgcaacattgaacagcatgcttctgataatgtcaacaaggtattggtggggaacaaagctgacatggacgaaagcaaaagggccgtgccaacctccaagggtcaagctcttgctgatgagtatggtatcaagttctttgaaactagtgcaaaaacaaatttgaatgtggaggaggttttcttttcaatagctaaggatataaaacaaaggcttgcagaaactgattccaaggctgagcctcagacaataaagattaaccaaccagaccaggcagccaatggtggtcaagctcctcaaaaatcagcttgctgtggttcataaaggaaatgaaaatatgcgagaccaggggaaggttcttcaagtgacactcctgcaggtgaaaaaactagttgtcataacaatatggtgggcacttgtttccgttcctatcatttttttcaactactggctttggcatgttaaagttatttttataattattttgtggaatttattctaagagtactctcttttgtcacctcctccttttctctcccactctttttcttttaccttttttgggggattggtatcacagtgaaccctgatatatctgttgctcttcttgatgtagaaaagataaactgaagtggccttctttgtgtttcagaaaaatgggttgagtgtctcaatctgtaactcagactataaactgctcctgtatgtgcatccagaaaatgtttgattaactgggaagctcttaatccatagtaaagtttgtctttgatgattctcagca

SEQ ID NO: 9501 - DNA, 1132 bp, Glycine max
ggggtggagagaggggcactgactcacacccacaatagtcgggggcagcttcaaagtacctccacattgtctcctactcttactgttctcttctcttctcatcatttttattttttccaatcaaaccaaacaaaacataagcaccgctcttttctctccgaaatccccatctcccttcacttctgagctctggacgagatcccagatctcaccatctttcacgcactcttccatcagattcaccctttcgtttaacgcaaactcataacttgaaggttaatggctgctccaccggcaagggctcgtgccgattacgattatctcataaagcttctcttgatcggtgacagcggtgttgggaaaagttgcctccttctgcgtttctccgatggttctttcaccactagtttcatcacaactataggcattgattttaagataagaaccattgagcttgatggcaaacggatcaagctccaaatttgggatactgcagggcaggagcggtttcggacaattacaactgcttactaccgtggtgctatgggcatattgctagtctatgatgttacagatgaagcatcatttaacaatatcaggaattggattcgcaatattgagcaacatgcttcagacaatgttaacaaaatactggtggggaacaaagctgatatggatgaaagcaaaagggccgtgcctacgtccaagggccaagcactggctgatgagtatgggatcaaattctttgaaactagtgcaaagacaaatctaaacgtggaggaagttttcttctcaatagcaagagatataaaacaaaggctggctgacactgacaccaaggcagagccatcaacaatcaaaatcaaccaagaccagtcaggaggggctggacaggctgcacaaaaatcggcttgttgtggttgaggacaaatgttacaaattggaggcaacattcttgtacaagaacaagaagaaagaagaaattacgtgtataatgatcatgatgctgactttgtgcttaaccttgtcattctttataaatttgtgtgataagtagtgtctctgacttttttaacaagttacattaaatccaaaactaaatgtgattgtggcgaaaaaaaaaaaaaaaaaa

SEQ ID NO: 9502 - DNA, 1383 bp, Medicago truncatula
gaaacattgcgaatccaaaggcaaaatctgtgtctgtctgaaacaaaacacttcaattgaaatcaaacatgttttgcggcgtagttagcacttccttcacttccattttacccagaaaacaacaccactccacacccttttccccattcaaatccattcaatgttctcttccaggagctgttgctgaacctaaaacaaataatgccacagaacctcttttgctcaatgcagttcgtggattagatgtcgaaagacctcctgtttggcttatgaggcaagctgggaggtacatgaagagttaccaaatcatctgcgaaaaatatccgtcattccgggaaagatctgaaaatgttgatctcgtggttgaaatttcattgcaaccgtggaaggttttccagcctgatggggtgatattattctcagacattcttacacccctatctggaatgaatattccatttgacattgtaaaaggcaagggtcctgtcatatttgacccagttcactccgcaggccaagttgatcaagtgagggagtttattcccgaggaatcagttccatacgttggtgaagcactatcaattttgcgcaaagaggtagataataaatctgcagtccttggttttgtgggtgctccgtttaccctggcgtcgtatgtggttgaaggcggttcatcaaaacatttctctaaaataaagagattggcattctctgaaccaaagatccttcactcattactgcaaaagtttacaacatcaatggcaagatacatacaataccaagctgacaatggagcgcaagctgtgcagatattcgattcatgggcaacggagcttagtccagtggattttgaacgattcagtttgccatacttgaagcaaattatcgacactgtaaagaaaagccatccagaactccctcttatcctctatgcaagtggatcaggaggcttacttgagagaatagcattgaccggtgtggatgttgttagcttggattggacagtcgatatggctgacggtagaaggagattaggaccaaatgtagctatccaaggtaatgttgatcctggtgttctgtttggatcgaaagagctgattacagataggatacacgatactgtgagaaaggctggtagagggaaacatatcctaaaccttggtcacggcattgtagtaggtactcctgaggagaatgtagcacatttttttgaggttgccaaaggaatcaaatactaagttcattaagatttttattgatttactaacatttttattcatttcattacagttaatataagattttggtttgtcaatattttatttttgcagtaataagttagttacatgactaacagtttagttaacaaaaaaaaaaaaaaaa

SEQ ID NO: 9503 - DNA, 1401 bp, Glycine max
ggattgctgatctgattcaatcccttatctttccttccttccccatacccatttcatatcacttccttcaaacttttcaacttcactcttcaattcagttcaatttcaaacatgctttgcgtcaacactgccttcacctctttcttgcccagaaaatcaatttgcttcttttcctccaaatcaaccaccccaatttcctgcaccctccaaggaacagttgcagaaccaaaatctacagctgctggtgaacctcttttgctaaatgcagttcgtgggatagatgttgaaagacccccggtttggctcatgaggcaagcagggaggtatatgaagagttaccaaaccatctgtgagaaatatccttcattccgtgaaagatctgaaaatgttgatctcgtggtggaaatttctctgcaaccatggcatgtttttaagcccgatggagtgattttattctcagacattcttaccccactttctggaatgaatataccctttgatattgtgaagggtaagggtcctgttatatttgatcctattcacacagctgcccaggttgatcaagtgagggagtttattcctgaagaatcagttccatatgttggtgaagcactgacaattttgaggaaagaggtggataataaagctgcagtccttggttttgttggggcaccattcaccctggcatcatatgtggttgaaggtggttcatcaaaaaacttctcaaaaataaagagattggctttctctgaatccaagatcctgcactcattactgcagaagtttacaacatcaatggccagatacattcaataccaagctgacaatggagctcaagctgttcagatctttgattcatgggcaacagaacttagtccagtggattttgaagaattcagtttgccttacttgaagcagattattgatactgtgaagaaaagtcatccaaacctccctttgatcctctatgcaagtgggtctgggggtttgcttgaaagactagctttgacaggcgtggatgtagttagcttggattggacggttgatatggctgatggtaggaggcgactgggaccgaatatagctgtccaggggaacgtggaccctggcgttctttttggttcaaaagagttcatcactgatcggataaatgatactgtgagaaaagcaggtagagggaaacatatcttgaatcttggacatggcattaaagtaggtacgcctgaggagaatgttgcacatttttttgaggttgctaaatcaatcagatactaagcagctacttatgattaattcatttttttttgtttaattgcacttttagtttttttactatgatcggtgtttgattttgattctctaatgcattttctcagagcaactaaaaaaaaaaaaaaaaaa

SEQ ID NO: 9504 - DNA, 3217 bp, Vitis vinifera
gggactgtggcagaaccaataattattaatgctactgaacccctcttgcttactgctgttcgaggtgaagatgttgaaagacccccagtttggcttatgaggcaagcagggaggtacatgaaggcaggtttatgcatctatgttttaacactacatgttgtacatctgttctatgtttcaatgagtttatcatgattttcagctggcaaaatattatttcaaaatgaaatcaagttatacacaaaggttggatcatattgttggtgtcattttgtataaatttacctttcacctctttttgacttgcaaatcctccttttctttagtggtctgttgcactaatttggaagatactgttttctcgagcatgacaatgtgggcatcttttcaagatattctgaactcaaacctacccaaggaaagttaactgttatgccttgctaaaatttgcgtcttcaaattttactccataactagacacctgaaatcaatctcattcttcctcctgtggaagagggtttctattagcaatttgctttttggttgcatgccctacttcacaaatatgcgcatatgctgattttagtttggatctcattattgagtctttcttattgcagagttaccaaatcatatgtgagaagtatccttcatttcgtgaaagatcagaaaatgttgatcttgttgtggaaatttctctgcagccatggaaagtttttaaacctgatggggtaagacatcttgctaggattcattcttatattttgacttgtgggagcttcatgttgtgatttgtatgtctaactccatgttcctcgtatttatagtcatattaaaaaataaatattagaaagaactttatagtcatattaaacaataaatattagaaagaacatccttctgcagtgcatatctgtcagcaagctgagtatgagctcagtatgtggacaacaaatttaccatgattttatttcctgttacttctatgagccttttatttgctatctcttttctgatttctgtcatattgatcaatttggcaggttattttattctcagacatccttacccctctttcggggatgaatataccttttgacatcataaaaggtaaaggtcctgtcatattcaatcctttgcgcacagctgatgatgttgaacaagtaagagaatttgttcctgaggattcagttccatatgttggggaagcattgacaatcttgagaaaagaggttttgctcgcacgtctcctctttaattttctgtcttgaatttcttttcttgttcatttatcctattccctcttttgtgaacctcctagtttgatcaaatctaacgtggtcagatattgttggtccttttttatatgactcgaagtattcaaacttcttaggctgaagccatgaatggattgtacaaactttgaaaaggactcctgaccttcctcttctctacagtatatggattccaaacaataggatcaaacttgctttcagtcaaccatctgaatagaagacatagaggatgcttcatatggtgcctgaggaaacttaaaatcttgagaagaaacgaacctgatctttctcacataattatcgttttatcaaccttcatttattctttgccaaactgtgtgagaatcccttacatgcttctaatctcaacaagtatgtttcactttcagtttacactacatgaatgcaggtaagacaaaccgatcttgccatgtacatttatgtgcctaaatagtaactaccttttttaatcagatgaatagtaaccatcttcataactcacttgaccttaacacctttggcttgcttcatttctcactgtccagtgtaatgtttctatgattgagatgatattttacatctcaattttgcaaatttgaagttattatcttagaaactttgatgaaacttaagattttattcgtgcatttgatgtttttataccttgccctagtatttagactttggatgtgttcactcataactttactccgtcaggtggataatgcagcagcagtgctgggttttgttggggccccctttacgctggcatcatatgtggttgaaggtggttcatcaaagcatttctccaaaataaagagactagctttctctcaacccaaggtaatgcagaactatgtgtctctagctttatgggacctatcaattgtacaagattctggaaatagattctagagaaccaacctacacacttagcctcggtcttttacttcagagttagcgagtgagaatttattttgataaattggttatcatcttgaaaatttgatcatctcatttctgaacacctttgtgtaaccatacattgtaagagttcctgaaatatatatgtcatagttaagtcttaagatacattgggagcctgcagttgtttcaaaattccaatctggatggtccgataaatgttccctcaagtttaacgggtgggagtccatagttatatgttcgatgtgcaaagattactgctgaaatgtgattaggtagcagtgtgaatcctagattgtttactagattatatgttattttcttttcgactgtatagggaatatgttgaatcatggacgaaatgaacctctgtgagatgatcagattcagacatgatttgccattccttctgccttcctctcaatgataccacattttacaagccttgcaatattcttgcaggttctccatgcacttcttcagaaattcacaacctccatggcaaagtacattcagtaccaagctgacaatggagctcaagctgttcagatcttcgactcctgggcaacagaacttagcccagtagactttgaggagttcagcctgccttacttaaagcagattgtggattctgtgaaacaaacccatccaaatctccctctaattctctacgcaagcgggtctgggggcttgctcgagaggctacctttgacaggtgttgatgtagtgagcttggattggacagttgacatggctgaaggccggcggagactgggaaccgatgtggccgttcagggcaatatagatcccggcgttctatttggttcaaaagagttcatcaccaaccggataaacgacacagtgaggaaagctggtaaagggaaacacattttgaatcttggccatggaattgtggtaggtacaccagaagagaatgttgctcatttctttgaagtagctagaggaatcagatacta

SEQ ID NO: 9505 - DNA, 1380 bp, Vitis vinifera
atgtcgtgcatctacagcagctcaatctcttccttctctgctctctccacttccctcagatcgaggtctccttctccttcaaattcaaagcccaggatttactgtgcccttggagggactgtggcagaaccaataattattaatgctactgaacccctcttgcttactgctgttcgaggtgaagatgttgaaagacccccagtttggcttatgaggcaagcagggaggtacatgaagagttaccaaatcatatgtgagaagtatccttcatttcgtgaaagatcagaaaatgttgatcttgttgtggaaatttctctgcagccatggaaagtttttaaacctgatggggttattttattctcagacatccttacccctctttcggggatgaatataccttttgacatcataaaaggtaaaggtcctgtcatattcaatcctttgcgcacagctgatgatgttgaacaagtaagagaatttgttcctgaggattcagttccatatgttggggaagcattgacaatcttgagaaaagaggtggataatgcagcagcagtgctgggttttgttggggccccctttacgctggcatcatatgtggttgaaggtggttcatcaaagcatttctccaaaataaagagactagctttctctcaacccaaggttctccatgcacttcttcagaaattcacaacctccatggcaaagtacattcagtaccaagctgacaatggagctcaagctgttcagatcttcgactcctgggcaacagaacttagcccagtagactttgaggagttcagcctgccttacttaaagcagattgtggattctgtgaaacaaacccatccaaatctccctctaattctctacgcaagcgggtctgggggcttgctcgagaggctacctttgacaggtgttgatgtagtgagcttggattggacagttgacatggctgaaggccggcggagactgggaaccgatgtggccgttcagggcaatatagatcccggcgttctatttggttcaaaagagttcatcaccaaccggataaacgacacagtgaggaaagctggtaaagggaaacacattttgaatcttggccatggaatttgcaaaagctcaacacttccccttttatattggcctgcatcattgaatgcaaaaaccagggaatgcagaaagatgtgtgtgaatgctgggaattgctgctctgaagcccatgagatcctatctcccttggggcatcctttgttcatccttgatgaggttggccacgcatcacagagcacatttgagctatatgcccgaatgcacattgaaaccacaagttgtagcatctctctcgtgttgaatcgtgaccttgttgaagacggttga

SEQ ID NO: 9506 - DNA, 1595 bp, Oryza sativa Japonica Group
aggtcgtctctcgccgagacgctgcccaccccaatccggcagcacagcagcagcagaagcagctcggatccctcctgcaatggcgaccgcgtgcccgccgctctcgctgcagccggcctacctctcggggaggtccgcgcgcgcgcgccgcccgccgcccgccgtccgctgcagcgccgtcggagaggttatggcggagacggcggcggtcgggacggcggaggagccgctgctggtgagcgcgatcaaggggaggaaggtcgagagaccgccggtctggctcatgaggcaggccgggaggtacatgaagagctatcaattgctctgcgagcgacatccttcattccgtgaaagatcagaaaatgttgaccttgttgttgagatctctctacaaccatggaaggttttcaagcccgatggagttatcctgttctcagatatccttacaccgcttcctgggatgaacataccttttgacattgtgaaaggaaaaggtccagtgatatttgatcccttgagaacagcagctgctgtgaatgaggtcagagaatttgttccagaggagtgggtcccatatgttgggcaggctttaaacattttgcgggaagaggttaacaatgaagctgccgtgttgggctttgttggagctccctttacattggcatcctattgtgttgaaggaggttcatcaaaaaacttttcaaagattaagaaaatggccttctcagaaccagagattctgcataatttgctacagaaatttactacgtccatggctaactacattaaataccaagctgacaacggagcacaagctgtccaaatttttgactcatgggctacagaactcagcccagttgattttgaggagtttagcttgccttatctgaagcagattgtggatagtgtcaaagaaacacatcctgaattgcctctgatactatatgcaagtggatctggtggactgctggagaggcttccactgacaggtgttgatgttgttagcttggactggacggttgatatggctgaggggaggaaaagattgggatctaacatagcggttcaagggaatgttgaccctggcgttctttttgggtcaaaagagttcataagcaagcggatttttgacactgtgcagaaagctggtaatagtgggcatgtattgaaccttggtcatggcattaaggtaggcactcctgaggaaaatgttgcccatttctttgaggttgcaaaagggatcagatactgaaatacctaggctattcgatgcattcctttctccctagtccccaccggcagaagttgtagattctgctgcttgaggatagatgcaggaagccatgtctagcgtagaatacctgaagagcacatcttttgcgatttctgtgttttgcgatcaaatttttattttattgttagtcttgtaaggttatcacttgaggtgtaagaaagttcctacttgtttatagcaagtatatattctaatcaaatctgtaaccccgagattatcaatttgtatcggtaagaaataaatattgtatttgaaaatgttttttttcctaaaaaagaagcaggatgtaatgttaccttct

SEQ ID NO: 9507 - DNA, 1399 bp, Phaseolus acutifolius
acatgtcgagcacagctggtcaggtcatcaaatgcaaagccgcggtggcatgggaggcagggaagccactggtgatggaggaagtagaggtggcaccaccaaaggctggtgaagtgcgtttgaagatcctctacacctctctttgccacactgatgtttacttctgggaagccaagggccagactccattgtttcctcgtatatttggtcatgaggctggagggattgtggagagcgtaggtgagggtgtgactcatctgaaacccggggaccacgcccttcctgtgtttactggggagtgtggggagtgtgcacattgtaagtcagaagagagcaacatgtgtgatttgctgaggatcaacactgatcggggtgtcatgatccatgatagtcaaacaagattttctataaagggacaacctatttaccattttgttggtacctctacattcagtgaatacactgtggttcatgctggatgtgttgccaaagtcaaccctgctgccccacttgataaaatttgtgttctcagttgtggaatatgcacaggtcttggggctactgtcaatgttgcaaaaccgaaacctggttcttctgttgctatttttggacttggagctgttggccttgctgctgctgaaggggcaaggatttctggtgcatcaagaatcattggggttgatttagtttcaagccgatttgaagaagctaagaagtttggggtcaatgaatttgtgaacccaaaagaccatgacaaacctgtacaagaggtaattgctgaaatgacaaatgggggtgtggatcgtgctgttgaatgtactggcagcatccaggctatgatctcagcattcgaatgtgttcatgatggttggggtgttgctgtacttgttggagtgccaaacaaagatgatgcattcaaaactcatccagtgaattttttgaacgagaggactcttaagggtaccttctatggaaactacaaacctcgcactgatcttcctttagttgtggagcagtacatgaatggggaattggaactggacaaattcatcactcacaccgttccattctcagaaattaacaaagcttttgattacatgctgaaaggggagtccatcagatgcattattcgtatgggagagtagaactatgaaataaatgatgacatagttcctgtggagggactttgttctctttctggttaagaaaagaagaaaataaatattatgcataattaatctcttcaggatgattgaatctgtgagaatttgtccatgtttgaatgtagagaacgatttgtgttatgtggatgagttgctcttgtggtaatttgattgagatttctttcttgaggaaagaaatatatgtgtcaatctataaaaagctgaatacattgttt

SEQ ID NO: 9508 - DNA, 1194 bp, Phaseolus acutifolius
aaattcatcaattcttctttgttctaccatcttttcttctcagacatgtcgagcacagctggtcaggtcatcaaatgcaaagccgcggtggcatgggaggcagggaagccactggtgatggaggaagtagaagtggcaccaccaaaggctggtgaagtgcgtttgaagatcctctacacctctctttgccacactgatgtttacttctgggaagccaagggccagactccattgtttcctcgtatatttggtcatgaggctggagggattgtggagagcgtaggtgagggtgtgactcatctgaaacccggggaccacgcccttcctgtgtttactggggagtgtggggagtgtgcacattgtaagtcagaagagagcaacatgtgtgatttgctgaggatcaacactgatcggggtgtcatgatccatgatagtcaaacaagattttctataaagggacaacctatttaccattctgttggtacctctacattcagtgaatacactgtggttcatgctggatgtgttgccaaagtcaaccctgctgccccacttgataaaatttgtgttctcagttgtggaatatgcacaggtcttggggctactgtcaatgttgcaaaaccgaaacctggttcttctgttgctatttttggacttggagctgttggccttgctgctgctgaaggggcaaggatttctggtgcatcaagaatcattggggttgatttagtttcaagccgatttgaagaagctaagaagtttggggtcaatgaatttgtgaacccaaaagaccatgacaaacctgtacaagaggtaattgctgaaatgacaaatgggggtgtggatcgtgctgttgaatgtactggcagcatccaggctatgatctcagcattcgaatgtgttcatgatggttggggtgttgctgtacttgttggagtgccaaacaaagatgatgcattcaaaactcatccagtgaattttttgaacgagaggactcttaagggtaccttctatggaaactacaaacctcgcactgatcttcctttagttgtggagcagtacatgaatggggaattggaactggacaaattcatcactcacaccgttccattctcagaaattaacaaagcttttgattacatgctgaaaggggagtccatcagatgcattattcgtatgggagagtagaactat

SEQ ID NO: 9509 - DNA, 1429 bp, Lotus corniculatus
catcaatcaattctcagtttttcgtcataatcaatcttctcagttcatcttaatttgtgaaagctagctatgtcgagcacagctggtcaggtcatcaaatgcagagccgcggtttcatgggaggcagggaagccactagtgattgaagaagtggaggtggcgcccccgcaggccggtgaagtgcgcctgaagatactctacacctccctttgccacactgatgtttacttctgggaagctaagggtcagactccattgtttcctcgtatatttggtcatgaagctggaggcattgtggagagcgtaggcgaaggtgtgactcatctgaaaccaggggaccatgctctcccagtattcacaggagaatgtggtgaatgcccacattgcaaatcagaggagagcaacatgtgtgatcttcttaggatcaacactgataggggtgtcatgatcagtgacaaccagagtagattctccataaaaggaaaacccatataccattttgttggtacctcaacattcagtgaatacacagttctccatgctggatgtgttgcaaagatcaaccctgctgccccacttgacaaagtttgtattctcagttgtggaatatgcacaggttttggtgctactgtcaatgttgcaaaaccaaaacctggttcttctgttgccatctttggacttggagctgttggccttgctgctgctgaaggggcaagggtttctggtgcatcaagaatcattggggttgatttagtttccagccgatttgaaggagccaagaagtttggagtcaatgagttcgtgaacccaaaagatcacgacaaacctgtacaagaggtaattgctgaaatgaccaatggaggtgtggatcgtgctgttgaatgcactggcagcatccaggccatgatctctgcatttgaatgtgtccatgatggttggggtgttgctgtacttgttggagtgccaaacaaagatgatgcattcaaaactcatcctgtgaatttcttgaatgagaggactcttaagggcaccttctatggcaactacaaaccccgcactgatcttcctaatgttgtagagatgtacatgagaggggaacttgaactggagaaattcatcacccacacagtttcgttctctgagattaacaaagcttttgattacatgctgaaaggagagtccatcagatgcatcatccgcatggaggagtaaaacccaaaaacaatgatgtgtgagtccctatttggggactgagttctgtttctggttgtgaaagaaaaaaggcatatataaataatcccttatgaggattatgaaatttgtgatgtttgaatgtatagaatggcagggcctttgcttctgggcttgtctaatacagaataaataaaatgtggcttttttccaaaaaaaaaaaaaaaaaaaaaaaaaa

SEQ ID NO: 9510 - DNA, 1454 bp, Lotus japonicus
ttcattaccagctcactcatcaattcattctcagttcatcttaatttctgaaagctatagctatgtcgaccacagctggtcaagtcatcaaatgcagagccgcggtttcatgggaggcagggaagccactagtgattgaagaagtggaggtggcgccgccgcaggccggtgaagtgcgtctgaagatactctacacctccctttgccacactgatgtttacttctgggaagctaagggtcagactccattgtttcctcggatatttggtcatgaagctggaggcattgtggagagcgtaggcgaaggtgtgactcatctgaaaccaggggaccatgctctcccagtattcacaggagaatgtggtgaatgcccacattgcaaatcagaggagagcaacatgtgtgatcttcttaggatcaacactgataggggtgtcatgatcagtgacaaccagagtagattctccataaaaggaaaacccatataccattttgttggtacctcaacattcagtgaatacacagttctccatgctggatgtgttgcaaagatcaaccctgctgccccacttgacaaagtttgtattctcagttgtggaatatgcacaggttttggtgctactgtcaatgttgcaaaaccaaaacctggttcttctgttgccatctttggacttggagctgttggccttgctgctgctgaaggggcaagggtttctggtgcatcaagaatcattggggttgatttagtttccagccgatttgaaggagccaagaagtttggagtcaatgagttcgtgaacccaaaagatcacgacaaacctgtacaagaggtaattgctgaaatgaccaatggaggtgtggatcgtgctgttgaatgcactggcagcatccaggccatgatctctgcatttgaatgtgtccatgatggttggggtgttgctgtacttgttggagtgccaaacaaagatgatgcattcaaaactcatcctgtgaatttcttgaatgagaggactcttaagggcaccttctatggcaactacaaaccccgcactgatcttcctaatgttgtagagatgtacatgagaggggaacttgaactggagaaattcatcacccacacagtttcgttctctgagattaacaaagcttttgattacatgctgaaaggagagtccatcagatgcatcatccgcatggaggagtaaaacccaaaaacaatgatgtgtgagtccctatttggggactgagttctctttctggttgtgaaagaaaaaaggcatatataaataatcccttaggaggattatgaaatttgtgatgtttgaatgtatagaatggcagggcctttgcttctgggcttgtctaatacagaataaataaaatgtggcttttttcaaaaaaaaaaaaaaaaaaaaaaaaaaaaaaaaaaaaaaaaaaaaaaaaaaaaaaaaaaa

SEQ ID NO: 9511 - DNA, 1507 bp, Populus trichocarpa
cggtaaatggttttcttttaagaaatattcaaatttatggtcaacataatccaaaaaacaggagagatatgcgtccttctgcaactataaatacctccaaagacaacctgtctcgtcacaactcaagaaacagagcaaagtaatcaaagaagcgttaaagaagggtctaaagttcgtttaagacaaaaacaaatatgtcaagcactgctggtcaagtcatatgttgcaaagctgctgtggcatgggaagctgggaagccactggtaatagaagaagtggaggtggctcctcctcaagctatggaggttcgtttgaagatcctctttacctccctctgccacactgatgtttacttctgggaagccaagggtcaaaccccattgtttcctcgaatatttggtcatgaagcaggagggattgttgagagtgttggggagggtgtgacagacctcaaacccggtgaccatgtgcttcctgtcttcacaggagagtgtaaggaatgccgacattgcaaatcagaagagagtaatatgtgcgatcttcttaggattaacactgacaggggtgtgatgctgaatgatggcaagtcaaggttttcgatcagagggcagcccatttaccattttgttggcacctcaacctttagcgagtacactgtggttcatgttggctgtgttgccaagatcaatcctgctgctcctcttgacaaagtttgtgttctcagctgtggaatctctacaggtcttggtgccaccttgaatgttgctaaaccaaagaaaggctcttcagtagccattttcggactaggagctgtaggccttgcggctgctgaaggggctcggattgctggtgcttcaagaatcattggtgtcgatttgaattccaatagattcgatgaagccaagaaatttggtgtgactgagtttgtgaacccaaaagatcataacaagcctgttcaagaggtgattgctgaaatgaccaatggaggagttgatcgaagtgtcgagtgtactggaagtgtcaatgccatgatttctgcatttgaatgcgtccatgatggatggggcgttgctgtacttgttggtgtgccgaacaaagatgattctttcaaaacccatccaatgaatgtcctgaacgagaggactctcaagggcaccttcttcggcaactacaaaccgcgctccgaccttccttcagttgtcgaaaagtacatgaacaaggagctggagctagagaaattcatcacccatgaagtccctttctcagaaatcaacaaggctttcgagtacatgcttagtggagctggcctgaggtgtattatccgtatgggtgcataaaagaagactggtttggtttgccttggtgtgacaggaaacaataaaattcttgtttgagattgttgattaaagaagttttctgtgtttgagcatcagtatgtaatttctttcattgttgatggcaaaaatatatataattggctcatttctggcgaaaaaaaaaaaaaaaa

SEQ ID NO: 9512 - DNA, 699 bp, Glycine max
gggagagagagagaaaacaacaacaaacctcatcaccacacagagtagtagagagagagagaaaaaaaaagagagtccgttagttaatttcagtttatttattttatatttttaaaaagaagagaaaaagcaatggtgacagaggaagaaatatctgaagcggttcagtctctgctgcgggaatcaaaccctagtagattcacgacgctaaaccaggtggtggaggagctccaggccaagctcggccacgacctcactcacaaaatcgatttcatcaccgcgcagatcaacctcctcttcggatcccgacaaccgccgcaaaacccgcataggcagttacaacagcctaaggaccattttgcccctccgccaaaccctaattttcactctgcccctgtcagtgttggctttcagttgcagaatttctcttcttctaacgctgttgtcgctgctgctactgctgctgatgcttcgcgcattgaagctccttccgctcctgttgttgttgaaggcaaccaggttcccaaggaaagtactcaaactaaggtgaagagaagaggtggcccaggaggtctcaccaaaatctgtggtgtttcgcctgaacttcaggtcattgttggccagccagcattgtcgaggactgagattgtgaagcaactgtgggcttacataaggaagaacaatctccaagatcccagc

SEQ ID NO: 9513 - DNA, 1979 bp, Glycine max
atggttaccaccaccgttgattcttcctctaaccatcactcacccactgctgctgatacctctaataatttcccgcaaaaaaccatgccatctccgtgggctcaggtcgttcgcggtgccgacgctgaacccaacgatcaatcgccgccatcttcttcctcttcctcgtccctcgattccattaattctaacggtcccgccgttcaaacaagcgatatcgccgtgaaacctgcgtggaagaaaccggaggccaatggcgtcgccgaagttgggcctgtaatgggcgctcattcttggcccgatttatccgagtccaccaagcccaccgctaaattgacatctgactcctctgttaagactgctgctgatgaagagtcaaccaccactcctcagggtcctgttacttcagacccccctcagaaacaagccactgctaatgcaaaacctagtcctactcctgcaatgaactatggtatggctaatagacaaagatcaatgaagcagcgtggaggggcaaatggcaataatgttgggtctggtcctgttcagaacaacttctctggtactaccccaaatcttcctccaccaccacctccgcccccctttcctgttcttctgatgcctccaagtacatttgcccatgggataccaggggctcctgttcctactccaagggatccttacaggaacaataactgggatgcaagacctcaacatgggggttttatgccaccaatgaatgagcatcggagtccctctcacaggggcaatgctgggcaccatccacgtggagaaggtccctatcacaacagttatggcaacaggcgcgatcaggaccgtgtaggttatgcaaatactagagatgctcatgtaaatcaacagaggatgcctccaaggggattaatgaggcccccaccacctaatcctgctccatttatggggcctcagcctatgcgaccccttgcaaaccctgctgggtttcctgaatactattatttcccaacacttcaatttgaaccctttgggggcatgccatttttcacacatgcacctcctcctgcgatgttctacccggttgcagaaactcctctcaccaatacaatagccaaccaaattgattattactttagtgatgctaatttagtgaaggatgagtatttaaggtccaacatggatgaacagggatgggttcctatttctttgattgcaagcttcccacgtgttagaagtttgacaagcaacattaagttgatattggattcattgagaacttccacttttgtggaagtgcagggggacaagttgaggaggcgcactgagtggatgaagtggcttccgtctgttcagcttctggccaagtctggctcaatatcccctagcgaatcaagttctaataacctagcagctgattttgaaaagatcacagtggatgatgctaaagttaacgccaagcctacggcaaatgatgatgctgcaggagagtcctcaactcagtcccaagtcccaaatgatgctactactgtgagcagcaattaaaactcaactcagtttatatctacctcatcccagaatacttggcccatatctggccctgtgcgactcttgattttaaagggtttttttttggaggggatggtaaggataggttgtttggaagtttcattcctttctacggtgacagattgattttggtagcaattgaatcaaagagggaaagaaataagaattcttcggaattattatattggcctaaagaaaagaaagttagcctagaattttgatggaggtgaatttgaagagtttttggttttgtatagttttatatctgctgcggatgatttattctttattttctggtggcttatggtggtatgtgtgggtaaaaatattttttatgaattgaattcagcacttgagctttgcttgtgccaagctgccctgccattttaacgaattaggttatgttgtttgttctgtca

SEQ ID NO: 9514 - DNA, 1738 bp, Glycine max
atggttaccaccaccgttgattcttcctctaaccattactcacccactgctgctactgctgccgctgacacctctaataatttcccgcgaaaaaacctgccatccccgtgggcccaggtagttcgcggtgctgacgctgaacctaaccatcaatcgccgccatcttcttcctcttcctcgttctcgtccctcgattccattaattctaacggtcccgccgttcaaacaagcgataccaccgtgaaacctgcgtggaagaaaccggagtccaatggcgtctcggaagttgggcctgtaatgggcgctcattcttggcccgatttatctgagtccaccaagcccaccgctaaattgacatctgactcctctgttaagactgctgctgatgaagaatcactcaccaccactcctcaggatcctgttaattcagactcccctcagaaacaagccattggtaatgcaaaccctagtcctactcctgcaatgaactatggtatggctaatcgacaaagatcaatgaagcagcgtggagggggcaatgctgggcaccatccacgtggagacggtccctatcataacagttatggcagcaggcgtgatcaggatcgtggaggttatgcaaatactagagatgctcatgtaaatcaacagaggatgcctccaaggggattaatgaggcccccgccacctaatcctgctccatttatggggcctcagcctatgcgaccttttgcaaaccctgctgggtttcctgaattctattatttcccaacgctacaatttgaaccctttgggggcatgccatttttcacacatgcacctcctcctgcaatgttcttcccagttgcagaaactcctctcaccaatacaatagccaaccaaattgattattactttagtgatgctaatttagtgaaggatgagtatttaaggtccaacatggatgaacagggatgggttcctattactctgattgcaagcttcccaagggttagaagtttgacaagcaacattaagttgatattggattcattgagaacttccactgtcgtggaagtgcagggggacaagttaaggaggtgcaatgagtggatgaagtggcttccctccgcccagcttcgggccaactctggttcaatatcccctagcggatcaagttctaataacctagcagctgattttgaaaagatcacagtggatgaagctatttcacataaagttaacactgagcctaccacaaatgaagatgctgcaggagagtcctcaactcagtcccaagtcccaaatgatgctactgtgagcagcaattaaaactcaactcagtttatcttcctcatcccaaaatacttggcccattctagtttttggccctgtgcgactcttgattttgaaagggtttttttggaggggatggtaggataggttgattcctttctacggtgactgagatcgattttggtagcaattgaatcaaatagggaaataaataagaattctttggaattattatggcctaaaaagataaagaaagttaacgagacacaagaaatctagaattttgatggaggtgaattgagttttgggttttgtatagtttttttttgctgcggatgatttattctttattttctggtggcttatggtggtatgtgtgggtaaagtatttgttatgaattgaattgaattgaattgagcacttgagttcgcttgtgccaagttgccctgccattttaacaaa

SEQ ID NO: 9515 - DNA, 219 bp, Glycine max
ccgttagtagataagctggagcatgaaacagcagcaaaggttactggtatgcttttagagatggatcaacccgaggtattacatctgattgagtcaccagatgctcttaaggcaaaagttgttgaggccatggatgtgttgagaaaagttacacagcagcaatcaaacagcccagccgatcaactggcttcactctctctgaatgataatgtcgagtct

SEQ ID NO: 9516 - DNA, 4122 bp, Glycine max
gctcaagttcttgagaaccccaccattgacgcggcggcttccggcgcgaacccctcgctgacgaccatctcgttgtacgtcggggatcttcaccacgacgtcaacgatccgcagctgtatgatctcttcaaccaggttgcccaagtcgtttccgttcgaatttgcagggacgtggccacccaacaatcccttggttacggctacgtcaatttcagcaacgctcacgatggtctatttcttcttctgaatcgcatttgttcttgcattcataggattaatcgcatttgtgtttgcattgtgataggattaattgcatttgttcttgcattggtagggttaatcgcgtttgttcttccattgatagggttaatcgcttttattcttgcattgttaggattaattgcatctgttcttgcattgatagggttaaatggcttttatgcttgcattgatatgattattactcgcatctattcttgcattgataggattagtagcttttgttcttgaattgataggattaatatcgcgtttgttcttgcattgatgggattaatcgcttttgttcctgcattgataggattaagcacttttgttcctgcattgataggattaatcacttatgttcttgcttagtactattttaaccttgattacaaactgtaactatcatgcagccgcaaaagcaattgatgtgctgaatttcactccactgaacggcaaaatcattaggataatgtactctattcgggaccctagtgctcggaagagtggtgcagctaatgttttcataaaggtgacttttgctgattctcaaaccctttttctctatgatgaatattaattttttttctggttgcttattaatcttgttatttcttgattgatggtgcagaatttggacaaggcgattgatcacaaggctttgtacgatacattttcggcttttgggaatattctatcttgcaaggttgcgacagatgcttctggccagtctaaaggccatggttttgtgcagtttgagagtgaagaatctgcacaaaatgcaattgacaagttaaacggcatgctgatcaatgataagcaggtctttgtgggtcctttcctgcggaagcaggatagagagagtgctctcagtggcacaaagtttaataacgttttcgtgaaaaacctgttggattcaatgactgaggctgacttggagagaatttttggagaatatggagctattactagcgctgtagtgatgagagatgtagatggtaaatcaaaaggttttggttttgtcaattttgcaaatgtagacgatgctgctaaagctgtggaggctcttaatggaaagaattttgatggtaaggagtggtatgttggaaaagcccagaaaaagtctgaaagggagcttgaactgaaagggcaacatgaacagattacaaaggagactgttgataaatatcatggtacaaacttgtatatcaagaacttggatgatagtgttggtgatgaagaactcatggaactgttctctgagtttggtacgataacctcatgcaaggtgtgtgagtatggttcttcgttttgttcatatctgcaattgtcaaatctacatcttcgtaaaatgtgtttctttttatcttcgtaaaatgtgtttccttttgcctaacatgcaggttatgcgagatccaaatggaattagtagaggatctggatttgtttcattttcaattgctgagggagcaactcgggctgtaagtatgaaaaaaatgttagggactatccttaaataactgatgaggaactttattgctcatatacaaaatctgttgatacttgtagcttggtgagatgaatggtaaaatggttgctggcaaacctctctatgttgcccttgcacagagaaaagaagatagaagagcaaggttacaggtaatatacagtgcaacaacagatcaccagttaactatatgctttataattacattatggtcatctttaggaataaaaattcctgcattaagtccattgctacttgtagttattttgtgtattttcatgcctgactctgcttttagttaaaattttacataaacttcttttttgtagcaatcttttcagtagcagaaatcatccattgtttttagactagcaaaagatgcttttgtcgcataagatttcattcctatggatcacaaatatgaattgcactatgtcaatagtacaaacatgatatatagaatacataagacaatttcaaaatgatagaggaattggctaggatttgcttccagaaatgtggaacggttactgtttatacatagatgcatcaatatttgcaactacaggaagaatttggacaagtaggttgagttcataaattccaataatacttgtggtgcatacattgaattggaagctatggtattgtttcattgagaaaaatcacaccaaatggaaagattagaggtgaagtgaaacacagaggaggtcaagctgtcttgtcctattagatgatatgttggaaggaaaaaaagttaaaaacaagtttctctcagaatcaggagaaagatatagtttttttttttatttgaagcaaagagaatgatatagttttctggtctaatgatttcagattttgtaggttgtgaattgttgaaattatcgggatttacataggggaggaaaagaaatataaaaaaaagaccgagtgatattctcttatattggtgttgaagtgaagacaaagcactacagttttgtactaatagactgttaatcctaattaaataaggaaataaacgaattattttaagatatggaaaccactcctgagacattacctcagatacattgtaaacattctatgatacaatcttgatattttgagatattttctatttgtactgatatgaatggttaacataactgagaagggtcttaacttattcttgtatttatacatgcagctgttaattttctgacctagcataattgctttatttttttgggcatattatttcatgcaggcacaattttcacaatcgaggcctgctgcaataacccctaatgtttcacctcgaatgcctctataccctctaggggctcctgcgataggacaacaatttttgtatgggcaagcagctccagccacgatacctcaagtaattaaagattcagttggttttaagtttttactcatgcataatgtggcctacagcctacctaccttttaagttttaatgtttcagttggttgtgttgtattctgtatttctgttcctcctgcattacttctgtgttgcaatattcgatgaacatttgatcttcataacaggctgcatttggttaccagcagcattttgttcctggaatgaggccaggtggtgctccaaacttctatgttccactggttcagcagggtcaacagggacagcgcccaggaggacaccgaggatcaggtcctatgcaacagctccagcagccattgccattgatgcaccaacaggtcttattctgcacacctttggcgatttctgttctgttttccttttttaaccccttgtatttgatattctctatgcctgatgttggtatacttattgttgcggttttcagatgcttccaaggggacatgtctatcgatatccttctggctccaatatgcaaaatattcaactggcaggagtacctggaggaatggtcacttatggcattggtcaacaaatgcccacgcaggccctggcctcggcccttgccaatgctactcctgaacagcagaggactgtaagacctgtttctggctttaatttcaacacatttgggtttagcactcattgattcatgcgcactagaaaattgacatacgactctattttgaatggttttgtagatgcttggtgaagctttatacccgttagtagataagctggagcatgaagcagcagcaaaggttactggtatgctcttagagatggatcagcctgaggtattacatctgattgagtcaccggatgctctcaaggctaaagttgttgaggccatggatgtgttgaagaaagttacacagcagcaatcaaacagcccagccgatcaactggcttcactctctctgaatgataatgtcgagtct

SEQ ID NO: 9517 - DNA, 2436 bp, Vitis vinifera
ctgcccacttccggtcgtctctatccctcttctaccgtcgtccttacgttcggcgctgatctccgatcagttatcacttcatttatccccatctccaaaataaaaaaaaatccctaaaaaagttagaaaaatctcccaaaatccccccattttgatttctagggttccgttttaagggccgagtgagattacaaaaaggggaaggaatcgctgtggaatttgcagaatggcacaggttcaggtccaggcacaggctcagcctccagtttctgctgcaaatggaggggctagcaatggtggtggaaaccagttcgtgtcgacgtcgctatacgtcggtgacctagaatcaaacgtcaccgactcgcatctctatgatttgtttggtcagctgggtccggtggtgtccgttcgtgtctgcagggacttgagtacccggcggtctcttggttacggttatgtcaactatggcaacacccaagatgctgctcgggcattggatatgttgaacttcactcctctcaatgggaagccaattaggattatgtattcttttcgagatcctagtattcgtagaagtgggaccgctaatatttttatcaagaatttggataaggcaattgacaacaaagcactctatgatacattttctacatttggggctattctatcatgcaagatagctactgacgcatctggtcagtcaaaaggatatggttttgtacaatttgataatgaggagtctgctaaaaatgctacagacaagctgaatggcatgttactgaatgataaacaagtttatgttggaccctttgtacgtaaacaggaaagggagtctgctacaaataagacaaaattcaacaatgtctatgtaaagaatttgctagaatcaacaactgatgaagatctgaagaatatatttggtgaatatggaccgattactagtgctgtagtgatgcaagatggagatggaaaatctaaatgctttggatttgtgaactttgagaatgcagatgatgctgctcgatctgtcgaggctctcaatggaaagaagtttgatgataaagagtggtatgttgggaaagcccagaaaaaaactgaaagagaggttgaactgaaaggacggtttgagcagagtttgaaggaggctgtagacaaatttcaaggactgaatttatatgtaaaaaacctagatgatagcattgctgatgataaattaagggaattattctcagaatttgggactattacttcatgcaaggttatgcgtgaccctaatggtattagtagaggatcgggttttgttgccttctcgactgcagaagaagcatcccgagcgcttgcggacatgaatggtaaaatggttgctagcaaacccctttatgttgcacttgcacagcggaaagaagataggagagcaaggttgcaggcacaattttcacaaatgcgtccagctgcaatggcaccttcagtaggccctcgaatgtccatgtatccccctggtgctccaggtcttggacaacaactattctatggtcaaggccccccagctcttatccctccccaacctggatttgggtaccagcaccaactagttcctgggatgagacctggtgcagctcccatgccaaatttctttgttcctatggttcagccgggtcagccaaatcagcggccaggaggtcgtcgttctggaacagggccagtgcaacaaacccagcaaccactaccactaatgcagcagcagatgctacccaggggacgtgtctaccgttatccccctggacgtaacatggctgatgttcccattcctggtgttcctggaggcatgctttctgctccttatgacatggctggaatgccattccgtgatgctgcagtctcacaacctatgccgattggggcactggctactgcccttgcaaatgcaccacctgatcagcagaggacattgttgggtgagaatctgtacccacttgtggatcagctggaacatgaaatggcagctaaggtgacaggcatgctactagagatggaccagactgaggttttgcatttgctagaatcaccggaagctttaaaagcaaaagttgctgaggctatggaagttctgaggaatgttgctcagcaacaggcgaacaacccaacggatcgaatggcctcactgtcgctaaatgacactcttacttcctgaatttgcttgcaacagtcggggcatgaccattaggatcatactttctggtgtggcttcctaacttcaaacgaaagttttggtgtggcttctattaagtttaatctgagttgctttaaagagaggaagttgatacttgactgagatttttatttatttaatttttcttttaggacttgaaaaattactcgcccttgatgcctggtttgtgtgcttctttattgtcttctccatttaagtaatcctat

SEQ ID NO: 9518 - DNA, 2651 bp, Vitis vinifera
catctacccaggtacataaagtccacagttgcaccaccgccggtgcggtgcaggtcggtctgccctcctctttaccccaaaaaaaaacatcttcgttcactccgtcgccgttatttggtttcctccgaacgattttatcccctctttacccttccctctcctcttcctgtttctgtttcctaccctaaaacaaaaatttcaaaaaaaatttcagaaatctcaagaaaaaaaaattctaatatcggctgtcggattccaatcctttcagacaaaaatatcagtggcgccactccgcggagtctagtactgttgctgttgttgtgtgctcgtattgtctctctagggtttgatttttgaataatttgaggagagggaagtacagaaaaaggaaaaaaaaatcagaaaaaagaaaggaaaaaaaaaaagatctggatggcgcagattcaggccgcagtagcaggtcccaatggagtggcgaatacagcatcgctatatgtgggagaccttgacgtcaacatcacggattcgcagctttacgatctgtttatccaggccggccaagtgctgtccgtacgggtgtgtagagacttgagcacccggagatctctcggctacggctacgtcaactatagcaaccctcaagatgcggcaagggcattggatctactgaacttcactccactcaatggcaagcccatcagaattatgtactctcatcgggaccctagtattcgtaaaagtggaactgccaatatatttattaagaatctggacaagtcaatcgacaacaaagcactccatgatactttttctgctttcggaaacattctttcttgcaagatagctactgatccttctggccagtccaaaggctatggttttgtacaatttgataatgaagaatctgcgcaaaatgctatagataagttgaatggcatgctgattaatgacaaacaagtgtatgttggacaatttcttcggaagcaggagagagaaactgctttgaataagacaaaatttaataatgtttatgtgaaaaatctctcagaatcaacaacagaagaagatctgaagaatatttttggagaatttggaataattactagtgttgttgtaatgagggatggagatggaaaatcaaaatgttttggatttgttaactttgagaatgcagatgatgctgctgaagcagttgaggctcttaatgggaagaaatttgatgagaaagaatggtatgttgggaaagcccagaaaaaatatgaaagagagcttgaactgaaagggcgatttgagcagagtatgaaggaagtagtagacaaatttcaaggggtgaacttgtatattaaaaacttggacgatagcattggcgatgataaactaaaggaattgttctcagagtttggtacaattacctcatgcaaggttatgcgtgacccaagtggaataagtagaggctcgggatttgttgccttctcaacttctgaagaagcatctcgagcactcacggagatgaatggtaaaatggttgtgagcaaacctctttatgttgcccttgcacagaggaaagaagagaggagagccaggttgcaggcacagttctctcaaatgaggcccgtctcgatggcaccttcagttgcacctcggatgccaatgtaccctcctggtgctcccggtcttgggcagcaattattttatgggcaagggccacctgctataattcctccccaagctggattcggttaccagcagcaactcgttcctggaatgaggcctggtggtgctcccatgccaaatttctttgttccactggtccagcaaggtcagcagggtcaacgcccagggggcagacgtggggcaggtcctgtgcagcagaatcagcagccagtgcccctgatgcagcagcagatgcttccaagggggggacgagtctaccgctaccctcctggccgcaatatgcctgatgttccaatgccaggtgttgctggaggcatgctttcaattccatatgacatgggtggcgtgccacttcgagatgctgcaattggtcagccaatgcccatttcagctttggcttcagctcttgcaaatgcaacacctgatcagcaaagaacaatgctgggtgaaagtttgtaccctctcgtggatcagctggagcatgagatggcagctaaagtgacaggcatgcttctggagatggaccagactgaggttttgcatctgctcgagtcgccagaggctttgaagtccaaggttgcggaggccatggacgtcctgaggaatgttgctcagcagcaggctaacagcccaaccgaacaactagcctcactgtccctaaatgacagccttgttccctgagtgtgttgggtggaacttaaatgtggttccagcagtttaaattaagtttctctgctagtgaaggctctagatttcatttgatatggagttacattagccataggattctgaagtttgaaacatattgtgtgttggtttttggtgatgaagtttaggatgctatacattctatgttctggtgttgacgatcgagtgttcgattgagttgcttgcatattccaaaccatagaattctgacgttaaatagatactatgtttgattttgtgattaaattttggacttagacattgctata

SEQ ID NO: 9519 - DNA, 2491 bp, Daucus carota
gtctttgtctgccctcccaaatcaaaaaaataatctctctctctctctctccccccctctctctcatcatcgtcaatttttcatctctcgacgatttatcccaaaaaatctcaaaaaatataaacacaaattatatctatttctatataatcactagtattctaccctagggttttaaaaaaaaatctaaaaaaggagaatcgaatcaaatcaatggctcagattcaagttcaacctcagcagcagcaacagcagattcctgtttctggatctaacggagtttcggccggagcggcggcaaacgccggcggcagcaatcagttcacgacgacgtcgttgtatgttggagatttggatcaaagcgtgactgattcgcagctgtatgacttgtttaaccaagtcggtcaggttgtgtcggttagggtttgtagagatttgagtactggccgctctctgggttacggttatgttaactatagcaatcagcaagatgcgacgagggctattgatgtcttgaatttcactccgctgaataacaagacaattcgagtgagtgtttctcgtcgggatcctactgatcggaagagtggagctggtaatatttttatcaagaacttggacaagtcaatagatatcaaagccttgcatgaaacattttcaagcttcggaactatcatttcctgcaagatagcaactgatgcctctggccagtctaaaggctatgggtttgttcagtatgatagtgaagaagctgctcagactgctattgacaagctaaatggcatgttgatgaatgacaagcaagtttatgttggtgtatttttgcgcaagcaagatagagatagtgagatgagcaaaactaaatttaacaacatatatgtgaaaaatctttctgattctacatctgaagatgatctcaggaaaacctttggtgagtatggaacaattaccagtgtagtagtaatgagagatgcagatggaaaatcaaagtgttttggctttgtcaactttgagaatcccgaagatgctgctaaagctgttgatgcactgaacgggaagaagttcgacgataaagaatggtatgttggtaaagctcagaaaaaatcagaaagagaagtcgagctcaaaagtaggtttgagcaaactgtgaaggagcaggtcgacaaataccaaggggttaatttgtatgtcaaaaacttagatgacaccattgatgatgaaaaactgaaggagttgttctctgaatatggaactatcacttcatgcaaggtcatgcgtgatcctagcggtatcagccggggatctggatttgttgcattttcaactcctgaagaagcttctagagctcttggtgagatgaatggaaaaatgattgtcagcaaaccactctatgttgcacttgctcagaggaaagaagaaagaagagctaggttacaggcccagttttcacagatgaggcctgttgcaatgcctccatccatgggccctcgtatgccgatgtattcacctggtgctcctggtatgggacagcaactcttttatggacaagcacctcctgcaatgattgcaccccaggctggttttggctaccagcaacagctggttccagggatgaggcctggtggagggccaatgccaaatttcttcatgccaatggtacagcaaggtcagcagggacagagacctggtggaaggcgtggtgcaggtccagcacaacagactcagcaacctgttcctatgatgccccaacagctcatgcccaggggccgcatgtatcgtttcccacctggtcgcaatgttggtgatgttaccatgccaggtgttggagggggaatgcttccagttccctacaacatgggtggcatgcttcctagagaggctgctatgggtcagcctatgccaattacagcattggcttctgcacttgctaatgctccagcagaccagcaaaggactatgcttggggaaaatctatacccgcttgtcgaccagttagagcatgatcatgcagccaaagtcacaggcatgcttttagagatggaccaaactgaagttctgcatttgttagagtcacctgatgctctgaaggcaaaagtggccgaggccatggatgttttgaggaatgtatctcagcctaatgtagctgatcaactaggtggactctctttaaacgagaacctcgtttcttaagatctgtccaggctggcgattctcgtttgaccttgggatccttttctgtgaaggctggaggttctagtctttgtttctttatcatctagtgtctcggaccacgaaccgaactgtgttaagtttaatactgaacgtaagtgcatcttgtttccttgacagtttctctttgactattgaatttggtttggagctacggctttggtttgatatttaccttttactatgtcattagtcaaatccgttagaaatcgttgttattgtgttgatttctaatgatagtaataataaaaaaaaaaaaaaa

SEQ ID NO: 9520 - DNA, 3125 bp, Phaseolus vulgaris
gtcttctttttctgttcgttttctggcccctccatgctgccccacgtctcgctccaagacactgctctgtgccagccccacggcggctccggctgcctcagaggcggtggaggcgtccaggttggagcctagagtggaggagagagatgggttctgggttttgaaggaagagtacagggggggcatcagccctcaggaaaaggtgaagcttgagaaagaccccatgaagcttttcatggaaggtgggattgaggatttggctaagatgtcccttgaggaaattgagagctccaagcacactaaggatgatattgatgttagactcaagtggcttggcctttttcataggagaaagcatcactgtaagtttcacctttttcaacttccttttggttggcttcaccaccactccatcttttggattttttacaattctagcaagattctaatacaattttaaaaggagaaatatattactttttaaaaaatttaaacttattgtataatatatacaaattcgtgtttcagtatcatacaattatacgtatatctgaatctatgtcgtatcaatgtctctagactctcaatatgtcatgattagtgaaaaccaagagttgaatgctacatctttgaaatcctgcatatggataattttttctgtaaagtaatccaaaaagaaagaaagcttgaaacccaaatggattaaattctttccatgacttagaattagtgtagtacacaagtcaatttataaaaactcttctatatagcttttttaaattatacttttaacctatactaggctatgttaacttataagagaaacttaattcatatcataacataagtattttatgggaagtttatctgaatatatctagagtctcaaaccgagtggaccacataagttgttgatgtttaagttaattgcatttcaaactcagggttaagaacaaaatttagtttcagcactattataagtgcttgaaatatcttttcatttgcaaaaccagatggtaggtttatgatgaggctgaagcttccaaatggggtgacaactagctctcagactcgatatttggcgagtgtgatcaggaagtatggaaaagatgggtgtgctgatgtaacaacgaggcagaattggcaaattagaggtgtggtgctacctgatgtgccagaaattcttaagggactagcagaagttggtttgacaagtctgcagagtggcatggacaatgtgagaaactctgtgggtaaccctcttgctggcattgaccctgatgagattgttgatactagaccttacaacaacttgttatctcaattcatcactgccaattcacttggcaacccagccatgtcaaacttgtaagtatgcacttaaagagtatgtgtggaaaaagttcttcataaccacttctagtagaaaaaaataacaaggaaacatgaagctatttcctactagcttgtccaaaatcttattttttaactcaaactaattttaacttgtggaagaaaacaacttctttacattttataatctgagcattggtgtggggtccttaggttcaatctttgaaattgtgcaggcctaggaagtggaatgtgtgtgtggtgggatcccacgatctgtttgagcatccccacatcaatgatctggcttacatgcctgctaacaataaggatggtcgttttggattcaacttactggttggtggtttctttagtgccaagagatgtgctgaagcaattccacttgatgcctgggtctctgcagatgatgtaatcccagtttgtaaagcagttcttgaggcatatagggaccttggcttcagagggaacagacagaaaacaagaatgatgtggttgattgatgaactcgtaagtggattctcttataaattttgccacttttttctagcatctatttagttgacttttactgtaatattttcttttttaaattgtagttaatttagtcagcctaactgatctgtcaagttgcatactggtacttaacatgaaagtttttataaataaaattataatcaatctaaacaaaaactaatgcagtttatagaaggaaaatgattcatgacacttgggtgctatttgacttctagaatagaaacacagataggcatgacaactacattactacattactaaaatatatcttgacaaccatatttttcctaaacaaccaaatcacaatcttttttagtaataaaatattaaattgggattaatcattgttgtttagaataaagtaacaagatatttaccatgtaaataactgtaaaatggttatataaatagtttcataatgatttttttgtagtgtcatgtatctagttggcaagtaagtgataagtgtttggcaaatgcaggggatagaagtattcaggtcagaggtggagaaaagaatggcaggaaagcagctggagagagctcaggaagatctggttaagaaacaatgggaaagaagagactacttaggtgttcatccacagaaacaggagggtctaagctatgttggtattcacattccagttggtagaatccaagcagatgagatggatgagttggcccttttggcagatgaatatggcagtggtgagctgaggctaacagtggagcagaacataataatccccaatgtggacaactcaaaacttgaggccttgctccaagagcctctcttgaaacacaagttttcaccagaaccttctcttttgatgaaaacattggtggcttgcacgggtaaccagttttgcgggcaggccataattgagacaaaggccagggcattgaaagtcactgaggaagtggagaggcaagtggctgtgactaggcctgtgagaatgcattggactggttgccccaacacctgtggtcaggtgcaggttgctgatattggtttcatggggtgcatggctagggatgagaatggtaaagccactgaaggtgtggatatttttctgggagggagaattggaagtgattcacatttagctgagttgtataagaagggtgtgccttgcaagaatttggtgcctgttgttgcagacattcttgtaaaacactttggagctgttcaaaggaatagagaggaagtggaagat

SEQ ID NO: 9521 - DNA, 2267 bp, Glycine max
gagagggaattttagttaaaagtgttttgttttcatgaggaaggtgacccttggaagcaccgaagggtctatcgatccgaggaagatcacctctgacctcttgcttacttgtaaggtcctcgttcactctggtcctctcgtcctacaaaatgtacactcttctctcaaaccgccattaccataataacaacctcaaaaactcaatattctcaacaacacactactttccttcttccaataatgtcttcttcattctctgttcgttttcttgctcctccatcatcatgcttccccagctctcggcccaagacatggctctgcgccgccaccaccccaacggtggctccggcaactgcctcctcggaggtggaggcttcaaggttggagcctagagtggaggagagagatgggttctgggttttgaaggaagagtacaggggaggcatcagccctcaggaaaaagtgaagcttgagaaagaccccatgaagctctttatggaaggtgggattgaggacttggctaagatgtcccttgaggaaattgagagctccaagcacaccaaggatgatattgatgttagactcaagtggcttggcctttttcataggagaaagcagcattatggtagatttatgatgaggctgaagcttccaaatggggtgacaacaagtgcccaaacacgatatttggctagtgtgatcaggaagtacggaaaagatgggtgtgctgatgtaacaacgaggcagaattggcaaattcgtggtgtggtgctacctgatgtgccagaaattctcaagggcctcgatgaggttggattgactagtcttcagagtggaatggacaatgtgagaaaccctgttggtaaccctcttgcaggcattgacccagatgagattgttgatacacgaccttacaacaacttgttatctcaattcatcactgccaattcacgcggcaacccagccatgtcaaacttgcctaggaagtggaatgtgtgcgtggttggatcccatgatctgtttgagcatccccacattaatgatctggcttacatgcctgcaaacaaggatgggcgttttggattcaacttacttgttggtggtttcttcagtgccaagagatgtgctgaagcaattccacttgatgcatgggtctccgcagatgatgtaatcccactatgtaaagctgtccttgaggcctatagggaccttggcttcagagggaacagacagaaaacaagaatgatgtggttgattgacgaattggggatagaagtattcaggtcagaggtggaaaaaagaatgccagggaagcagctggagagagcatctgaggaagaactggttaagaaaaaatgggaaagaagagactacttaggtgttcatccacagaaacaagatggcctaagctatgtagggattcacattccagttggtagagttcaagcagatgatatggatgagttggcgcgattggtggacaaatatggaactggagagctcaggctcacagtggagcaaaacataataatcccaaatgtggatagcaacaaaattgatgccttgctcaatgagcctctcttgaaggagagattctcacctgaaccttctctattgatgaagacactggtggcatgcactggcaaccagttttgtgggcaagccataattgagacaaaggaaagagcattgaaagtgactgaggaagtggagaggcaagtggctgtgactaggcctgtgagaatgcattggactggctgccccaacacttgtggccaggtgcaagttgctgacattggtttcatggggtgcatggctagggatgagaatggtaaggccactgaaggtgtggatattttcctgggagggagaattggaagtgattcacatctagctgaggtgtataagaagggtgtgccttgcaagaacttggtgcctattgtggtagacatactagtaaagcattttggtgctgtccaaaggaatagagaggaaggggaagattaaactttatggccattggcaattttagtttctttactaaatctaccattgtccctgaacaaaagtatcagtgtcctctacataaaagaaaaagggatgatcatgagacatgcattatatcatatgcatgtacacttttggataagacatgtacattctttgctagtccctaagttacactttatttcttcaaagatgtatgctatatatttctcattttcttgtggcaaatgcttaagaattattttttcattataaactaa

SEQ ID NO: 9522 - DNA, 2149 bp, Glycine max
gccacaacacatgtacacgttccttcttcttcttccaataatgtcttcttcattctctgttcgttttcttgctcctcttcctccatcatcatcatcatgcttccccaccagctctctgccgaagacatggctctgcgccgccgccaccccaacggtggctccgtcaaccaccacctcctcctcggaggtggaggcttccaggttggagcctagagtggaggagagagatgggttctgggttttaaaggaagagtacaggggaggcatcagccctcaggagaaagtgaagcttgagaaagatcccatgaagcttttcatggaaggtgggattgaggaattggctaagatgtcccttgaagaaattgagagctccaagcacaccaaggatgatattgatgttagactcaagtggcttggcctttttcataggagaaagcagcatcatggtagatttatgatgaggctgaagcttccaaatggggtgacaacaagtgcccaaacacgatacttggctagtgtgataaggaaatacggaaaagatgggtgtgctgatgtaacaacgaggcagaattggcaaattcgtggtgtggtgctacctgatgtgccagaaattctaaagggcctcgacgaggttggattgactagtcttcagagtggaatggacaatgtgagaaatcctgttggtaaccctcttgcaggcattgaccctgatgagattgttgacactcgaccatacaacaacttgttatctcaattcatcactgccaattcacgtggcaaccccgccatgtcaaacttgcctaggaagtggaatgtgtgtgtggttggatcccatgatctgtttgagcatccacacatcaatgatctggcttacatgcctgcaaacaaggatggtcgttttggattcaacttacttgttggtggtttcttcagtgccaagagatgtgctgaagcaattccacttgatgcatgggtctccgcagatgatgtaatcccactttgtaaagctgtccttgaggcctatagggaccttggcttcagagggaacagacagaaaacaagaatgatgtggttgattgacgaattggggatagaagtattcaggtcagaggtggagaaaagaatgccagggaagaagctggagagagcatctaaggaagaactggttaagaaacaatgggaaagaagagactacttaggtgttcatccacagaaacaagagggcctaagctatgttgggattcacattccagttggtagagtccaagcagatgacatggatgagttggctcgtttagccgacgaatacgccaccggtgagctcaggctcacagtggagcagaacattataatcccaaatgtggacaataacaaaattgatggcttgctcaatgagcctctcttgaaggggagattctcacccgaaccttctctattgatgaagactctggtggcatgcactggtaatcaattttgtggacaagctataattgagacaaaggaaagggcattgaaagtgactgaggaagtggagaggcaagtggctgtgactaggcctgtgagaatgcattggactggctgccctaacacttgtggacaggttcaagttgctgacattggtttcatggggtgcatggctagggatgacaatggtaaggccactgaaggtgtggatattttccttggagggagaattggaagtgattcacatctggctcaagtgtataagaagggtgtgccttgcaaggacttggtgcctgttgtggtagacatactagtaaaacactttggagctgtcctaaggaatagagaggaaggggaagattaagtgcatgtttggatagttattacaaacagacatttgcatcaaaatgagttttgcaaaaggatcctcaccctttcttttgcaaaatgagttttgaagatcattgatttgatctcggaatttgtgcataagttgaattaaaaaccaaatatgcattaaattttaatggccattggtaattttagtttctttattaaatccaccattgtcccttggacaaaattattagtgtcctctacatagaagaagggatgatatatgcatgtacacttttggtttagacgtgttcattctttgctagtccctaatttacactttatttct

SEQ ID NO: 9523 - DNA, 2029 bp, Medicago truncatula
tccacacacactctcttctccaaaaatgtcttccttctcagtacgtttcctcactccaccatccatcactcgtccaaaaacatggctactatctgctgcaactccatcagttgcacctgtttcaacaccacaagttgattcatcaaggttggagcctagagttgaggaaaaagatggttattgggttttgaaggaagagtatagaggaggtattaatcctcaggagaaagttaagattcagaaagaacctatgaagctttttatggaaggtgggattaatgatttggctaatatgtctcttgaagagattgaaagctctaagcttactaaagatgatattgatgttagactcaaatggcttggtctttttcataggaggaaacatcattatggtagatttatgatgagactaaaacttccaaatggggtaacaacaagtgctcaaacaagatacttggcgagtgtgataaaaaaatatggcaaagatggatgtgctgatgtgacaacaagacagaattggcaaattcgaggtgtaacattacctgatgtccctgaaattcttaagggccttgcagaggttggcttgacaagtctgcagagtggaatggacaatgttagaaaccctgttggtaaccctcttgctggtattgatcctgatgagattgttgatacaagaccttacaccaatttgttgtcccaattcatcactgctaattcacttggtaatccaaccattacaaacttgccaaggaaatggaatgtatgtgtgataggttcccatgatcttttcgagcatccacatattaatgatcttgcttacatgcctgctaataaggatggtcgattcggattcaacttattggtgggtggtttctttagtcccaagcgatgtgctgaagcagttccacttgatgcttgggtctctgcagatgatgttatcccactttgtaaagctgttcttgagacctatagagacctcggcaccagaggcaatagacagaaaaccagaatgatgtggttgatcgatgaacttgggatagaagtattcagatcagaggtggaaaaaagaatgccagagaagaagctagagagagcatccaaagaagaacttgttcaaaaacaatgggaaagaagagacatcttaggtgttcatccacaaaaacaagaaggtttaagctatgttggaattcacgttccagttggtagaatccaagcagatgagatggatgagctagctcgtatcgccgacgaatacggcaccggagaactacggctaaccgtagagcaaaacataataattccaaatgtagaaaactcaaaacttgaggcattgctaaatgaacctctcttgaaagacaaattctcaccagaaccttctatcctaatgaaaacacttgtggcatgcactggtaaccaattttgtggccaagcaataattgaaacaaaacaaagagctttaaaagtaactgaagaagttgagagacatgtggctgtgagcaaaccagtgagaatgcattggactggttgtcctaacacatgtggtcaagttcaggttgctgatattggttttatgggatgcatggctagggatgaaaatggtaaggctactgaaggtgttgatattttccttggtgggagaattggaagtgattctcatttagctgaggtgtataagaaagctgtcccttgcaaggacttggtgcctattgtagctgacattttggttaaatattttggagctgtccaaaggaatagagaagaaggggatgattaaagtatataggtatttggtgattttaattgcctctacataaattattagtgttctgtccaaatatatagtcacaagggataattgagattgagatgcagcacacatgaacttgtacatttggataagtcattttcattgctattttataagttacactttgaaattttgtaataaattttattttatttcaagtaaaatttaattatttaataattgtaagatctcatatctagtcctgacattttcaaggactag

SEQ ID NO: 9524 - DNA, 3243 bp, Glycine max
tctgacctcttgcttacttgtaaggtcctccttcacccgtcctacaaaaatgtgacactcttctcttaaaccgccacaacacatgtacacgttccttcttcttcttccaataatgtcttcttcattctctgttcgttttcttgctcctcttcctccatcatcatcatcatgcttccccaccagctctctgccgaagacatggctctgcgccgccgccaccccaacggtggtccgtaaccaccacctcctcctggaggtggaggcttccaggttggagcctagagtggaggagagagatgggttctgggttttaaaggaagagtacaggggaggcatcagccctcaggagaaagtgaagcttgagaaagatcccatgaagcttttcatggaaggtgggattgaggaattggctaagatgtcccttgaagaaattgagagctccaagcacaccaaggatgatattgatgttagactcaagtggcttggcctttttcataggagaaagcagcatcgtaagtttccactttttgaatgttccttttgtgcatcaccaccaccactcacaattttggtgaaacacaaaatttgtgtagtagtattgtaagtgtttttttttattattgtttttttaattagaaatagagtttcatctcgtaattcacatgttaaaaaggacgacacatagaatttgacaatataagataaaacttagatatagtttttattaagtattattcgtgatgatctcccatcaaaattggagcttttatctcgataatttgtataacaaaagtttgtataagttttgtattatttgaaatgaaactccaattctgattcaagaaggttacaaacaacaactttaaagttgtgtataagttttgtatttgattaatatagttgggttaatttcttctcattgcctaaaaacagatggtagatttatgatgaggctgaagcttaagcttccaaatggggtgacaacaagtgcccaaacacgatacttggctagtgtgataaggaaatacggaaaagatgggtgtgctgatgtaacaacgaggcagaattggcaaattcgtggtgtggtgcatcctgagtgtccagaaattctaaagggcctcgacgaggttggattgactagtcttcagagtccaatggacaatgtgagaaatcctgttggtaaccctcttgcaggcattgaccctgatgagattgttgacactcgaccatacaacaacttgttatctcaattcatcactgccaattcacgtggcaaccccgccatgtcaaacttgtaagtaatagtatacaaatataaccaaagggtctaactcggtagttttagtaaagagagtgcatgaattattataaatcttctagttgtcttcttcgatgactgtgtttgattactacggataaaaaatatacttattatgtaagatgaattataattattagttacaaaaaaccttttagtaacggtcttcgagtcctatcgataaaaagtaaactttttatacaaggaggattatatattttgacttgttgtgcattagaatttcatggtctaagcattggtgtggggttcttacatatttccatttttgaatttgtgcaggcctaggaagtggaatgtgtgtgtggttggatcccatgatctgtttgagcatccacacatcaatgatctggcttacatgcctgcaaacaaggatggtcgttttggattcaacttacttgttggtggtttcttcagtgccaagagatgtgctgaagcaattccacttgatgcatgggtctccgcagatgatgtaatcccactttgtaaagctgtccttgaggcctatagggaccttggcttcagagggaacagacagaaaacaagaatgatgtggttgattgacgaattggtaagtcattattttatttaattttacaacttttgcctgctgtcacatcatacttgtacataataagttagattattttaagactgagttatgtcatagtcctttctttcataaattataatcaatctaaacaaaaagtaaaaaattactgcaatttataaaaggaaaaaaatccatgcatatttgacatctagagtgaaacagagacacagaagtacaagtattataagtaacatgatataatatataatagaaaaagataaattatgtattaataaggagtttggatatataagtgtttatgaatcaatattctttataaaatattttcggtcagaaatctggattttctggattattttttattgtaatcactgtagtttaggcttttgactccttgctaagattttgaggtatctaagatgtgttaggccgtttaggctagttatggaactgatcctctgtccaaaatttagtagtactaatctatttccactgtcattaagtgtattttgcttggcaaaatgcaggggatagaagtattcaggtcagaggtggagaaaagaatgccagggaagaagctggagagagcatctaaggaagaactggttaagaaacaatgggaaagaagagactacttaggtgttcatccacagaaacaagagggcctaagctatgttgggattcacattccagttggtagagtccaagcagatgacatggatgagttggctcgtttagccgacgaatacgccaccggtgagctcaggctcacagtggagcagaacattataatcccaaatctggacaataacaaaattgatggcttgctcaatgagcctctcttgaaggggagattctcacccgaaccttctctattgatgaagactctggtggcatgcactggtaatcaattttgtggacaagctataattgagacaaaggaaagggcattgaaagtgactgaggaagtggagaggcaagtggctgtgactaggcctgtgagaatgcattggactggctgccctaacacttgtggacaggttcaagttgctgacattggtttcatggggtgcatggctagggatgacaatggtaaggccactgaaggtgtggatattttccttggagggagaattggaagtgattcacatctggctcaagtgtataagaagggtgtgccttgcaaggacttggtgcctgttgtggtagacatactagtaaaacactttggagctgtcctaaggaatagagaggaaggggaagattaagtgcatgtttggatagttattacaaacagacatttgcatcaaaatgagttttgcaaaagggatcc

SEQ ID NO: 9525 - DNA, 1960 bp, Lotus japonicus
tcaccatgtcttcttccttctccattcgcttcctcgctcctccatttccctccacctctcgccccaagtcatgtctctccgccgccacgccggctgtggctccaaccgatgcggcggtgtcgaggttggagcccagagtggaggagagaaatgggtactgggttttgaaggaagagcacaggggtggcattaatccgcaggaaaaggtgaagctggagaaagagcctatggccctttttatggaaggtgggattgatgagttggctaaggtttctattgaagagcttgatagctctaagcttactaaggatgatgttgatgttaggctcaaatggcttggtctttttcataggagaaagcatcagtatggtagatttatgatgaggctgaaacttccaaatggggtgacaacgagtgcgcagacacgatacttggcgagtgtgatcaggaagtacgggaaagatgggtgtgctgatgtgaccacaaggcagaattggcaaattcgtggtgtagtgctacctgatgttcctgaaattcttaagggccttgcagaggttggcttgactagtctgcagagtggtatggacaatgtaagaaaccctgtgggtaaccctcttgcaggcattgaccctgatgagattgttgatacccgaccttacacgaacttgttgtcccatttcatcactgccaattcacgtggcaacccaaccgtctcaaacttgccaaggaagtggaatgtatgcgttgtgggttctcatgatctctttgagcatccccacataaatgatcttgcttacatgcctgctaacaaagatggtcgttttggattcaacttattggtggggggtttctttagtcccaagcgatgtgcagaggcaattccacttgatgcatgggtctctgcagaagatgtaatcccagtttgtaaagcaatcctcgagatgtacagggatcttggcaccagaggaaacagacagaaaacaagaatgatgtggttgattgacgaactggggatagaagtattcaggtcagaggtggaaaaaagaatgccattagggcagcagctggagagagcatcccaggaagatctggttcagaaacaatgggaaagaagagattactttggtgccaatccacagaaacaagagggcttaagctatgttgggattcacattccagttggtaggatccaagcagatgagatggacgagctggcccgtctggccgatgaatacggcactggtgaactgaggctcactgtagagcaaaacataataatcccaaatgtggaaaactcaaaactcagtgccctgctcaatgagcctctcttgaaagaaaagttctcacctgaaccttcccttctaatgaaaacactggtggcatgcactggtagccaattttgtgggcaagccataattgagacaaaggcgagggcattgaaggtgactgaagaagtggagagactagtggcagtgactaggcctgtgagaatgcactggactgggtgtcccaacacctgcgggcaagtgcaggttgctgatattggtttcatggggtgcatggccagagatgagaatggtaagcctggtgaaggtgtggatattttcctgggagggaggataggaagtgattcacacttagctgaggtttataagaaggctgttccttgcaaggacttggtgcccatagtggcagacatactagtaaaacattttggagctgtccagaggaatagagaagaaggagatgattaagttatttaggtttaacttttgaaattaaaccttctgttgtatctatgacaaaatatcattttcttgtccaaaatttataatagtagtaagggtgatcaagtgagatataccacatgtgccaatggggaaaaaaagtcggatatgaaagttgtaatcttacatgagtggttttgaaattacatgacacatttttattgatcggacgg

SEQ ID NO: 9526 - DNA, 2257 bp, Gossypium hirsutum
gacaaacccaaacattgtcagttttctcggttctttcttacaacccaagctgacccttaacatcgtcgaagagtcccccccatcgaaagaaaaaaaaaccagtaaaaaaaaaaacaaaaaaaaccctcccctttgctcttaaagtccccttcattccattacaaaaatgtccgaactctgatatcccttcacttatctttccaccaccacaattccaccagttccaagcttcttttcaaacaacaaaaccccacatgtcttccttttcggtccgtttctttgctccacaacagccgttactgccgtccacagcttcctctttcaagcccaaaacatgggttatggcagctcccacgacggcgccggcgacttcggtggatgtcgacggggggaggttggaaccccgagttgaagaacgagaggggtacttcgtgttgaaagagaagttcagagatggcatcaaccctcaggagaaaataaagatcgagaaagaccctttgaagcttttcatggaagctgggattgataaactcgctaagatgtcgttcgaggatcttgataaagctaaggctacaaaggacgacattgatgttagacttaaatggctcggcttgttccataggagaaaacatcaatatgggagatttatgatgagactaaaactaccaaatggtgtaacaacaagtgcacaaacacggtacttagccagtgtgataaggaaatacggcaaagaagggtgtgccgatgttacgacaaggcaaaactggcaaatccgtggagcggtgttgcctgatgtgcctgaaatacttaagggtctcgacgaagtaggcttgacgagcctacagagtggcatggacaatgtgaggaaccctgtcggtaatcctcttgccggcatcgaccccgaagagattgtcgatactcgaccttataccaacttgttatctcagttcatcaccgccaattcccgcggcaatccggctgttgccaacttgcctaggaaatggaatgtctgtgtcgtggggtctcatgatctttatgaacatccccatatcaatgatctcgcttacatgccggcgacgaaaaacggacgatttgggtttaatttgctggttggtgggttctttagtgccaagagatgtgatgaggccattcctcttgatgcttgggtctcagctgatgatgtgatcccattgtgcaaagctgtgttagaagcctatagggatcttggataccggggcaataggcaaaagactagaatgatgtggctgattgatgaactggggattgaagtgttcagatcagaggtagccaaaagaatgcctcagaaagagttggagagagcatctgatgaaggtttggttcaaaagcaatgggaaaggagagactacctcggtgtccatccgcaaaagcaagaaggtttcagctacattggcattcacatcccagtcggtcgcgtccaagctgacgacatggacgaactagcccggttagccgacatgtatggctcgggcgaactcagactcactgtggagcaaaacatcataatccccaacgttgagaactcgaaactagaagcattacccaacgagcctctattgaaagatcggttttcaccccaaccaagtattctcatgaaagggctagtagcttgtactggtaaccagttttgcggacaagccattattgaaacaaaagctagagccttgaaggtgacggaagaggttgaaaggctagtgtcggtgagccggccggtgaggatgcattgggccggttgcccgaacacgtgtggtcaagtccaagtggcggatataggtttcatggggtgcatggcaagggatgagaatgggaaaccatgtgaaggggcagacatattcttgggagggagaattgggagtgactcgcatttaggagagctttataagaagggtgtcccttgtaagaacttggtacccgtagttgctgacattttggtggaacactttggagctgtccctaggcaaagggaagaaggggaagattgattcaaaatcaacttcatttcattccattacttctatatttgttttattttttttttctaataaccaagaaaaatgaagggtttgaaagatactggagaggattaaatttggagaatattgatcaatggcatgatgatgaagggctttgtattataaaatatgtaacattttcagcatatgtattagaataaagttactggtaatatattttcagttaaaatttagagatgatcatg

SEQ ID NO: 9527 - DNA, 2190 bp, Populus trichocarpa
gaccaccattacttctctctacaacactaacaaaaatccacacttctctagaaactatctaccatcattatgtcatcactttcagttcgttttctcacgccacaattgtcacccacagttccaagctcctctgcaagaccaagaacaagactctttgctggacctcccacagtggctcagccagcggagacgggggtggatgcagggaggttggaacctagagtggagaagaaagacggatactatgtgttgaaagagaagtttaggcaaggtattaatcctcaagagaaagtgaagatagagaaagagccaatgaagcttttcatggaaaatgggatcgaggagcttgctaaattgtcgatggaagagattgacaaagagaagagcactaaagatgatattgatgttagactcaagtggctcggtctctttcacagaaggaagcaccaatatggtagatttatgatgagactaaagctaccaaatggggtaacaacaagtgcacaaacaagatacttggcaagcgtgatcaggaaatatgggaaagatggctgtgcagatgtaacaacaagacaaaactggcaaattcgtggagtggtgttgcctgatgtgccagaaatactaaggggtctagctgaagttggtctgacaagcctgcagagtggcatggacaacgtgagaaaccccgtcggaaatccgcttgcaggaattgatccggatgagattgttgataccagaccttataccaacttgttgtcccaatttatcactgccaattctcgtggaaatcctgagttcactaacttgccaaggaagtggaatgtatgtgtcgtgggttctcatgatctttatgagcatcctcatatcaatgatcttgcttacatgcctgccatgaaggacgggcggtttggattcaatttgctggttggtgggttctttagtcccaagcgatgtgctgaggcaattcctcttgatgcttgggtttcagctgatgatgtgctcccatcttgcaaagcagtgttagaggcctacagagatcttggcaccagagggaacaggcaaaagactagaatgatgtggctgatcgacgagcttggcattgaaggattcaggtcagaagtagtaaaaagaatgccacgtcaagagctagagagagaatcttctgaagatttagttcaaaagcaatgggaaaggagggactatttcggtgtccatccacagaagcaagaaggccttagctatgcaggtcttcacattcctgtcggtcgcgtccaagcagatgacatggatgagctagctcgtttagctgatatttatggcactggcgaactcagactcactgtggagcagaacatcataattcccaacattgaggactcaaagattgaagccctacttaaagaacctctattaaaagacaggttctcacctgagccacctcttctcatgcaagggttggtagcatgcactggcaaagagttttgcgggcaagcaataattgaaacaaaggctagggccatgaaggtaactgaggaggtgcagaggttagtgtcggtgtctaaaccagtgagaatgcactggacaggctgtcctaatacctgtgggcaggtacaagttgccgatattgggttcatgggttgcatggcaagagatgaaaaagggaaaatctgtgaaggagcagatgtgtacgtaggaggaagagttgggagtgactcacatttgggagagctttataagaaaagtgttccatgcaaggacttggtgcctttggttgtggacattttagttaaacaattcggagctgtacctagggagagggaagaggtggatgattagttcatttaatcaaaatgttcattcttgtttcattgcaaattcggaggggatctaatgcatgcttttggaatcggaaatgaagcactgaaatgatctcacaggactacgacgggtgatagaggtcagagaaggggaagggaagggagttgtgttcttgagctcccacgagcatgatttccaacaactctggtttcattgtttgggttttgtctgatggttagaagcccggtgggagcttttatgtatgaaaataaaacttagtatagcttatgatgcaaaactaaaaacactcggagactaaaaaacaataaaatttggaagatttttgtgtgactcccaaaaaaaaaaaaaaaa

SEQ ID NO: 9528 - DNA, 1751 bp, Vitis vinifera
atggatcttcttgccaagagttacacggcagatgatgacgacgggccacagcatgaagcagaagaccaaaaccttgacaattcatcgccggattcttccccaactcgaatcgctctcccctccaaatcctccgcccccaaggtcgacgacaccacgctcgctctcgcgatcgccaatacaaatgacaaacccattgaccctatccaacacgtcgtccccttcaatcccacctacgaccagctctgggctcccatctatggccccgcccacccatacgccaaagacggcatcgctcaaggcatgcgcaaccacaagctagggttcgtggaaaacgccgctatcgagcctttcattttcgacgaacaatataacacgtttcacaagtacggttacgccgcggacccgtctgcttcggcggggaataattatgttggggatctggaggcgttggagaaaaacgacggtatttcagtgtataatattcctcagcacgagcaaaagaagcggaagattgagaaaaagaaggaatcggagagcgaggagaatgaggatgttgatgtggaggaggttcagaatcccgctactgatacgtggttgttgaaaaataagaagagtccgtgggcggggaagaaggaagggttgcagacggaattgacggaggaacagaagaagtacgccgaggagtacgcaaagaagaagggtgaggagaaaggggcagccgaaaagggcgaatttgttacagataagagtacatttcatgggaaagaggagagggattatcagggtaggtcttggattgcaccacccaaggatgctaaggctacaaacgatcattgttatataccaaagagattggtgcatacttggagtggacacacgaagggtgtgtctgcaattcggttcttccccaagcatgggcatttgattctctcagctgggatggataccaaggtaaagatttgggatgtgttcaattcagggaagtgtatgaggacttatatgggtcactcaaaggcagttcgagatatttcgttttgtaatgatgggactaagtttttgactgctgggtatgacaagaatatcaagtactgggacacagaaactggacaggtgatatccaccttctcaactgggaagatcccttatgttgttaagctgaatccagatgatgataagcagaatatcctattagcagggatgagtgataaaaagattgttcagtgggatatgaatacagggcaaattacacaagagtatgatcaacatttgggagcggtaaacaccattacatttgtagacaacaataggagattcgtcacttctagtgatgacaaatctcttcgtgtttgggaatttgggattcctgtggttataaagtatatcagtgaacctcatatgcactccatgccatcaatttctcttcacccaaatacaaattggcttgcggcacagagtttggacaatcagattcttatttatagcactagggagaggtttcagctcaataaaaagaagaggtttgctggtcacattgcggctggctatgcttgccaagtcaatttctcaccagatggacggtttgtcatgtctggagatggtgaaggtaaatgctggttttgggactggaagagttgcaaagtcttcagaacactcaagtgtcatgaaggggtatgcatcgggtgtgagtggcatcctttggaacaaagtaaagtagcaacatgtggctgggatggcttgattaagtactggta

SEQ ID NO: 9529 - DNA, 1725 bp, Glycine max
atggatctccttcaccaatactcagacggcgacgatcccgactccccctctgaaaaccctagctcccctccgcgcctcctcccgggacgctccgccgcgcccaacgtcgacgacaccatgctggccctcaccgtcgcctcctcctcctcggccctctcgcggcccatcgaccctacccagcacctggtgggcttcaacccctcctacgaccagctctgggcccccatccagggcccggcccaccccttcgccaaggacggcatcgcccagggcatgcgcaaccacaagctcggcttcgtcgaggacgcctccatcgaacccttcctcttcgacgagcagtacaacaccttccacaagttcggctacgccgccgaccccgccgccaacaacttcgtcggcgacctcgacgcgctacgcgacaacaacgccgtctccgtctacaacatcccccgccacgagcataagaaacgccgcattgaggccaagcagaagaagaaatcagaggaagacgacgacggcgacgtcaacgaggagatcgaaaacccggcctcggaggcgtggataatgaagaacaagaagagcccttgggcagggaagaaggaagggttgcaaggagaattgactgaagaacagcagaagtatgcggaggagtatgcgaagaagaaaggggaagagaagagtggtttgggaggggagaaagttgaggttgttaaagataagagcacctttcatgggaaagaggagagggattaccaaggtaggtcttggattgcgcctcccaaggatgcaaaggcgaatagtgatcgttgttatattcctaagagattgattcatacttggagtggacacaccaaaggggtttctgctattaggtttttccccaagtatggccacttgattctctctgccggcatggataccaaggttaagatttgggatgttttcaactctggcaagtgtatgaggacctacatgggacactcgaaagccgttagggatatttgtttcagcaatgatgggaccaagtttttgagtgctgggtatgacaagaatattaagtattgggataccgagacggggcaggtgatatcgacatttgccaccggcaaaattccttacgttgtgaagcttaatccggatgaggataagcagaatgttttgttggctggaatgagtgataagaagattgttcagtgggatatgaataccggccagataactcaggagtatgatcagcatttgggggctgtgaataccatcacctttgttgataacaacaggaggtttgttacttccagtgatgataagtcactcagggtatgggaattcggtattcctgtggttataaagtatattagtgaaccccacatgcactccatgccttccatttcgcttcaccccaatgccaattggcttgctgcgcagagcttggataaccagatacttatttatagcactagggagaagtttcaacttaacaagaggaagagatttggtggacatattgtggctggatatgcatgtcaggtcaatttttctccggatggacaatatgtcatgtcgggggatggtgaggggaagtgttggttctgggactggaagacttgcaaggtctacagaactctcaagtgtcacgaaggtgtttgcattggttgcgagtggcatcccttggaacagagcaaggtagcgacatgtggctgggatgggatgattaagtactggtaa

SEQ ID NO: 9530 - DNA, 1752 bp, Vitis vinifera
atggatcttcttgccaagagttacacggcagatgatgacgacgggccacagcatgaagcagaagaccaaaaccttgacaattcatcgccggattcttccccaactcgaatcgctctcccctccaaatcctccgcccccaaggtcgacgacaccacgctcgctctcgcgatcgccaatacaaatgacaaacccattgaccctatccaacacgtcgtccccttcaatcccacctacgaccagctctgggctcccatctatggccccgcccacccatacgccaaagacggcatcgctcaaggcatgcgcaaccacaagctagggttcgtggaaaacgccgctatcgagcctttcattttcgacgaacaatataacacgtttcacaagtacggttacgccgcggacccgtctgcttcggcggggaataattatgttggggatctggaggcgttggagaaaaacgacggtatttcagtgtataatattcctcagcacgagcaaaagaagcggaagattgagaaaaagaaggaatcggagagcgaggagaatgaggatgttgatgtggaggaggttcagaatcccgctactgatacgtggttgttgaaaaataagaagagtccgtgggcggggaagaaggaagggttgcagacggaattgacggaggaacagaagaagtacgccgaggagtacgcaaagaagaagggtgaggagaaaggggcagccgaaaagggcgaatttgttacagataagagtacatttcatgggaaagaggagagggattatcagggtaggtcttggattgcaccacccaaggatgctaaggctacaaacgatcattgttatataccaaagagattggtgcatacttggagtggacacacgaagggtgtgtctgcaattcggttcttccccaagcatgggcatttgattctctcagctgggatggataccaaggtaaagatttgggatgtgttcaattcagggaagtgtatgaggacttatatgggtcactcaaaggcagttcgagatatttcgttttgtaatgatgggactaagtttttgactgctgggtatgacaagaatatcaagtactgggacacagaaactggacaggtgatatccaccttctcaactgggaagatcccttatgttgttaagctgaatccagatgatgataagcagaatatcctattagcagggatgagtgataaaaagattgttcagtgggatatgaatacagggcaaattacacaagagtatgatcaacatttgggagcggtaaacaccattacatttgtagacaacaataggagattcgtcacttctagtgatgacaaatctcttcgtgtttgggaatttgggattcctgtggttataaagtatatcagtgaacctcatatgcactccatgccatcaatttctcttcacccaaatacaaattggcttgcggcacagagtttggacaatcagattcttatttatagcactagggagaggtttcagctcaataaaaagaagaggtttgctggtcacattgcggctggctatgcttgccaagtcaatttctcaccagatggacggtttgtcatgtctggagatggtgaaggtaaatgctggttttgggactggaagagttgcaaagtcttcagaacactcaagtgtcatgaaggggtatgcatcgggtgtgagtggcatcctttggaacaaagtaaagtagcaacatgtggctgggatggcttgattaagtactggtaa

SEQ ID NO: 9531 - DNA, 2062 bp, Glycine max
atggatctccttcatcaatactcagacggcgacgatcccgactccccctctcaaaaccctagctccccgccgcgcctcctcgccggccgctccgccgcccccaaggtcgacgacaccatgctggccctcaccgtgacctcctcctcctccgcggccctctctcggcccatcgacccgacccagcacctggtgggcttcaacccctcctacgaccagctctgggcccccatccagggcccggcccaccccttcgccaaggatggcatcgcccagggcatgcgcaaccacaagctcggcttcgtcgaggacgcctccatcgaacctttcctcttcgacgagcagtacaacaccttccacaagttcggctacgccgccgaccccgccgccaacaacttcgtcggcgacctcgacgccctccgcgacaacaacgccgtctccgtctacaacatcccccgccacgaacacaagaaacgccgcattgaggccaaggagaagaagaaatcagatgaaaacaccggcgacgacgatgacaacaacgacgaggaggagaaccagaacccggcctcggaggcgtggataacgaagaacaagaagagcccttgggcggggaagaaggaagggttgcaaggagaattgaccgaagagcagcagaagtacgcggaggagtatgcgaagaagaaaggggaagagaagagtggttttggaggggagaaagttgaggttgttaaagataaaagcacttttcatgggaaagaggagaaggattaccaaggtaggtcttggatcgcgcctcccaaggatgcaaaggcgagtaatgatcattgttatatgcccaagagattgattcatacttggagtggacacaccaaaggggtttctgctattaggtttttccccaagtatggccatttgattctctctgctggcatggataccaagattaagatttgggatgttttcaactctggcaagtgtatgaggacttacatgggacactcgaaagccgttagggatatctgtttcagcaatgatgggaccaagtttttgagtgctgggtatgacaagaatattaagtattgggatacggagacagggcaggtgatatcgacgtttgccactgggaaaattccttacgttgtgaagcttaatccagacgaggataagcagaatgttttgttggctggaatgagtgataagaagattgttcagtgggatatgaataccgggcagataactcaggagtatgatcagcatttgggggctgtgaataccatcacctttgttgataacaacaggaggtttgttacttccagtgatgacaagtccctcagggtctgggaattcggtattcccgtggttataaagtatattagtgagccccacatgcactccatgccttccatttcgcttcaccccaatgccaattggctcgccgcgcagagcttggataaccagatacttatttatagcacaagggagaagttccaacttaacaagaagaagagatttgggggacatattgtggctggatatgcgtgtcaggtcaatttttctccagatggacgatttgtcatgtcgggggatggtgaagggaagtgttggttctgggactggaagacttgcaaggtctacagaactctcaagtgtcacgaaggtgtttgcattggttgcgagtggcatcccttggaacagagcaaggtagccacgtgtggctgggatgggatgattaagtattgggactagtttctcctgatcaacctgttgctggaatcagttggcagaagcagggcaaagaaaggcactacttcacgacagaaaggagaagaaacattgaattcacaatgttgatatattcatccttggttaaaagtacaatggcttttattgaatattatcacgagatttctcttcactcatcatgacatggccatccagtgttgtgctaattgcaattttgccatctttttagggacttttgtacaatagtcattttaagttagatattcatgtgtgaaaattgccctctcatgttgcagtttaatttaattacgttttatgctat

SEQ ID NO: 9532 - DNA, 1752 bp, Medicago truncatula
atggatctactcaaccaatacaccgacaacaacaacgatccagactcaccatctcaaaaccctaattcaccggaaaattctccaccccgtctcctcccttcccgttccgccgcccccaaagtagacgacaccatgctcgctctaaccgtcgccgaccccaaaaccctctccaaacccatcgacccaactcaacaccttatcgccttcaaccctacctacgaccagctctgggccccgattcaaggtccatctcacccttacgctaaagacggtttagcacaaggtatgcgtaaccacaagctcggttttgttgaagacgctaatatcgaacctttcctctttgatgaacagcataatacctttttaaaattcggttatgctgctgatccgtctgcttcgaattatgtcggtgattttgatgctttgcagaagaataatgctgcttctgtttataatatcccacaccgtgaacagaagaagcggaaaattgaatctcttaagaagaaagaagacaatgataacgaagaagacgaaagtaacaacgacaaacagggtgctgagattgagaatccagcttctgaggcgtggttgttgaagaataagaagagtccttgggctgggaagaaggaaggtttacaaggagagttaactgaagatcagaagaaatacgctgaggagcacgcgaagaagaaaggcgaagaaaaaagtggttttggtggtgagaaagttgaggctgttacagataagagtacctttcatgggaaagaggaaagggattatcaaggtaggtcttggattgcgcctccaaaagatgcaaaagcgagtaatgatcattgttatataccgaagagattggtgcatacttggagtggacatacgaaaggggtttccgctattaggttttttccgaattcgggtcatttgattctatctgctggtatggatactaaggtcaagatttgggatgttttcaatactggcaaatgtatgaggacttatatgggtcattcaaaagctgttagggatatttgttttaccaatgatggaactaagtttttgagtgccggttatgataagaatattaagtattgggacaccgaaacggggcaggttatatcaactttctccactgggaagattccttatgttgtgaagcttaacccggacgaggataagcagaatgttttgttggctggtatgagtgataagaagattgttcagtgggatatgaatacagggcagatcactcaagagtatgatcaacatttgggggcggtgaataccattacttttgttgataataatcggagatttgttacttccagtgatgacaagtccctcagggtctgggaatatggcattcctgtggttataaagtatattagcgagccacacatgcattctatgccttccatttcgcttcaccccaacgcaaattggctcgccgcgcagagtttggataaccagatacttatttatagcacaagggagaagtttcaacttaacaaaaagaagaggtttgctggacatattgttgctggatatgcttgtcaggtaaatttttcgccggatggtcgttttgtcatgtcgggagatggtgagggtaagtgttggttctgggactggaagagttgcaaagtcttcagaactctcaagtgtcatgaaggcgttaccattggttgcgagtggcatcctctggaacagagcaaagtagcaacatgtggctgggacgggttgataaagtactggtaa

SEQ ID NO: 9533 - DNA, 1737 bp, Cucumis melo subsp. melo
gatcttctccagtcatacacagatcaaaacgacgatgacggaagccctaaacagcttacatcttcaccagaagcgtctccgcctcgccttatcccctccaaaacctcggcgcctaaggttgatgatacaatgttagccctcacggtggctaatgccaaccaaaccctttcgaagccgatagacccaactcagcatcttgttgcgttcaaccccacttacgatcaactatgggcgcccatttatggcccatctcatccctatgccaaggatggaattgcacagggaatgcggaaccacaagctagggttcgtggagaatgcgtccattgaaccatttgttttcgatgagcagtacaacacgttccataaatatggatatgctgctgacccatcagcttctgctggaaacaattacattggggatatggaggctttgcagaagaatgatgccatttccgtgtataacattccacagcatgagcaaaagaagcggaagattgagaaaaagaaagaaatgagtgagaatgaagatatggaagaggaggtgaacccggctgaagttgataatccagcttctgatgtgtggttgatgaagaataggaagagtccatggtctggaaagaaggaaggtctgcaaaccgagctaactgaagagcagaagaaatatgcagaagagtatgcaaagaagaaaggtgaagagaaaggtggtgagaagggagaagttacggcggataagagtacttttcatggtaaagaggagagggactaccagggtagatcttggattgcacctccaaaggatgccaaggccacgaatgatcattgttatataccgaaaagattggtgcatacatggagcgggcacacaaagggtgtatctgctattagattcttccctaaacatggccatttaattctttcagctggtatggacaccaaagtgaagatatgggatgtgttcaattctggtaaatgtatgagaacctacatgggtcactctcaagcggttcgggacatttcattttgtaatgatggatctaagtttttgactgccggatatgataaaaagatcaagtattgggatacagaaacagggcaagtgatatcaaccttctctaccgggaaaattccttatgtagttaagcttaatcctgatgatgataagcagaatatcttgctggcagggatgagtgataagaaaatcgttcaatgggatatgaacacaggacagattacacaagagtatgatcaacatttaggagcagtgaataccattacgtttgtagacaataataggaggtttgttacatcgagcgatgacaagtctctccgtgtttgggaatttggaattcctgttgttattaagtatattagtgagcctcacatgcattccatgccctctatttctgtacatcccaatacgaattggcttgcagcacagagtttagacaatcaaattcttatttatagcactagggagagatttcagctaaacaagaagaagaggtttgctgggcacattgtggcaggatatgcttgtcaggttaatttttctccagatggacgttttgttatgtcgggtgatggtgagggtaaatgctggttttgggactggaaaacctgcaaggtattcagaactctcaagtgtcacgagggtgtatgcattgggtgtgagtggcatccattggagcaaagtaaagtagcaacttgcggatgggatggactgataaagtattgg

SEQ ID NO: 9534 - DNA, 2118 bp, Zea mays
cttcgcgatcgcgaacagtcgcggcggcctcgtcattgccgcagaaaccctaaccctagatccgccgtcatggatctcctccagtcctcttacgcgccggacgacgcgtcgtctccggaggcttcgtcggccgcgtcctcgccggactcctcgccgctccgccttccgtccaagtccgccgcccccgccgtcgatgacaccgcgctcgcactctcctccgcggcgtccgccgcccgcccactcgacccttcgctccacctcgtcgccttcaacccaactgctgaccagctctgggctcccatcctcgggccccagcacccccacgccccgatctcgtccgcctccggcaaccgcaaccacaagctcggccacgttgaggacgccgctgtcctgccattcctattcgacgagcagtacaacaccttccatcggtttggctacgccgccgacccgtctggcctccacatcgtcggcgacgcccagccccaggcgcctgagcccgacactgtctacaacctcgccccttccgagcacaagcgccgtcgcctcctggccaaggcggacaacgaggcggagctagcccccccggaggcaaagaaccccgcctccgaggaatggatcctccacaacaagcagagtccctgggctgggaagaaggaagcgcctcccgcggagctcactgacgagcagaagcagtatgcggaggcgcacgctgccaagaaggccgagaaggaggcccgcctcgaagggaagagcgagaggacagaggttgtggtcaagaccaccttccacggcaaggaggagaaggactaccaaggacgctcctggatcacgccgcccaaggatgccaaggccacaaacgaccactgctacatccccaagaggtgtgtgcacgagtgggtcggtcacaccaagggggtctcagctatcaggtttttcccgaagtatggacatttgctgctctctgcgagtatggattgcaagattaagatctgggatgttcttgggtcacggacatgtatgcgtacctatatggggcactcaaaggcggtaagggatatatcattctccaatgacgggactaagttcttgagcgctgggtatgacaggaatatacagtactgggatactgagacagggcaggtgatctcgaccttttcaactgggaaggtcccatatgttgtgaagctcaatcctgatgaggataagcagcatattctccttgccggaatgagcgataagaagattgtgcaatgggatatgaagtcagggcagattacacaagagtatgatcagcatttaggggctgtgaacaccataacttttgtggataacaacaggagatttgtgacctcaagtgatgacaagtctcttcgtgtgtgggagtttggcatccctgtggtgattaagtacatcagtgagccgcacatgcattcaatgccatcgatgtcactgcatcccaactccaattggctggcagcacagagtttggacaatcagatactgatatacagcaccaaggagaggtttcagcttaataagaagaagagatttgctggccacattgtggcaggttatgcttgtcaggtgaacttctcacctgatgggaggtttgtgatgtctggtgatggcgagggtagctgctggttctgggactggaaaagctgcaggagattcaagactttgaagtgtcacaacggggtttgcattggatgtgagtggcatccgttggaaactagcaaggttgcaacctgtggatgggatggtgtaattaaatactgggactgaactttggcagagatattggttgagctcctgggaaaggttttgtaacaatccgattcacgccgaatgtcatggcatactgtaagtcacatgctcgacaagagaatcccggaggaaaaaacatgtgttttttgaggttacatatatgggagaaaaaggtggggttttgctgctacctttgtgttggttctgccctgttagatgtccaaatgtacaatattcgcaccatattcaaatttttagttgtatctctgccactagcaacttgtttgcggtttctggtaatcctgttccttcgaacgtttgtaccatctgaggaagtgtctgttgtgt

SEQ ID NO: 9535 - DNA, 2161 bp, Zea mays
agctcgtgcgctctcgtcttcgcgatcgcgaacagtcgcggcggcctcgtcattgccgcagaaaccctaaccctagatccgccgtcatggatctcctccagtcctcttacgcgccggacgacgcgtcgtctccggaggcttcggcggccgcgtcctcgccggactcctcgccgctccgccttccgtccaagtccgccgcccccgccgtcgatgacaccgcgctcgcactctcctccgcggcgtccgccgcccgcccactcgactcttcgctccacctcgtcgccttcaacccaactgctgaccagctctgggctcccatcctcgggccccagcacccccacgccccgatctcgtccgcctccggcaaccgcaaccacaagctcggccacgttgaggacgccgctgtcctgccattcctattcgacgagcagtacaacaccttccatcggtttggctacgccgccgacccgtctggcctccacatcgtcggcgacgcccagccccaggcgcctgagcccgacactgtctacaacctcgccccttccgagcacaagcgccgtcgcctcctggccaaggcggacaacgaggcggagctagcccccccggaggcaaagaaccccgcctccgaggaatggatcctccacaacaagcagagtccctgggctgggaagaaggaagcgcctcccgcggagctcactgacgagcagaagcagtatggcggaggcgcacgctgccaagaaggccgagaaggaggcccgcctcgaaagggaagagcgagaggacagaggttgtggtcaagaaccaccttccacggcaaggaggagaaggactaccaaggacgctcctggatcacgccgcccaaggatgccaaggccacaaacgaccactgctacatccccaagaggtgtgtgcacgagtgggtcggtcacaccaagggggtctcagctatcaggtttttcccgaagtatggacatttgctgctctctgcgagtatggattgcaagattaagatctgggatgttcttgggtcacggacatgtatgcgtacctatatggggcactcaaaggcggtaagggatatatcattctccaatgacgggactaagttcttgagcgctgggtatgacaggaatatacagtactgggatactgagacagggcaggtgatctcgaccttttcaactgggaaggtcccatatgttgtgaagctcaatcctgatgaggataagcagcatattctccttgccggaatgagcgataagaagattgtgcaatgggatatgaagtcaggacagattacacaagagtatgatcagcatttaggggctgtgaacaccataacttttgtggataacaacaggagatttgtgacctcaagtgatgacaagtctcttcgtgtgtgggagtttggcatccctgtggtgattaagtacatcagtgagccgcacatgcattcaatgccatcgatgtcactgcatcccaactccaattggctggcagcacagagtttggacaatcagatactgatatacagcaccaaggagaggtttcagcttaataagaagaagagatttgctggccacattgtggcaggttatgcttgtcaggtgaacttctcacctgatgggaggtttgtgatgtctggtgatggcgagggtagctgctggttctgggactggaaaagctgcaggagattcaagactttgaagtgtcacaacggggtttgcattggatgtgagtggcatccgttggaaactagcaaggttgcaacctgtggatgggatggtgtaattaaatactgggactgaactttggcagagatattggttgagctcctgggaaaggttttgtaacaatccgattcacgccgaatgtcatggcatactgtaagtcacatgctcgacaagagaatcccggaggaaaaaacatgtgttttttgaggttacatatatgggagaaaaaggtggggttttgctgctacctttgtgttggttctgccctgttagatgtccaaatgtacaatattcgcaccatattcaaatttttagttgtatctctgccactagcaacttgtttgcggtttctggtaatcctgttccttcgaacgtttgtaccatctgaggaagtgtctgttgtgtagtatccaaaaaaaaaaaaaaaa

SEQ ID NO: 9536 - DNA, 4166 bp, Glycine max
ttcaaatttcaaaaccaaaactaattgtctctctgagagaactccatagcttggaaactccactctccaaaactccatcctccttccttctatgccacaactatgtccctcctcagccgattcttctacaagcgcccccctgacggcttactcgaattatccgacagagtctacgtcttcgattcctgcttctccacggaggcactcccggagggaatgtacagcctctacctccgccaaatcatctccgacctccacgaggacttcccggaatccactttcctcgccctcaacttccgcgacggcgaccaccgcagccgcttctcccgcgtcctctgcgacctcgacgccaccgtcgtcgactacccaaagcagtacgagggatgccccctcctccccctctccctcctccaccacttcctccgcctctgcgactcctgcctcgccgaccccgccgccctgatcctcctccactgtgagcgcggcggctggcccctccttgccttcctcctcgccgccttcctcgtcttccgcaaggccgcgcagaccggggagcgccggattctcgagatggtccataaagaggcgcctaaggggttgctgcagctgttgtcggcgctgaacccgctgccgtcgcagctgcggtatgtgcagtatgtggccaggaggaacattggggcggagtggccaccgccggagagggccctgtctttggactgtgttattctcagagggattcctgggtttgatggcgggaatgggtgcaggccattgtttaggatttttggcaggaatttgcttagtaaaggggggctttccacacagatgatttataatatgcataagaagaagaagagtttgaggcactatagacaggcagactgtgatgtgattaagattgatattcaatgcttagtgcaaggggatgtggttttggagtgtgtccatttggatttggatctggagagggaagtgatgatgtttcgggtgatgttcaacacggcgtttattcggtccaacattttgatgctgaatgctgagaacttagacattctttgggattcgaaggagcggtatccgaagggcttccgggctgaggttttgtttggggaggttgaaagcataagtcctccaagggctcagacgagtattttagatggtgaggtgaaaggtggattgcctattgaggcattttcaagggttcaggaactttttagtggtgtagaatgggttgaaagtggggatgctgctgctgtctggctgctcaaacagcttacagtcttaaatgatgccaaagagctttcaaggtttcaaggtagaggaagttggtattcatcacccgctgactctgactctgaaaataatgaatcgagcactgctgatagttcagatgaggcctttgatgttattcccaagtcttatgctgatccttcaaaattattgatatctgacaaccctgatttggtccatttagcttttgagaacaatggtggagattatgtaaatctcacttcaagaacacctgatcagtcgttgactgataatgtttcatcacctcatcatgctccaagaaaggaatattctccttgttcctctccaccatcaccttcaccagttcccgctactcaaccttttccaataccggcaccaccacctcctacatcaaatatacagccagatttagctcctcccccacctccacatcagatagatcagaatgtgaacaatgcttctacatttccttcacctcctcctcctcctcctcctttggtttccaatactcctagtcaacctccacctcctctaggacctgtacgaacaagttcagccccaccgccaccacctcctcctccaggtcatgtacaaacaggttcagccccaccacctcctccacgatctgtacaaactggttcagctccactgcctccacctccagaatctgtacgaacaggtttggtaccaccacctcctccaggtcccgtgcgaataggttctgccccgcctccacctccacctccacctccacctccacctccacctcctccgggtcctgtacgaacaggttctgtcccgccaccacctcctcctcctccaggtcatgtacgaacaggttcagccccaccaccacctccacctcctccaggtcctgtacggacaggttcagccccaccaccacctccacctcctccaggtcctgtacaaacaggttcagccccaccacctcctcctcctcctccaagtatacgaacaggttcagctccaccacctcctcctcctcctccaagtgtacgaacaggttctgctccaccaccaccaccaccaccattggcaccaaaacctccaggtgctcctcctcctccacctggccgtggtacatctccaatgccacctccaccacctgcagttagggcccctggtgtggcaccaccaccaggcaaagcttcaacaacaaatgttggaagaggtcgtggtactggtggtactgttaatgctcctaagaaaactttgctaaaacccctacattgggtgaaagttgctcgagcagccaagggaagtctatgggctgattcacagaaacaggatagtggaacaagggcccctgagattgatatatcagaacttgagagcctgttttcagcagcatctacttctgatgggagcagtactaagggtggaggacgacgtggtcctaatattaacaaacctgagaaagtacaattggttgatttgcgtagagcatataattgtgaaataatgctctctaaaatcaaaattcctttgccagatatgcttatagcagtcctggcattggattctgcagttctggatattgatcaggttgagaatctcatcaagttctgtcctacaaaggaagagatggagatgttaaagaattatacaggaaacaaggaaatgcttggaaagtgtgaacagttttttatggagctcatgaaggttccacgtgtggaatccaaattaagggtttttgcttttaaaatcaacttttcttctcaggtgaatgatttgaagttaaatttgaacacaatcaacaatgcagccagagaggtgaaagaatctgggaaattgcgtcaaataatgcagaccattcttacactgggcaatgccttgaatcaaggaacagcacggggatcagctgttggattcaaattggatagccttcttaaattatctgatactcgtgcaagaaataacaaaatgactttaatgcattatttgtgtaagcttctcgctgagaagatgccagaattgctagattttgataaggatcttgtccatttggaagcagcttctaagattcaactaaaagcattggctgaagaaatgcaagctgtgagtaaaggtttagagaaagttgagcaagaacttgctgcttctgaaaatgatggtgctatatctactggatttcgtaaggtgttgaagaattttcttgatattgctgaagctgatgtgaggtctcttatatcattgtattctgaagtgggaagaagtgcagactctttgtcccagtactttggggaggatccagctagatgcccttttgaacaagtgacgcaaatccttgttgtctttgtcaagatgttcaacaagtcaagggaggagaatgaaaggcaggcagatgctgaaaaaaagaaattagagaaagaagcattgaaggaaaggacagcaaataactcgctttccaaaaaagatggcgttcgatagatgcctaaacaagcaagccgcatggttactttcagttcaaacacactgcgttattcattttggactatctcaaatgcatatttgcatgtgccattgggatttattccttctaaagatgatgctagctgttggacgcaagtggtttagtcagttccttttagttggatcaacgtgcctctcccattgtgctgcactgctgctaaaggagaaatacatgaagaggctggtggtcttttgtaattataccacagggcaactaatatagaaaattcacgttttcttcctctttaaaatatagaggccatatataatttttttaagttcaaattttcttgtgctctagaacactgcacatgcacttctcattttgtaatctagctgcagataattttttgtagttcaaaaacactttggatatatgataacgaattcttcccgtgtat

SEQ ID NO: 9537 - DNA, 4109 bp, Glycine max
atgtcccttctcagccgattcttctacaagcgcccccctgacggcttactcgaattctccgacagagtatacgtcttcgattcctgcttctcgacggaggcactcccggacggaatgtacagcctctacctccgccaaatcctctctgacctccacgaggacttcccggaatcctccttcgtggccctcaactttcgcgacggcgaccaccgcagccgtttctcccgcgtcctctgcgacctggacgccacattcgtcgtcgactacccaaagcagtacgagggctgccccctcctccccctctccctcctccaccacttcctccgcctttgcgactcctgcctcgccgaccccggcgccctgatcctcctccactgcgagcgcggcggctggcccctcctcgccttcctcctcgccgccttcctcgtcttccgcaaggccgcgcagaccggggagcgccggattctcgagatggttcataaggaggcgccgaaagggttgctgcagctgttgtcggcgctgaacccgctgccgtcgcagctgcggtatgtgaagtatgtggccaggaggaacattggggcggagtggcccccaccggagagggcactgtctttggattgtgttattctcagaggggttcctgggtttgatgggggcaatgggtgcaggccactgtttaggatttttggccggaatttgcttagtaaaggggggctttcaacacagatgatttataatatgcataagaagaagaagactttgaggcactatagacaggcagactgtgatgtgattaagattgatattcaatgcctagtgaaaggggatgtggtgttggagtgtgtccatttggatttggatccggagagggaagtgatgatgtttcgggtgatgttcaacacggcgtttattcggtccaacattttgatgctgaattctgagaacttggacattctttgggattcgaaggagcggtatccgaagggcttccgggctgaggttttgtttggggaggttgaaagcataagtcctccaagggctcaaacaagtattttagatggtgaggtgaaaggtggattgcctattgaggcattttcgagggttcaagaactttttagtggtgtagaatgggttgaaagtggggatgctgctgctgcctggctgctcaaacagcttacagtcttaaatgatgccaaagagctttcaaggtttcaaggtagaggaagttggtattcatcacctgctgactctgactctgaaaataatgaatcaagcacagctgatagttcagatgaggcctttgatgttattcccaagtcttatgctgatccttcaaaattattgatatctgacaaccctgatttggtccatttagcttttgagaacaatggtggagattatgtaaatctcacttcaagaacacctgatcagtcattgactgataatgtttcattacctcatcatgctcccagaaaggaatattctccttgttcctctccaccatcaccttcaccagttcccgctactcaaccttttccaacaccggcaccaccacttcccacatcaatgcctatacagccagatttagctcctcccttgcctccgcatcagatagatcagaatgtgaacagtgcttctacattgccttcacctcctcctcctatagtttccaatgctcctagtcaatctccaccgcctcctcctcctcctccacttcctccacgatctgtacaaactggttcagctccacctcctccaggacctgtacgaacaggctcggtaccaccgcctccacctcctccaggatctgtacaaactggttcagctccaccacctccacctcctccaggtccagtacgaacaggctcggtaccaccgcctccacctcctccaggatctgtaaaaactggttcagctccaccacctccacctcctccaagtccagtacgaacaggttcagccccaccgccacctccacctcctccatgtcctgtacgagcaggttcagccccatctcctcctcctcctcctcctcctcctccaggtcctgtacgaacaggttcagccctacctcctcctcctcctcctccacctcctccaggtcctgtacgaacaggttcagccccacctcctcctcctcctcctcctctaggtcctgtaccaacaggtccagccctacctcctcctcctcctcctcctccaggtcctgtacgaacaggttcagctccaccacctcctccccctccaagtgtacgaacaggttcaactccaccaccaccaccaccggcaccaaaacctccaggtgttcttcctcctccacctggccgtggtgcatcaccgatgccacctccaccacctgcagctagggcccctggtgtggcaccaccaccaggcaaagcttcaacagcaaatgttggaagaggtcgtggtactggtggtactgttaatgctcctaagaaaactttgctaaaacccctacactgggtgaaagttgctcgagcagccaagggaagtctatgggctgattcacagaaacaggatagtggaacaagggctcctgagatagatatttcagaacttgagagcctgttttcagcagcatctacttctgatgggagcagcactaaaggtggaggtcggcgtggtcctaatattaacaaacctgagaaagtacaattggttgatttgcgtagagcatataattgtgaaataatgctctctaaaatcaaaattcctttgccagatatgcttaaagcagtcctggcattggattctgcaattctggatattgatcaggttgagaatctcatcaagttctgtcctacaaaggaagagatggagatgttaaagaattatacaggaaacaaggaaatgcttggaaagtgtgaacagttttttatggagctgatgaaggttccacgtgtggaatccaaattaagggtttttgcttttaaaatcaccttttcttctcaggtgaatgatttgaagttaaatttgaacacaatcaacaatgcagccagagaggtgaaagaatctggaaaattgcgtcaaataatgcagaccattcttactctgggcaatgccttgaatcaaggaacaacacgaggatcagctgttggattcaaattggatagccttcttaaattatctgatacccgtgcaagaaataacaaaatgactttaatgcattatttgtgtaagcttcttgctgagaaaatgccagaattgctagattttgataaggatcttgtccatttggaagcagcttctaggattcaactaaaagcattggctgaagaaatgcaagctgtgagtaaaggtttagagaaagttgagcaagaactcgctgcttctgaaaatgatggtgctatatctacaggatttcgtaaggtgttgaagaattttcttgatattgctgaagctgatgtgaggtctcttatatcattgtattctgaagtgggaagaagtgcagactctttgtcccagtactttggagaggatccagctagatgcccttttgaacaagtgacacaaatccttgttgtctttgtcaagatgttcaacaagtcaagggaggaaaatgaaaggcaggcggatgctgaaaaaaagaaattagagaaagaagccttgaaggaaaggacagcaaataacttgcattccaaaaaagatggtgttcgataggatgcctatacaagcaagccgcatggttactttcagttcaaacaaactgcgctatacattttggactatctcaaatgcatatttgcatgcacctttgggatttattccttctgaagatgatgctggccgttggacgcaagtggtttagtcagttccttatagttggatcaacgtgcctctcccattgtgctgcactgctgctaaaggagaaatacaccgcgacacgctggtggtcttttgtaattataccacaaggcaactaatatagaaacttcacgcttttttcctctttaaaatatagaggccatcatatattattttaagttcaaattttcttgtgctttagaacattgcacttctcaaagctgcagataattctttgtaattcaaaaacactttggatatatgataacgagttcttcctgtgt

SEQ ID NO: 9538 - DNA, 1136 bp, Glycine max; identical to SEQ ID NO: 8906

SEQ ID NO: 9539 - DNA, 1508 bp, Glycine max; identical to SEQ ID NO: 8905

SEQ ID NO: 9540 - DNA, 1557 bp, Medicago truncatula; identical to SEQ ID NO: 8907

SEQ ID NO: 9541 - DNA, 2331 bp, Glycine max
gacaaaaaagagagtataaaacattattttcgaattagggtttctgactgatctccctctctctgctctctgagcacacctccactctgttcctcagattcatcaccaccttgcgttgcgccaatgggaaaagcattcgacatcggagccgttccgttcaacgccgaggggtggggtccgccggacagcaccatcaccggcagcaacatcaacctccctctgaacgtccccttcgcccccttctcccgctccgacaaattgggccgcatcgccgactggacccgcaacttcaacaacccgacccgctccaagaaccccgctgacgccgtctttgacttcacgaacgacgacgacgacgacaccttccacctcgtcgaccccaagcccccgccgcgccccaaatttggtcccaagtggcgcttcccgcagcagcgccagctccctcagcgccgcgacgaagaagtcgaggcgaagaagcgcgagcaggagaaggaacgcgcccgccgagatcgtctctaccacatgaaccgctcaaaccctaatcagcagcgccgtgaagccgctgttttcaaatcctccgtcgatatccaacccgaatggaacatgcacgaccagatccccttcagcaccttctccaagctctccttcaccgttcccgaacccgaagaccttctcctctgcggcgctctggaatactacgaccgcacttacgatcgcatcacgcccaaaaacgaacgccgcctcgaacgcttcaagaatcgaaacttcttcaaagtcaccaccaccgacgaccccatcattcgcagactcgccaacgaggacaaggccaccgttttcgccaccgacacgattctgtccactctcatgtgtgcccctcgttctgtttattcctgggacattgtcgtccagcgtgtcggaaacaagcttttctttgataagcgcgatgggtcgcagctcgatttgctctctgttcatgaaacctcgcaggagccattgcctgagtcgaaggatgatattaactctgcccattcgttgagcgttgaggctgcttatatcaaccagaatttctctcagcaggtgcttattagggatgggaataaggttacttttgatgaggctaacccttttgctaatgaaggtgaggaggttgcttctgtcgcttataggtataggaggtggaagcttgatgatgatatgtatcttgttgcgaggtgtgaggttcatagtgttgttgacgtgaacaagcagaggtcgttccttactttgaatgcgttgaatgagtttgatcccaagtattcgggtgtggactggaggcagaagttggagactcagaggggtgctgtgttggccactgagcttaagaacaatgcaaataagttggctaagtggactgctcaggctcttttggcgagcgcggatacgatgaagttggggtatgtgtcgaggattcatccccgtgatcatttcaatcatgtgattttggctgtggttggatataaacccagggactttgcggcacagattaatttgaacacgacgaatatgtgggggattgtgaagtctattgtggatttgtgcatgaaattgaatgaggggaagtatgttcttgtgaaagatccatctaagccccaggttaggatttacgaggttcctgcggatgcttttgaaaatgactacgtggaggagccacttccggaggatgaacaagttcagcctccatcagagggtgctgaggggggagaggcaactactacaactaatgacgtggaagataagcagatagatggtcaagcttaaaaaggtcatttttttattggagttgatggccgttcatttggaaaaaaagatcgtactcggataaattttctttaacactgcttatttgtcggccaaaattttgcaatatgtgatgttccttttggaccaaaagtttaaagcaaaacttcttagtgttttttttctatgctacagctgtttatgatttacagaccttagcatatttaagtggaaccaccaaagcagtaatatctttcaaaattgtattacgctcatttgggcttagggttattattgtggtttacaaatttccatgtttgcacagagtgatcttgagattcgcaagctacaaacattttggtttgttatcgtattgtaaacgaccaaattagataaaaacatgcttttatttcttgtattttttgtctgaacatgctttatttcttgtatttttggtctgatacaaatatacaattataggccatgtgagacatgaatgaggaaatgaagtaattgtagaaaataagcaaaaatgtcaagaaattaaaatttagg

SEQ ID NO: 9542 - DNA, 2101 bp, Glycine max
tccgagcacacaccactactctgttcctcagattcaacaccaccttgcgtggcgccaatgggaaaagccttcgacatcggagccgttccgttcaacgccgacgggtggggtccgccggacaacgcgacctcaggcagcaacaacaacaacctccctctgaacgtccccttcgcccccttctcccgctccgacaaattgggccgcatcgccgactggacccgcaacttcaacaatccgacccgctccaagaaccccgccgatgccgtcttcgacttcgccaacgacgactccttccccgcctccgccgacgacgacgcctccttccgcctcgtcgacggaaagcccccgccgcgccccaaattcggccccaagtggcgcttccagcagcagcgccagctccctcagcggcgcgacgaggaagtcgaggccaagaagcgcgagcaggagaaggaacgagcccgcagagaccgtctctaccacatgaaccgctcaaaccctaaccaacagcgccgcgaagccgccgtcttcaaatcctccgtggatatccaacccgagtggaacatgcacgaccagatccccttcagcaccttctccaagctctccttcaccgttcccgaacccgaagacctcctcctctgcggcgccctcgagtattacgaccgcacctacgatcggatcactcccaaaaacgaacgccgcctcgaacgcttcaagaatcggaacttcttcaaagtcaccaccaccgacgaccccgtcattcgcagactcgccaacgaggacaaagccaccgttttcgccaccgacacgattctctccactctcatgtgtgctcccaggtctgtttattcctgggacattgtcgttcagcgtgtggggaataagctcttcttcgataagcgcgatgggtcgcagcttgatttgctctctgttcacgagacctcgcaggagccattgcctgagtcgaaggatgacattaactctgctcattcgttgagcgttgaggctgcttatattaaccagaatttttcgcagcaggtgcttattagggatgggaataaggttacttttgatgaggctaacccttttgcgaatgagggtgaggaggttgcttctgtggcttataggtataggaggtggaagcttgatgatgatatgtatcttgttgcgaggtgtgaggtgcatagtgttgttgatgtgaacaagcagaggtcgttccttactttgaatgcgttgaacgagtttgatcctaagtattccggtgtggattggaggcagaagttggagactcagaggggtgctgtgttggctactgaacttaagaacaatgcgaataagttggctaagtggactgctcaggctcttttggcgagtgcggatacaatgaagttagggtatgtgtcgaggattcatccccgcgatcatttcaatcatgtgattttggctgtggttggctataaacccagggactttgcagcacagattaatttgaacacgacgaatatgtgggggattgtgaagtctattgtggacttgtgcatgaaattgaatgaggggaagtatgttcttgtgaaggatccatctaagccccaggttaggatttacgaggttcccgcggatgcgtttgaaaatgactatgtggaggagccacttccggaggatgaacaagttcagcctccagcagaaggcgccgaggggggagaagcagccgctactactaatgatgtggaagacaagcagatagatggtcaagcttaaaaggtcagatgtttattggagtagatgtggccgttcatttgtgaacagatcgcactcagaataattttctttaacactgctttgtcggccaaaattttgcaatgtgatgttcctttggaccaaaagtttaaagcaaaacctgagtttttttttttctttctatgctacagctgtttatgatttacagaccttagcatatttaagtggaagcaccaaagcaacatctttcaaaattgtatttgggcttagggttattattttatggtttacaaatttccatgttggcagagtgatgttgagattcgcaagctacaaacattaatttagtttgttatagtgcgctcta

SEQ ID NO: 9543 - DNA, 2126 bp, Arabidopsis thaliana
aacgtagactaaagaattagggtttccgctttccacacacacagctgcaacactatcttctcagaaatggtaaccgaagctttcgaattcgtcgccgttcctttcaattccgatggctggggacctccagacgcttccgacgtttcctcctccgcctctcccaccagcgtcgccgccgctaatcttctcccgaacgttcctttcgcttccttctcccgttccgataagctcggccgtgtagctgattggactcgcaatctctctaatccatccgctcgtcctaacaccggatccaaatcagatccgtctgcagttttcgatttctccgctttcgcaatcgacgaaggcttcggtctcgcttcctccggtggtaatcccgacgaagacgcagctttccgtctcgtcgacggtaaacctccgccgcgtcctaaattcggacctaaatggcgtttcaatcctcaccacaatcggaatcagcttcctcaacggcgagatgaagaagttgaagctaagaagcgtgatgctgagaaggaacgagctcgtcgtgatcgtctctacaataacaaccgtaacaacatccatcaccaacgccgtgaagctgccgctttcaaatcatccgttgatattcagccggagtggaacatgcttgagcagatccctttctcaacattctcgaagctctcgtacacagttcaagaaccagaagatcttcttctctgtggtggccttgagtactacaaccgccttttcgatcgcataacgccgaaaaacgaacgcagactcgagcgtttcaagaacaggaacttcttcaaagtcactactagtgatgatcctgtgattaggcgtttagctaaggaagacaaagctactgttttcgctactgatgctatattagctgctcttatgtgtgctcctagatctgtttactcttgggatattgttattcaacgtgttggtaacaaactgttctttgacaagagagatggatcacagcttgatttgttgtctgtgcatgagacatctcaagagccattgcctgagtctaaagatgatatcaattctgctcattctctaggtgtggaagctgcttacatcaatcagaacttttcgcagcaggttttggttagagatggaaagaaggaaacttttgatgaagccaatccatttgctaatgaaggtgaagagattgcttctgttgcttataggtatagaaggtggaagcttgatgataatatgcatcttgttgcgaggtgtgagttacagagtgttgctgatctcaacaaccaaaggtcgtttcttactttgaatgctcttaacgagtttgatcctaagtactctggtgttgattggagacagaagcttgaaactcagagaggtgcggttttagctacagaattgaagaacaatggaaataagttggctaaatggactgcacaagctttattggctaatgctgatatgatgaagattggttttgtctctagggttcatcctcgtgatcatttcaaccatgttatattatctgttttggggtataagccgaaggatttcgctggacagattaatctcaacacttctaacatgtgggggattgtgaaatccatagttgatctgtgtatgaaactaagcgaagggaagtatgttcttgtgaaggatccatcgaagcctcaagtgaggatttatgaggttccacctgatgctttcgagaatgattacgttgaggaaccgttgcctgaagatgaacaggttcagccaactgaggaaaacacagagggagcagaagcaagtgtagctgcaactaaagaaaccgaggagaagaaagctgatgatgctcaagcttgatggttataaagtcaggtccaaagtctacacctttcgtttctgggttcttttgagagttgaagcttcaatcaaacaacaacaatggaggttccttttttaattatcttgtcctttttcaaatttttgtggtactgctgtaattttaagtcagaaatgagattgtagaacactatcttcgtgacatcttttggaaaatcattacggattgtttacagaacagaaatctttttactatgactcttatagccaccaaattttcttgaatcattttgcattagttttat

SEQ ID NO: 9544 - DNA, 2054 bp, Arabidopsis thaliana
acagctgcaacactatcttctcagaaatggtaaccgaagctttcgaattcgtcgccgttcctttcaattccgatggctggggacctccagacgcttccgacgtttcctcctccgcctctcccaccagcgtcgccgccgctaatcttctcccgaacgttcctttcgcttccttctcccgttccgataagctcggccgtgtagctgattggactcgcaatctctctaatccatccgctcgtcctaacaccggatccaaatcagatccgtctgcagttttcgatttctccgctttcgcaatcgacgaaggcttcggtctcgcttcctccggtggtaatcccgacgaagacgcagctttccgtctcgtcgacggtaaacctccgccgcgtcctaaattcggacctaaatggcgtttcaatcctcaccacaatcggaatcagcttcctcaacggcgagatgaagaagttgaagctaagaagcgtgatgctgagaaggaacgagctcgtcgtgatcgtctctacaataacaaccgtaacaacatccatcaccaacgccgtgaagctgccgctttcaaatcatccgttgatattcagccggagtggaacatgcttgagcagatccctttctcaacattctcgaagctctcgtacacagttcaagaaccagaagatcttcttctctgtggtggccttgagtactacaaccgccttttcgatcgcataacgccgaaaaacgaacgcagactcgagcgtttcaagaacaggaacttcttcaaagtcactactagtgatgatcctgtgattaggcgtttagctaaggaagacaaagctactgttttcgctactgatgctatattagctgctcttatgtgtgctcctagatctgtttactcttgggatattattattcaacgtgttggtaacaaactgttctttgacaagagagatggatcacagcttgatttgttgtctgtgcatgagacatctcaagagccattgcctgagtctaaagatgatatcaattctgctcattctctaggtgtggaagctgcttacatcaatcagaacttttcgcagcaggttttggttagagatggaaagaaggaaacttttgatgaagccaatccatttgctaatgaaggtgaagagattgcttctgttgcttataggtatagaaggtggaagcttgatgataatatgcatcttgttgcgaggtgtgagttacagagtgttgctgatctcaacaaccaaaggtcgtttcttactttgaatgctcttaacgagtttgatcctaagtactctggtgttgattggagacagaagcttgaaactcagagaggtgcggttttagctacagaattgaagaacaatggaaataagttggctaaatggactgcacaagctttattggctaatgctgatatgatgaagattggttttgtctctagggttcatcctcgtgatcatttcaaccatgttatattatctgttttggggtataagccgaaggatttcgctggacagattaatctcaacacttctaacatgtgggggattgtgaaatccatagttgatctgtgtatgaaactaagcgaagggaagtatgttcttgtgaaggatccatcgaagcctcaagtgaggatttatgaggttccacctgatgctttcgagaatgattacgttgaggaaccgttgcctgaagatgaacaggttcagccaactgaggaaaacacagagggagcagaagcaagtgtagctgcaactaaagaaaccgaggagaagaaagctgatgatgctcaagcttgatggttataaagtcaggtccaaagtctacacctttcgtttctgggttcttttgagagttgaagcttcaatcaaacaacaacaatggaggttccttttttaattatcttgtcctttttcaaatttttgtggtactgctgtaattttaagtcagaaatgagattgtagaacactatcttcgtgacatcttttggaaaatcattacggattgtttacagaacagaaatctttttactattaaaaaaaaaaaaaaaa

SEQ ID NO: 9545 - DNA, 1621 bp, Musa acuminata
atgggcttcgacgtgggcgttgtccccttcaataccgacggatggggtccgcccgagagtcccgccgctcccctcctcctctccaggaacgacggggaatccacccagccggccaacatccccttcgcccccttctcgcgatccgagaagcttggacgcgttgccgactggactcgcaatcctaatttcggcaacaacgctgcccggtctgctggaggccgcgacgccgtcttcgacttcgccgttgacgagtcctccgccctctctggcgctgctgctgacgattcttccttccgccttgtcgatggtaagccccctccgcgacccaagttcggccctcgctggcgcttccagcagcgcccgcagctgccgcagcgccgcgacgaggaggtcgaggctcggaaacgggaggccgagaaggagcgtgcccgccgcgaccgtctctatcgccttaaccaccgctcctacgcttccgccggtggtcacggcgccgctggctcccaccgcgatgcccctgcccgcaagtcctccgtcgacatacagcccgaatggacgatgctcgaccagatccccttttccaccttctccaagctctccttctccgtccctgacccgcccgaggacctcctcgtctgtggcgcccttgagttttacgaccgctccttcgaccgcgtcaaccccaagaacgagcgccgcctggagcgcttcaagtcccgcaacttcttcaaggtcaccacctccgacgaccctgtcatccgccgcctcgccgccgatgacaaggccactgtgttcgccaccgatgccatcctttccgcgctcatgtgcgccccacggtctgtgtactcctgggacattgtcatccagcgtgtcggtaacaagctcttcttcgacaagcgcgacaggtctcagctcgacctcctctccgtccatgagacctcgcaggagctcctccctgatgccaaggaggacatcaactcagcatactccctcgccgtcgaggccacgtacatcaaccagaacttctcccagcaggtgcttgtgcgtgacggaaacaaggtttccttcgacgaacccaacccctttgcttccgaaggcgaggaagttgcctccgttgcataccggtaccgacgctggaagctcgacgaagacactcatatcatcgctcgctgtgaggtgcatagcgtgaccgacgtgaagggacagcgagccttcatgaccctgaacgctctcaacgagtttgaccccaagttctcaggggttgactggaggcagaaacttgagacacagaggggagcagttctcgctaccgagctaaagaacaatgccaacaagctcgcaaagtggacggctcaagccctccttgctggtgctgatttgatgaagctggggtatgtctcaagggtccatccccgagaccacttcaaccatgttattttgagcgtgattgggtacaagcccaaggactttgcaacccagatcaatctcaatacctctaacatgtgggggattgtgaagtcgatcgtggacctctgcatgaagctcaacgaggggaagtatgtgcttgtgaaggacccggtgaagccgcaggtcaggatctatgaggttccagcagatgcatttg

SEQ ID NO: 9546 - DNA, 1423 bp, Phaseolus vulgaris
ggcacgaggtcaactccactccactggagaccaacagggaagtgagaatacaccgtagctggagctggggaacctcgtcgccactcgctctcgtccccgacggagatccaccatggacggcaaccccaccaccacttcctcctccgcatcacctcccgtgaatttcaatttctcccccgataacccctccccaatcaccctcactgcggatcaggtcagccactgcgcccaagccctcaaccttttgaaggaaaaactccacgctcctcacaccatcactcgggagttcgcacacttgcaggctaacagaataacgccgagtgagatgaggagaagatgcaccgtcgctcttgacgccgtcaatttgagcaaaaaccgatacacggacgttttgccatttgacagtaacagggttgctctcaaatcgagtacagattatagacctgcagcacaggggtatatcaatgcaagcttggtctcgacctcctcccctggaaacgtgtcacagtttgtagccacacaaggtccacttccacatacttatgaagatttctgggagatgattatccaatatcactgccctgcaattatcatgcttacaaggttggtggataattataagatggtaaagtgtggagattattttcaagcggaggacggacctagagaagttggtaatatttctgttattggtaaatgggtgaacactaccgaaacttcattggtgctgcgccttttagaggtgaaccatagagaggtagaagatgctccaatatctgttttgcatattcagtatcctgagtggcctgaccacggagttcccaaagatacattagctgtgcgtgaaattttgaaaagattataccatttaccaccaaaccttggtccaatagtggttcactgcagtgcaggtattggtagaactggaacatactgcacaattcacaacacaattcagagaatacttgctggtgatatgtctgctgtagatattgctaacacagtatctgtgttcagggcccagcgtattggaatggttcagacccaggatcagtacattttctgctataaagccatcatagatgaactggaagaccttgtatctcagcagtagaaggagctgaaaagatgctataagctgcttgcctcgttttgaagctaacttccaattcttcgatcttttatttggttcgtgcaatggtcatatctcccggctgctaacactgaaacattggcattctggatattttatgaatttgactgttattctctagcttttcatgtataactgcaggcaggggaaagctgacagatattagcatccttttggttatattgttagaattatgttgggaaacagaatggcataattattaatgactgcaataatcaaaagtccatcgcccaaaaaaaaaaaaaaaaa

SEQ ID NO: 9547 - DNA, 1412 bp, Glycine max
gttccactctatatccatcgtcaacagtgaagtgcgaatactcagcaactggagctggggaaccttgtctctactcgctctcgtccccgccggagatccaccatggccggcaaccccgccaccacttcctcctccgcattatctcccgagaaatttaatttcaatttctcccccgataacccctcccgaatcaccctcacttcggatcaggtcaaccactgcacccaagccctcaacattctgaaggagaagctccacgctcctaacgtgatcactcaggagtttgcacacttgcaggcgaacaggataacgccgagcgagatgaggagaagatgcaccgtcgcgtatgacgacgtcaatttgaggaaaaaccgatacaccgacgttctgccatttgacaagaacagggttgttctcaaatctagtactgattatagacctgaagcacaggggtatatcaatgcaagccttgtctcgacctcctcagctggaaacgtgtcccagtttatagccacgcaaggtccacttcaacatacttacgaggatttctgggaaatgatcatccaatatcactgccctgcaattatcatgcttactagattggtggataattacaagatggcaaaatgtggagattattttcaagctgaggataggcctagagaagttggtaatatttctattattggtaaatgggagaacacgactgaaacttcactcgtgctgcgccatttggaggtgaaccatagagaggtagaagatgcgccattatctgttttgcatattcagtatcctgaatggcctgaccatggagttcccaaagatacatttgctgtgcgtgaaattttgaaaagattataccatttaccaccaaactttggtccaatagtggtgcactgcagtgcaggtattggtagaactggaacatactgcacaattcacaacacaattcagagaatagttgctggtgatatgtctgctgtagatattgctaagacaatagctatgttcaggtcccagcgtattggaatggttcagacccaggatcagtacattttctgctataacgctatcatagatgaactggaagaccttgtatctcagcagcagtcggagtagaaggtgctggaacttggaaggatgttgaagctgcttgcctcattttgaagctaactatcaattcttcgaacgtttttatgttcctgcaatgctcatgttttccagcagctgaagtctgaaacattagcatctgggagattttatgaatttcaccgaattctgttattctcatgcttttttgtataattgcaggcagggaaagctgacaaatattaacatccttttgattatattgttagaattctattggggaacagaatggcataatgactacaataatgcattgtccctcc

SEQ ID NO: 9548 - DNA, 1080 bp, Glycine max
tcatatcaactggagctggggaacctcgtctctactcgctctcgtccccgccggagatccaccatggccggcaactccgccaccgccaccgccacctcctccgcattgtctcccgagaatttgaaattcaatttctcccccgataacccctcccgaatcatcctcacttcggatcaggtcaaccactgtacccaagccctcaaccttctgaaggagaagctccacgatcctcacgtgatcactcaggagttcgcacacttgcaggcgaacaggataactccgagtgagatgagaagaagatgcaccgtcgcgtatgacgccgtcaatttgagcaaaaaccgatacacggacgttttgccatttaacaagaacagggttgttctcaaatcaagtactgattataggcctgaagcacaggggtatatcaatgcaagccttatctcgacctcttccgctggaaatgtgtcccactttatagccacacaaggtccacttccacatacttgtgaggatttttgggaaatgattacccaatatcactgccctgtgattatcatgcttactaggttggtggataattacaagatggtaaagtgtgtagattattttcaagctgaggatgggcctagagaagttggtaatatttctattattggtaaatgggagaacactactgaaacttcactggtgttgcgccatttggaggtgaaccatagagaggtagatgatgcaccattatctgttttgcatattcagtatcctgaatggcctgaccatggagttccaaaagatacactagctgtgcgtgaaattttgaaaagattataccatttaccatcaaaccttggtccaatagtggtgcactgcagtgcaggtattggtagaactggagcatactgcacaattcacaacacaattcagagaatacttgctggagatatgtctgctgtacgcattgctaacacaatagctatgttcaggtcccagcgtattggaatggttcaaacccaggaccagtacattttctgctataatgctatcatagatgaactggaagaccttgtatctcagcagcaatag

SEQ ID NO: 9549 - DNA, 1336 bp, Pisum sativum
gttgaactggggaacctcgtctctacccgctctcgtcctcgccggaaatccgtcatgggtgggagttccgcacctccctcctccacgtcttctcacaacaattcaactttctcacctgatttcccttcccgaattccccttacttccgatcagatcaaacactgcactgaagcactcgccctgttgaaaaacaaacttctcaaccctcacaccgtctcccaaaagttctttcacttgcagtcgaataggataacgctgagtgagacgacaaaaaaatgccatgttgctcttaattctgctaatctcagcaaaaatcgatacagtgatgttataccatttgacaagaacagggttgttcttaaatcgagttctgattataggtctgaagcactagggtatatcaatgcaagcaaaatctcgacctcttcccctggaattgtgtccgagtttatagccacgcaaggtccaatgccacacacttttgaggatttttgggaaatgatgatacaatatcactgccctgcaattgtgatgcttactgggttggtcgacaattacaagacggtgaagtgtggagattattttcaatctgaagatagacctagagaattcgggaatatctctcttacatgtaaatggacgaaaactactaaaacttcacttgtgctgcgacatttggaggtgaaccgtaaagaggtagaagatacaccgttatctgtttttcatattcagtatcctgagtggcctgaccatggagttccaaacaatactttggctgtgcgtgcaatttggaaaagattataccacttgccaccaaatcttggcccaatagtggtgcactgcagtgcaggtattggtagaactggaacatactgcacaattcataacacgattcagagaatacttgctggtgatatgtctgctatagacattgccaatacagtatctgtgttcagatctcagcgtattggaatggttcagacacaggatcagtacattttttgctatgaagctatcatagatgaactagaagaccttgtatctcaacagtaatgagagtagaaggtggtggaccaaagaatgttagtctgattgcctcactctgaagccaacgttcgattcttcgattttccacttgggtcctactatgctcttgtttcccagcagctgattctgaagcattagcattcaggagattttatgattttcattgaactcagtttattctcaagcattcatgtatatttgtagtcaggtgaaagctaacaaatatcagcatccttttcattatatttctacaattctattggtgaactgaaagacactaatgaccttt

SEQ ID NO: 9550 - DNA, 469 bp, Glycine max
gaataggtttccctaacaccaaaattacatttcacacatatttggttccttgcagaagaagatggagaacaacagcaggagtccgcgagagggttgcatggattttgcagttcacagccaagtgataaagattaaggaagaaattgagaaaataaagcacccttcacttcagctacacatgaggcgtgcccttctcagagatgtcaaccgcctccgctctcgctcacccctcggatttgcagacagagagagagctatccttacttagatgttacaaacttacacacacatgtacatataaaaatacagagacttccctttcaaggaagtttcaactatgatattttgtgtttcttcttcctagctttctatgtgtttctgtacttccttgtacatgtttttggtggtaacgtttacgacgtggtttctctcaagtctataagactataactcccttttttactcataa

SEQ ID NO: 9551 - DNA, 2001 bp, Medicago truncatula
cccattttcccctctttatttttcttccgattctatcaacgaacaactcttcgtttttctgcagaagaaacataaattagttcttgaactcattcacacaaatgcaatctgttcacaatttgcatagttgaatttaaatcagtccctacttgttttaaccggatccagatcagagtcctcggtcccactctgagaaccataatggagtgggaaaatgcagtttcaggaggatccgattcagcgcttccaattccacttccattagcttctgaatctcaacaaccttatgtctctgaacttctctccttcactctcgatcgccttcataaagaacctgagcttcttcgcgtcgatgccgaacggatccgtcgtcaaatgcaagaggttgccgttggtaattatcgttcattcattgctgctgccgatgctttgcttgctattcgtcatgaagtttcctctattgatactcatcttgaatctatgataaatgaaatcccaaagctgacatctggatgcactgaattcatagaatccgcggaacaaattttggagaagaggaagatgaaccaaacaatgctagccaatcacagtactttgcttgacttgctagaaattcctcaacttatggacacatgtgtacggaatggaaattatgatgaagctctagatttggaagcatttgttggtaaactttcaaccatgcatccaaagttacccattattcaagcattggctgcagaagttagactgacaacccaatcgcttctttcccagcttcttcagaaacttcggtcaaatattcagttgcctgaatgcctgcgcattattggatatttacggcgaataggagtatttagtgagtatggaatgcgtttgctgttcttaagatgtcgagaagcatggcttaatggtattcttgaagatctggatcaggcaaatccgtatgaatacttaaaaggaatgattaactgtcacagaatgcatctttttgatgtcgtgaatcaatatcgagcaatatttgctgatgacacatcgggaagtgaggaaaactatgatggtggactactttttagctgggcaatgcaccaaattacctcacatctgcaaactctgaaagttatgcttccaaagataactgaaggtggatcactgtctaatattttggatcagtgcatgtactgtgctatgggactgggttgggttggactggattttcgaggcttgctcccaccactttttgaagaggcagttctcaacttattctccaaaaatatgagtactgcagttgagaattttcagttggtcttggaatcacatcgctgggttcccctacctgcagttggctttcgtgcaaattctgttgaagaaagtaaggaagatgtaactcctccctcttatttgatggagcatccacctcttgctgtttttataaatggtgtatctgctgcaatgaatgagctacgcccgtgtgccccattaagtttaaagcatgtccttgcccaagaattgatcaagggactacaggctgtttctgattcattgttgctatacaacacaacacgcgttcttagggctaatgaatcaggacttttcctctcactttgccgggcatttattgaggtactttataacttggtcactgtttttttcagggttgcttatcctcattgtgctacatgttttggacgttgctatactggtggagcaactcttattacggatgcaaagaacgtttatgatggaattagacgcctagtagaggcttcctctgcaagagaactcccaaaaccagtaaataatggagaagccagtggcatagctgagaatggtgaagtgccaaaaatggataatggagaaacacctgatgccaaagaacctgatgccaaagaatctgaagccatcgatactgaatctgaagccaccaatactgacgagacgaacaaaaactctacttctcagacaggtcaggaagtcattaatcttgaaaagacagatgaataa

SEQ ID NO: 9552 - DNA, 2220 bp, Glycine max
aacccaacgccattagtgaaccttgaaaccttaacagagtaaacttgcttgcagcgaatccagattcggaggaggagtgagtggtccttgttgctgatttggcaacaacaaataaagatgatagtttgagtttgagtttgtgtgaatccagatctgagtttcatttcgcagttttgcggagaagagaacaatggagtcagcaacggtatcatcatcggagtcggagacggcgcttcctcttcctctggcgtcggagtcacagcaaccctacgtctccgaacttctctccttcacgctcgatcgcctccacaaggaacccgaactcctccgcgtcgacgccgaccgcattcgccgccaaatgcaggaggtcgcagtcggcaactaccgatctttcattgccgccgccgacgccttaatcgccattcgccaggaagtttcttccattgacaaccaccttgaatctctgataaatgagatcccaaagctgacatctggatgcactgagttcatagaatctgctgagcggattttggagaagaggaagatgaaccaaacaatgctaactaatcacagtactttgcttgacttgctagaaattcctcaactcatggacacatgtgtacggaatgggaattatgatgaagccctagatttggaagcatttgttggcaaactttcaaccatgcatccaaagttaccagttattcaagcgttggctgcagatgttaggctgactacccaatcacttctttctcagcttcttcagaaacttcgctcaaatattcagttacccgaatgccttcgcattattggatatttacggcgaataggagtatttagtgagtatggaatgcgtttgctgttcttaagatgccgagaggcatggcttactggtatactcgaggatctggaccaggcaaatccatatgagtacttaaaagggatgatcaactgtcacagaatgcatctttttgatgttgttaatcaatatcgagcaatatttgcggatgacacatcaggaagtgaggaaaattatgacggtgggcttctttttagttgggcaatgcaccaaattacctcacacctacaaactctgaaagttatgcttccaaagataactgaaggtggatcactgtcaaatattttggatcagtgcatgtactgtgccatgggacttggttgggttggactggattttcgaggcttgctcccatcactttttgaagaagctgttctcaacttattctccaaaaatatgagtagtgcagtagaaaattttcagttggtcttggattcacatcgatgggttccccttcccggagttggcttttctgcacatactgtcggtgatgaaaatcatgaggatgtcactccgccctctaatttgatggagcatccacctcttgctgtttttattaatggtgtatctgcagcaatgaatgagctacgtccatgtgccccaataagtctaaaacatgtccttgcccaagaattgattaagggattacaggctgtttctgattcattgttgctgtacaatacaactcgagttctaaggtctaatgagtcaggacttttcctctcactctgttgggcatttatagaggctgcctatcctcattgtgcaacttgttttgggcgttgctatctgggtggagcaactctcattatggatgcaaagaatgtatacaatggaatcagccgcttattagagacttcctctgcaagagaactcccaaaaccagtgaacaatgtagaatccaagagcgtagctgagaatggcgaatcgccaaaaatggaaaatggagaaacacctgatgccaaagaatctgaagccgtcaatagtgaagaggtgaatgaagaaggcaccgaagaaggccctactttgcagacagatcgggaagacactaatcttgaaaagccacttgaataatgacattagagatgacagtttttattttcttgtttatgatattgctccccatttcagtgtttacatttttgccttggttttattctttgtatactcgaagacaggtctcgtcagctgtaattatattattggattacataaaatgaataggccgtagaaagcattgattgtattagaggaacgaagagggtttttggcagatagattacttgtagagatcaattttgtatttttgggggcataatgttttcatacattgttaatatacgctgtacgttccaagtgcc

SEQ ID NO: 9553 - DNA, 2228 bp, Glycine max
  misc_feature (1356)..(1356): n is a, c, g, or t
gaaagcttaacagaggaaatatccttgcagtgaatcaagattcggaggagtgagtggtccttggtgctgatttggcaacaacaaccacagatgagagtttgagtgtgagtgaatccagatccgagtttcgcacttttgcggagaatagaacaatggagtcggcaacggcatcatcatcggaatcggagatggcgcttcctcttcctctggcgtcggagtcacaacaaccctacgtctccgaactcctctcctttacgctcgatcgcctccacaaggagcccgaactcctccgcgtcgacgccgaccgcattcgccgccaaatgcaggaggtcgccgtcggcaattaccgatccttcatcgccgccgccgacgccttaatcgctattcgccaggaagtttcttccattgacaaccaccttgaatctctgataaatgagatcccgaagctgacatctggatgcactgagttcatagaatctgctgagcagattttggagaagaggaagatgaaccaaacaatgctaactaatcacagtactttgcttgacttgctagaaattcctcaactcatggacacatgtgtacggaacgggaattatgatgaagccctagatttggaagcatttgttggcaaactttcaaccatgcatccaaagttaccagttattcaagcgttggctgcagaagttaggctgactacccaatcacttctttctcagcttctacagaaacttcgctcaaatattcagttaccagaatgccttcgcattattggatatttacggcgaataggagtatttagtgagtatggaatgcgtttgctgttcttaagatgccgagaggcatggcttactggtatactcgaggatttggaccaggcaaatccatatgagtacttaaaagggatgatcaactgtcacagaatgcatctttttgatgttgttaatcaatatcgagcaatatttgcggatgacacatcaggaagtgaggaaaattatgacggtgggcttctttttagttgggcaatgcaccaaattacctcacacctacaaactctgaaagttatgcttccaaagataactgaaggtggatcactgtcaaatattttggatcagtgcatgtactgtgctatgggacttggctgggttggactggattttcgaggcttgctcccatcactttttgaagaagctgttctcaacttattctccaaaaatatgagtactgcagtagagaattttcagttggtcttggattcacatcgatgggttcccctgcccggagttggcttttctgcacatactgttggtgatgaaaatcatgaagatgtcactccaccctctaatttgatggagngtccacctcttgctgtttttattaatggtgtatctgcagcaatgaatgacctacgcccatgtgccccaataagtctaaaacatgtccttgcccaagaattgattaagggattatgggctgtatctgattcattgttgctgtacaatacaactcgagttctaagatctaacgagtcaggacttttccgctcactctgccgggcatttattgaggttgcttatcctcattgtgcaacttgttttgggcgttgctatccgggtggagcaactcttgttatggatgcaaagaatgtatatgatggaatcagccgcctattagagacctcctcttcaagagaactcccgaaaccagtgaacaatgaagaatccaagagcgtagctgagaatggcgaactgccaaaaatggaaaatggagaaacacctgatgccaaagaatctgaagccgttattggcaaagacgtgaacgaagaaggccctactttgcagatagatcaagaagacactaatcttgagaagtcggttgaataacgacattagagatgacagtttttatttttattttttgtttttgatactgctccctgtttttagtgtttaattttggcctcattggctttatttttttgtatactctaagacaggtgtcgtcagctgtaattatattatcggagtacataatatgaataggccgtagaaaacattgattgtattagaagaacgaagagagttcttggcagatagattacttatagagattagttttgtattttcggggggcataatgttttcatatattgctaatgtacgttgtacgttacaaatgccacaattctactttggtttttatgaagtgagcttcgtctttggccaacc

SEQ ID NO: 9554 - DNA, 1897 bp, Vitis vinifera
tctccaatggctactctcctccctctcgcctccgtctctcaacaaccctacgtctccgaactcctctccttcacactcgatcgcctccacaaggaaccagagcttcttagagttgatgctgaacgaattcgtcggcaaatgcaagaggtggcagttaataattaccgtgcattcatttctgccgctgatgctttactagcaattcgagaggaagtatcttctgtggataaacacctagagtctctgataaatgaaataccaaagctgacatctggttgcactgagttcattgagtctgcagaacagattttggaggagagaaagatgaaccaaacattgctagccaatcatagtactttgcttgacttgcttgaaattcctcagctcatggacacatgtgtacggaacggcaattatgatgaggctcttgatttagaggcttttgtttgcaaactttcaacaatgcacccaaaattgccagtcattcaagcactggctgcagaagttaggcaaacaacccaatctcttcttcatcagcttctccagaaacttcgatcaaatattctgttaccagattgtctccgcattattggatatttacgtcgaataggagtatttagtgagtttgaaatgcgtttacagtttttgagatgccgagaagcatggctcactggaattcttgatgatttggaccaaaaaaatgcttatgattacttaaaagggatggtaaactgtcagaggatgcatctctttgatgttgttaaccaataccgagccatatttgctgatgatacatcaggaagtgaagaaaactatgatggtggacttctttttagttgggctatgcatcagataacatctcaccttagaactctgaaagccatgctccccaagataactgaaggcgggtctttgtcaaatatcctggaccagtgcatgtattgtgcaatgggacttggttgggttggactggattttcggggattgctcccatctctttttgaagaggcagttctcaatttattctcaaagaatatgaatacagctatagagaattttcagttagtattagattcacatcgttgggtaccattgccagctgttggcttcccttctggtggcgtaggtgaagaaactcgggaggatgtgacccccccatcttatttaatggagcatccacctcttgcagtgtttgttaatggtgtatctgcagcgatgaatgagctacggccctgtgctccaataagcttaaaacacgtgcttgcgcaagaattgatcaacggattgcgggctgtttccaattccttattgaggtacaacgcgtctcggatgctcagagaaaacgaatcacttcttttcctctcactttgccgagcattcatcgaggttgcttatccacactgtgccacttgctttggccgctgctacccaggcggagctgctctcatcatggacgcaaagaacttgtacgacggaattggcaacctattagcagtttccgcctcaagagaactccccaaatcagtgaccaccacagaggagaacagtgtaacagtaacggaaaacggcaacctgcccaacgaagagaatggagtcatgcctgaaacggagcaggctctaaatggcaaagtagatgaggaggaggagaatgacctcacttccctaactgaaaaacctgcggatgaatgaagcaacctacagaagcaattctccttttttatttttgcagttgtccactccaattttttggtctgttgtttgtaattattacgtcaaaatgatttcttacatgttgtaggagtcaactccataattcttctatcaaactagtgagagagaaccaagaatttttttttccttaggccatgatttttcatttttgattcgcttcgtataa

SEQ ID NO: 9555 - DNA, 4502 bp, Citrus unshiu
atggaaactgaaactggagacgacgccacttcatcctcggtggcgagtctcctccctctcgcctccctctctcagcaaccttacgtctcggagctcctttccttcactctcgatcgcctccacaaggtaaaaaaaaaaaattgatttcaatagaagtttttcagtgatggaagcggaatgatattgttatttcttgtaattgtaaggaaccggaacttcttcgagtagatgcggagagaatacagaggcaaatgcaagaggtggcggttgggaattaccgcgcatttatagctgcagctgatgcattgctcgcgattcgagaggaagtctcttctatcgataagcatcttgactctctggtaattcacgatcatacttcatcacattttgtgatatttaattgctttttttgatactttggttttgtatcagatgttacattatgcaagtgctgacttatgatgtgtccaatttcgaagaagaatattttacttgaaataatgtaaactccgttttatgcatagatgagtaattagttgctagcttacattacatatcccaaagcattataaaaacagttctctttatttctttttaataaatagctttgtcgtttgacttgtcggcatatctaaaatgaattaaactctttagtggctgaaattgggggtgaatcgtattgtgttttaatggacgagttttatggaagatgtgaattgaagtaatgatttagtcacaagggtgctcaattttgtgaagcaggaaaatattgtcatctttgggctgtagagaaccaggaagtgcaataattatagttttacaaaatgctatgatgaattgaatgcttggattgttaagagaacacgagcatggagcttaggaatgaaaggctttgtacttattcatagattgatattttatgtattgggatttgttgatatataaattttcatctcctgcagataactgagatcccaaaactgacatctggttgtacagaatttattgaatctgccgaagagattttggagaaaagaaagatgaaccaaatgctgctagcgaatcacagtactttgcttgacttgcttgaaatccctcaacttatggacacgtatgtgtttgagaaaactattaagttacttgtttaacttaatcagtgaccaatgcaatataaggttttaaatagtacttgtcaaacgtgttatatatttttaattttcaaaagccttaatgcatttattatctgggcttcatgaagttaattttattttttttctgatattctttagaaggatacatgtgttattagttgcgtccaaggggtgttttggtcaagccatgataaaatggctgcatttttagtgtttcataggtttattaatattgttggatacaaagctgctttttctttgttttctcaaaggtgcattaaaccaagcatctgcatgtactgtgtattgtaagtattgtcagtactaaacatttgataagaataaaatttcaccctaaatggtttgagatgattcagaaacttgtgtgctaggctaattatttgaaagattcgctgactttcttctttttgcagatgtgtaagaaatggaaattatgatgaagctcttgacttagaagcatatgtatgcaaactttcaaccttgcaccccaagtgagtctatgttattttctccattgatgtctttttgactcagcttcttgaagcggttgctaagatactgttttcccccttcaaaggttacctattattcaagcactggctgcagaagttaagcagacaacccaatctcttctttctcaacttcttcagaaacttcgctctaatatccaggtattatgccatagttacattgaagatatatatttgatggaacctggttggaatcttatgtacttttgtcgatatatctgtgtattgtagttaccagaatgtctccgaattattggatatttacgtcgcattggagtatttagtgagtatgaaatgcgattacaggtaaagtttgccaaggatgttcttccgagttctgttttcttctcatagtatgctgtagacttttaatagataacaattttatatgcctgcatgtgacaaggaggattttgtatttcagtttttaagatgtcgagaggcttggcttactggaattcttgaggatttggaccagaaaaatgcttatgagtacttgaaagggatgataaactgtcacagaatgcatctttttgatgttgttaaccaatatagagcaatatttgctgatgatacttcaggaagtgaagaaaattatgatggcggccttctttttagttgggccatgcatcaaattactgcacaccttaaaactcttaaagtcatgctcccaaagataaccgagggtgtatctctgtcaaatattttggatcaatgcatggtgagaatgttacaatatgtatttgcttacattcatataattaccttttttacaagcatttgatggggatagttacatataatgataatagtattatccccatttaaagctttcccagacctatttcttatggcagccattaattcttttctataattccacacttcctaagtaatatcccttctgctttccttaaatgtgtatcaatgtaatctcaaggttttcctggtcagatgagcatgtttaaggattataggatatttttcaattacttgaggtgctgcccttacaatcacattttagttgctggagaatcagcaactcgactgttttctctctttctgtttatgggcatagtattcatgtcattcaactgtggtaataatatcaaaagtttctattgcacccggtacttgatgatgagctttatttatttatttatttttgagttattggcagtattgtgctatgggacttggttgggttggactggattttcggggcttgcttccaccactatttgaagagtaaagcaactttttcttaccttcccccccccccccccccctactctatctgtattcattttccattttttaaagcgtccacatcattaaataggtttgttggtttacagagcagtcctcaaattattttcgaagaatatgagtacggcagttgaaaattttcaggtacatgctcaattaatatattttgaattgatatactggtctaaaattctgtagttcaactctaaattgctactaagcacactaaggttttagtgttctatttgatgtagtgactttttgtctttactccagttagttttggattcacatcgatgggttccactaccagcagttggctatccagcccatagtgttggtgaagaaagtcaggaggatgtgactccaccatcttatctaatggaacatccacctctggcagtgtttattaatggtaagtttgacctacatttctcactgtccttgctataaatgtgctaaacttcctgttctcatccaaattttcctcccctcacatctctctctttccaccacctcaatctcctagtttatttgctatgaattctgatcacaaataacttcgaagctcagtagttcagatgatattttgtgttcagaagtcatatcaatctatatttgatatctgggctaaatttcaatgacatcgtgattgagtctattaattacctaagatggcttcagtctgaatcacttttgtttttgactcttaattgaaaacattttgatgacttgtttgaaggagaacaagtcaaattcctgcattagaaaagtaacaatgcatagatttaaaaagttgtatttttccataattactgattcaaattccttgaggttttcaactaaattcatagttgctgttaatcattaactttgttttgttaatatgatctataatgttttggaggattgcaagtctcttaggtatcacttacactgtggtcattgtaggtgtttctgcagcaatgaatgagttaaggccttgtgccccattgagtttgaagcatgtgcttgctgaagaattaatcaaaggattgcaggcagtttcagattctctactgaggtatagtactacccggatgcttagagaaaatgaatctggacttttcctttcgctttgccgagcattcatagaggtaaattctttaccaatgcttgatcattgatctgcaaattgtgttcataaccataaataacccccctcgcattgacgcattcttatgaaccctcctttcctttttaaggttgcttacccacactgtgccacatgctttgggcgttgctaccctggtggggctgcacttatcatggatgcaaagagtttatatgatggattgggccgcctatcgacacactcaccttcaagagaactcccaaaaccagtcaatgatgcagatggaaagaccataacagaaaacggtgacctccctgtggtggaaaatggagttaatcctgctgctgaagaaacagaaggtaccaatgtggacgaaaaggagcaacccctgcagactgaggaaaagccggaagagtg

SEQ ID NO: 9556 - DNA, 1990 bp, Arabidopsis thaliana
gcaggaaaacaaatcacagaaacattttgatgttaagtttttgaaaaaatcgcgagtttctggatctgtatactttcttagaggagattttgatagcatcgtttacaggagtaagatccgggaatggcaatggaggttggggagatgtctcagccggaggcgacggcgagtcttctctctctcgcttccgccactcagcaaccgtacgtctccgagctcctctctttcactcttgatcgtctccacaaggaaccggagctgcttcgagtggatgcggagcggattcagaggcaaatgcaagaggtggctgttggaaattaccgcgcgtttatcaccgctgctgatgctttgcttgcgatccgtcaggaagtttcttccattgataagcatctcgagtctctgattggcgaagtcccaaaactaacgtctggttgcactgaatttatcgattctgctgagaatattttggagaagaggaagatgaaccaagcattgctggcaaatcacagcactcttcttgacttgcttgagattcctcagcttatggacacatgcgtgaggaatggaaattttgatgaggctcttgacctggaagcatttgtatcgaaacttgctaccctgcatcccaaattgccagttatccaagcacttgcagcggaggttagacaaacaactcagtcacttctctcacagcttctccagaaactacgctcaaatatacagttaccagaatgtctccgcattattggatacttacgccgaataggtgtctttggcgagtatgaaatgcgattacagttcttaagatgccgagaggcatggctcactggaattcttgaggatttagatcagaaaaatgcctatgagtatttaaaaggcatgataaactgtcacagaatgcacctatttgacgtggttaaccaatatcgagctatattttctgatgatacatctgggagcgaagaaaattatgatggtggacttttgtttagctgggccatgcatcaaataacatcacacctgaagactctaaaaatcatgcttccaaagattactgaaggaggatctctatcaaatattttggatcagtgcatgtactgtgcgatggggcttggtggggttgggctagacttccggggtctgcttcctccactttttgaagaggcggttctaaacttattctccaagaacatgagtacagcagttgagaattttcagttagttttggattcacatcgatgggttccattaccatctgttggctttccttcaagtggtattaatgaagatagcaaggatgacgtcacacctccatcatacttgatggagcacccgccacttgcagttttcataaatggggtatcttctgctttgaacgaattacgtccttgtgccccgctaagtctaaagaatgttgttgctcatgaactgatcaaaggactccaggccgtgtctgactccttactaagatacaatacaactcggatgcttcgactcagtgaatccaatctattcctttcactttgccgagcttttgtcgaggtggtttttccacattgcgccacatgctttggccgatgttatccaggtggtgccacaatcgttatggatgccaagagtgcatacgaaggtctgggtcgcatcttagctgcatcgtcctctcaagaaccatccaacaaatctccaaaggtcatcagcacggacacaaaggatgcatcagagaatggtgtagcctcccaacctgaagaaaaacaagccgagaatccaaacgcgaaagaagaagataacagtcccattcctttgcagactcctgagataacacccgagtcttgagaaatttttcataaatttgtcttttgttgtaagaattatatgctaatacacacatagagagagagagacaacaaaagctttaaaattaagtgaagagtatcaatgcattatggtataaatttgatgggattatgtcgaattgagactgcatccaatt

SEQ ID NO: 9557 - DNA, 702 bp, Glycine soja
atggcttttgaagctctcaactcaccaacaacaaccgccccatctttccccttcgacgacccaactattccatgggccaaaagaaaacgttcaaagcgttgttcacgcgaccacccttcggaggaagagtacctcgctctctgcctcatcatgctcgctcgcggcggcaccacccgccgcgtcagcactccaccgccgcaaccgactccagatccttccaccaagctcagttacaaatgctccgtttgcaacaaaagcttcccctcttaccaagcgctcggtggacacaaggccagtcaccggaaactcgctgcctccggcggcgaagaccaacccaccaccacctcctccgccgccagctccgccaacaccgcctccggaggtaggacccacgagtgctccatctgccacaagtccttccccaccggacaggccctcggcggacacaaacgttgtcactacgaaggtaacagtaatggaaataacaacaacagtaacagctctgtcaccgccgcctcggaaggcgtggggtccacccacaccgtgagtcacggccaccaccgcgacttcgatctcaacatcccggcctttccggatttttcgaccaaggtcggagaagacgaggttgagagccctcaccctgtcatgaagaagcctcgcctcttcgtcattcccaagatcgaaatcccccaatttcaatga

SEQ ID NO: 9558 - DNA, 1010 bp, Glycine max
aaatcaacccaacccaacccaaaactcaagctaaattctcactctcacaacttcaatctctttctctctctctctctctctctctctctaccaaaaaaatggctttggaaactctcaactcaccaacaacaaccgccccatctttccccttcgacgacccaactattccatgggccaaaagaaaacgttcaaagcgttgttcacgcgaccacccttcggaggaagagtacctcgctctctgcctcatcatgctcgctcgcggcggcaccacccgccgcgtcagcactccaccgccgcaaccgactccagatccttccaccaagctcagttacaaatgctccgtttgcaacaaaagcttcccctcttaccaagcgctcggtggacacaaggccagtcaccggaaactcgctgcctccggcggcgaagaccaacccaccaccacctcctccgccgccagctccgccaacaccgcctccggaggtaggacccacgagtgctccatctgccacaagtccttccccaccggacaggccctcggcggacacaaacgttgtcactacgaaggtaacagtaatggaaataacaacaacagtaacagctctgtcaccgccgcctcggaaggcgtggggtccacccacaccgtgagtcacggccaccaccgagacttcgatctcaacatcccggcttttccggatttttcgaccaaggtcggagaagacgaggttgagagccctcaccctgtcatgaagaagcctcgccccttcgtcattcccaagatcgaaatccctcaatatcaatgaactctatgaattttttatttttatttttttcgattattttggagaattttgagatttactataatttgattttgtacatagtcctacctggaagttttgttgaaccgtacgtaccggacccagttctctgatttaggttgtactttcacagtgacagatttgcaattcaattcaatttctttatttaatttataaaattatttgatctaa

SEQ ID NO: 9559 - DNA, 996 bp, Glycine max
aaaattctcactctctctctcatctcgagatcatagtatcatattcaatatcatttcataccaaacacatggctttggaagctctcaactcaccaacaacaaccgctccatcttttccctttgacgacccaactattccatgggcgaaacgaaaacgttcaaagcgttctcgcgaccatccttctgaagaagagtacctcgccctctgcctcatcatgctcgctcgcggcggcaccaccaccgtcaacaaccgccacgtcagccctccgccgctacagccacagccacagccgacaccagatccttccaccaagctcagttacaaatgctccgtttgcgacaagagcttcccctcttaccaagcgctcggtggacacaaggccagtcaccggaaactcgccggcgccgccgaagaccaaccccccagcaccaccacttcctccgccgccgccaccagctccgcctccggaggtaaggcccatgagtgctccatttgccacaaatccttccccaccggacaggcccttggcggacacaaacgttgtcactacgaaggtaacggtaacggaaataacaacaacagtaacagcgttgtcaccgtcgcctcggaaggcgtgggctccacccacactgtcagtcacggccaccaccgcgacttcgatctcaacatcccggcctttccggatttttcgaccaaggtcggagaagacgaggttgagagccctcaccctgtcatgaagaagcctcgcctcttcgtcattcccaagatcgaaatcccccaatttcaatgaactcgttgaatttttagtttatttttcgactatatattttggagaattttgagagttactataatttgattttgtacatagtacttggaagttttgttggaccgtaccggacccagttctctggttgaggttgtactttcacaacagtggcagatttgcaattcaattcaatttatttgtttattttaaaaaaaaaaaaaaaaaa

SEQ ID NO: 9560 - DNA, 1011 bp, Glycine max
ggaaactcaaatcaacccaacccaacccaaaactcaagctaaattctcactctcacaacttcaatctctttctctctctctctctctctctctctaccaaaaaaatggctttggaaactctcaactcaccaacaacaaccgccccatctttccccttcgacgacccaactattccatgggccaaaagaaaacgttcaaggcgttgttcacgcgaccacccttcggaggaagagtacctcgctctctgcctcatcatgctcgctcgcggcggcaccacccgccgcgtcagcactccaccgccgcaaccgactccagatccttccaccaagctcagttacaaatgctccgtttgcaacaaaagcttcccctcttaccaagcgctcggtggacacaaggccagtcaccggaaactcgctgcctccggcggcgaagaccaacccaccaccacctcctccgccgccagctccgccaacaccgcctccggaggtaggacccacgagtgctccatctgccacaagtccttccccaccggacaggccctcggcggacacaaacgttgtcactacgaaggtaacagtaatggaaataacaacaacagtaacagctctgtcaccgccgcctcggaaggcgtggggtccacccacaccgtgagtcacggccaccaccgagacttcgatctcacatcccggcttttccggatttttcgaccaaggtcggagaagacgaggttgagagccctcaccctgtcatgaagaagcctcgccccttcgtcattcccaagatcgaaatccctcaatatcaatgaactctatgaattttttatttttatttttttcgattattttggagaattttgagatttactataatttgattttgtacatagtcctacctggaagttttgttgaaccgtacgtaccggacccagttctctgatttaggttgtactttcacagtgacagatttgcaattcaattcaatttctttatctaaaaaaaaaaaaaaaaaaaa

SEQ ID NO: 9561 - DNA, 1129 bp, Glycine max
ttccagagttggtgttagtcttggtgtagtgtagctagggagggatatatatctgagtaagatggcatcagagcttgaattgcccccaggcttcagattccatccaacggacgaggagctggtgttgcactatctctgccgcaaatgcgcgtcgcagccaatcgccgttcccatcatcgccgaaatcgacctctacaaatacgacccctgggacttacccggattggctacttatggagagaaagagtggtacttcttttcaccacgggaccggaaatacccaaacggttcgaggccgaaccgggcggctggcaccggttactggaaggcaaccggggcggataagcccattggtcagcccaaaccggttgggattaaaaaagctttggtgttttacgcagggaaagctcctaaaggggacaaaagcaattggatcatgcacgagtatcgtctcgcagacgtagatcgctccgttcgcaaaaagaacaccctaaggttggatgattgggtgctttgccgtatttacaacaagaagggcacgatcgagaaactgcaaccaagcagcgatgttgctcatagccgaaatatcgaatcctcggagatcgaagacaggaagccggagattctgaaaagcggaggaggttgtcttccgccgcctgcgccggtgcctgcgccgccgcaagcgacggcgaagacggattacatgtacttcgacccgtcggattcaatcccgaagctgcacacggactcgagctgttcggagcaggtggtatcgccgggattcgcgagcgaggtgcaaagcgagcccaagtggaacgagtgggagaaaagcctcgaatttccatttaattacgtggatgccactctcaacaacagcttcatggcccaattccagggcaataatcagatgttgtcgccgctgcaggacatgttcatgtactggcccaacaagtccttttgagcacatcatgatggttttaaattacgatccacaattgctcttaagattttctgactcaccatgcgaccacaatcgtaatttaaaaccatgtcacataaaatccacgcgcgccgcccattcgcatttgcacggtagcacgagactcaaggtccatgagtgtgcctgtaa

SEQ ID NO: 9562 - DNA, 1670 bp, Glycine max
gcggcacgtgtggcggtatcggctataaataaaggggtctctcttatgttctaagtttgaagcggcgccaccatagttggtgtagctagcgagggagggatatagggggaagcgtttattcattcattaagatggcatcggagcttcaattgcccccaggcttcagattccatccaacggaccaggagctggtgttgcactatctctgccgtaaatgcgcatcgcagcctatcgccgttcccatcatcgccgaaatcgacctctacaaatacgacccctgggacctacccggattggcttcctacggagagaaagagtggtacttcttttcaccacgggaccggaaatacccgaacggttccaggccgaaccgggcggcgggaaccggttactggaaggcaaccggggcggataagcccattggccaccccaaaccggttgggataaaaaaagctttggtgttttacgcagggaaagctccgaaaggggacaagagcaattggatcatgcacgagtatcgtctcgccgatgtagatcgctccgttcgcaaaaagaacagcctaaggttagatgattgggtgctttgccgtatttacaacaagaagggcacgatcgagaagttccaaccaagcagcgatgttgttgttagccgaaaaatggaatcatcggagatcgaagacaggaagccggagattctgaaaagcggaggaggttgtcttctgccgccggttccgccgccgcaagcgaaggcggcggtgaagaaggattacatgtacttcgacccgtcggattcaatcccgaagctgcacacggactcgagctgttcggagcacgtggtatcgccggaattcgcgagcgaggtgcagagcgagccaaagtggaaggagtgggagaaaagcctcgagtttccgtttaattacgtggatgccactctgaacaacagcaacagcttcacgacgcaattccagggcaataatcagatgatgtcgccgctgcaggacatgttcatgtactggcccaacaagcccttctgaacaaaccgatccacgccgcccattcgcatttgcacggtagcacgagactcaaggtctatgagtgtgcctgtgcgaccacacacagacgattatttatcaagttagcttagctagggcaaagaaagataaaaacattgaagctggaaacgcatgtgtttgttgggtccaccgtctgcaccggttctttttggtgttttgctatgtgacgacgacgacgacgatgacgatccaacggtgcatgtttgttgacctgtccctagtagtagtagcatgtgtacagctattgtatgtagaatgtagataggtacactactacacgttgttgtcatgtgatcatagaagctctcttaccgggaaaaataaaaattgatagaaggatggaaggtgtatttggaccttccctaattaatatttgttgaattattatcattagtatgtgttacatctaatttagtaggtgctcctttctcttgttttttaggtcctttttaatcgagtatcgtgatatcctactgtgtgtttacttttttattttctatctttagtttaatttattatgtaataatgtaattaatagtctaaaacaagtttagcttttttttttttacgtctttcaaatatactaatccactttcg

SEQ ID NO: 9563 - DNA, 2092 bp, Cicer arietinum
gaagtttcaaaagccgccaccgtagttctttctagtattctttgttcacggagaaagtatcgctagtttagattaattaattaattagaaatttagatcttatagtatacactatcacttaaaaaacatggcatcagagcttcaattgccgccaggcttcagattccatccaacggatgaggagctcgtcatgcactatctctgccgcaaatgcacttcgcaacccatctctgttcccatcatcgccgaaattgacctctataagtacgatccttgggatcttcctggtaattttatctaatctttttcctttcctattttttttcagtcatatataatttttaaattaatttatttttgactttattttatgaaaatttcttcatctaataattattgttattttataggcatggcttcttatggagaaaaggagtggtattttttctcgccacgagacaggaaatatccgaacggttcgaggccgaaccgggcggctggatccggatattggaaggcaaccggggcggataaacccataggtcacccgaaaccggttgggattaagaaagcgttggtgttttacgcggggaaagcgccaaaaggtgataaaacaaattggattatgcacgagtatcgtttggctgacgtggatcgctccattcgaagaaagaacagcttaagggtatacatacctaacttttgaatttttaaatttagatctagtttagcgatattagattaaattacgattttagcccttggaccagttttggtcaaaaacaaatgtggatacaattaatattgttgtctaccgtatgattagtctgagtcatataaatcagttgaatcatgatgattctatcatgtgagttgataggaaaatacttggatggaaatgtcgtttggacagataaacacaaaaatactcgttatttatttattttaaaaatatatattatatgagtcattttattaaattatttattttaagattttaaaaaattgtatatataataatcattgagaatagtagaaaataaaataattaaaattgtattaagaattataaatgatattatttgttttgttaaagggcttaaatacatgtgactgagaatgcaagaattcttcaacttgacaatagcatcaaggaaccttcactagttgatcactagatattttcatgtggtggctgatattcggatcctaaattttaacatcacattaaatcggacaatgaaatacttcacggttctagctaaattaacttattgaaataatattgaaattcatctgccaaccaccatcaattattacttttccacttatagaatttatttattatttatttattcgtacttatctctcgacctgcattttgttaggaaacatatttagacttttttattgtaaaatatttggactacttatccttaaaaaaaaggaaatgaaattgatccaacggttctgattttgcagctggatgactgggtgctttgtcgtatttacaataagaaaggcacaatcgagaaacaaccgaacagcggtgttataaacaggaaaacagacccctcggaaatcgaagacaagaagccagagattctgacacgtggaagcggtcttccgccacaccctccaccgcaagcgacggcgggaatgagggattacatgtatttcgacacatcagattcaatcccgaagctgcacacggactcgagctgttcagaacacgtggtgtcgccggagtttgcaagcgaggtgcaaagcgagcctaaatggaacgaatgggaaaagcaccttgaatttccttataattacgtggataccactctgaacagtggtttcgggtcccaattccagagcaataatcagatgtccccgttgcaggatatgttcatgtacttgccaaaaaccttttgagcatttgaaagatgaaactgaaatacatgtgacacccaatcaatcgctgtaacgcatcgcacggtagcacgagacgagagtccatgagtgtgcttgtgccaatgcgtacaatattatttgattaaatttcctaagcatgagtcgatagaaatttgagaagggaacattt

SEQ ID NO: 9564 - DNA, 1806 bp, Medicago truncatula
cacgtgtattctagaaaaaactagctactacaagcacgtgtcacctctattgttgcctataaatacacgtctctcccttatgtgataagtttcaagcgccgccaccgtagttcttcttagtattcttcatttcataaactagggagaaccatacatacaatatagattgattaaattcaaaaatcatcaaatcttattagcaagcaaattcagtttagcaattatagctgaaaaaacaatggcatccgagcttcaattgccaccgggcttcagattccatccaacggatgaggagctcgtgatgcactatctctgccgcaaatgcacgtcgcagcctatcgccgttccgatcatcgccgaaattgatctatataaatatgatccttgggacctcccaggtatggctacttatggagaaaaggagtggtactttttctcgccacgagacagaaaatacccaaacggttcaaggccgaaccgggcggctgggtctggatattggaaggcaactggggcggataaaccaataggtcatcctaaaccggttgggatcaaaaaagcgttggtgttttacgcgggtaaagcacctaaaggtgataaaaccaattggatcatgcacgagtatcgtttagctgatgtagatcgctccattcgaaaaaagaacagcttaaggttggatgattgggtgctttgccgtatttacaacaagaagggtacaattgagaaacaaccaagcaacagtgttgtcaaccgaaaaactgaacattctgaaattgaagacaggaagccggagattgtgacacgtgggggcggtcttccgccacatccaccgccgcaaactacggctggaattagggattacatgtattttgatacatcagattcgattcctaagctgcacaccgattcgagctgttcggaacaagtggtatcaccggagtttgcaagtgaggtgcagagtgagcctaagtggaacgagtgggacaagaatcttgagtttccttataattatattgatgccactctgaacactggttttggctcccaattccaaaatactaatccattgcaagatatgttcatgtacttgcccaaaaccttttgagcatttaaagataaagcacacttttgattggtcaggagtttgacaaaatcacgatatcatcttgattctgttaatcttgctatcaatccaacatgccgggtgccaccatgattctgtcaatcttatggtcaatccaaacatacacacagatgcattgcacggtagcacgagacgaatgtctatgagtgtgcctgtgcgagtgtgtgcatacaatattgttatggattaaattttcccaagtccaagccagagaaaattacaggaaagggaaagtttaagacaaaatgaagctgcaaatgcatgtgttggggctactattgtgcactgttttggtacgtccctatatgatctggatgaaccggtgcatatttcacctgtctctaggattagcatgtgcatatagttattgtaggatgtagatagggtacagagcatgttcatgtgatagaatgtcaattacgacattcttgattaatacatctcagtatgcattttctactctctataattagtagtaatggtcaagttaaagaaaatagcattagtaggactgcccctttcctctttttttttttttaggtcgtttattgcgacacttattatgttgtgtatttcttaatttcatatttgccttattactaccaggtttatgtttagctttttaataatactattatcttgctaaaaagagaaataaaaca

SEQ ID NO: 9565 - DNA, 1453 bp, Arachis hypogaea
gaagcgcagccgtagttcttcttagtctttcagagaggcgaaaagcttcttatctaccttcaccagatctcactaaagtatctcagttctttcaaaaatggcatcggagcttcaattgccgcctggatttcgattccatccaacagatgaagaactcgtgttgcactatctctgccgtaaatgcacttcacaaccgattgctgttccgatcattgccgagatcgacctttataaatatgatccctgggaccttcctggtatggcttcttatggtgagaaggagtggtattttttttcacctagagatagaaaatatccgaatgggtctagaccgaatcgggctgcaggaactggttactggaaggcaaccggagccgataagcctattggacaacccaaaccagttgggattaagaaagctttggtcttttactctggaaaggctcccaaaggagataagaccaattggattatgcacgaatatcgtcttgcagacgtagatcgttctgttcgcaaaaagaataagcctcaggctgggatgactgggtgctggtgtcgcatctacgataagaaaggatcagtcgagaagcaacaaccggaacagcggcgtccggtaccggtcgtgaaccagagggccgaatcttcggaagtcgaagacaagaagcccgatatagttccacgtggcggcggcgggggcgtacttccaccgcatcctcctacggctcaggcttcggcaggcggcgtgacgacagattatatgtacttcgacaactccgattcagttccgaagcttcacacggactcgagttgctcggagcaggtggtgtcgccggagtttgcgagcgaggttcagagcgagccaaagtggaacgagtgggataaaaacctcgaaagtgcgtataattacctcgatgccacactcacgaacggttttgggttcccgttccagggtaacaatcagatgtcgccgcttcaggatatgttcatgaaccttccgaaaccgttctgaacgcgctagtaatagtagaacaccagagaaagaatctttttatggaaaacctttgatatgcactatggtgcattccacggcagcacgagacgttaaggtccatgagtgtgcctgtgcgggtgcgagtccatggatgggtcaacgagatggaacagcaaggggagaatctgaagaagggaaaatgaaaaaaatgcatgcgttaggtgtgcagcattgtgcgcccattgatttgggtcgtgggattagaatatcgtttggggagtctgacggtggatgttgggtagtcgctaggttcgctaggttgggctgtgtatagtttattttgtacaatgtagagtgtaagaccggagggggtaaactatacggtggatggtggtgtatgtttccatctatttatgattagttaatataaatggttaattttattcaaaaaaaaaaaaaaaa

SEQ ID NO: 9566 - DNA, 1307 bp, Medicago sativa
gattcatggctacatgctgacagcctactgatgatcagtcgatggaaagaactcacttcaatatcatatccaatactaactaccctagcagccaccaaccaacactgaagaagaagaagaagaagaacaatagtacgtatagtatcaagaaattaattgaatatacgcgaatgcaaggagcattagaattaccacctggcttcagatttcacccgactgatgatgagcttgtcaatcactacttgtgtagaaagtgtgcttccctccctatagctgttcctattatcaaagaaattgatttgtataagtttgatccatggcatcttccagaaatggctctttacggtgagaaagagtggtattttttctctccaagggatcgaaaatatccaaacggttcaggccgaccggcggctgggtctggatattggaaggcaaccggggcggataaaccaataggtcaccctaaaccggttggaatcaagaaagctttggtgttttacgcgggtaaagcacctaaaggtgataaaaccaattggatcatgcacgggtatcgtttggctgatgtagatcgcaccattcgcaaaaagaacagcttaaggttggatgattgggtgctttgccgtatatacaacaagaagggtacaattgagaaacaaccaagcaacggtgttgtcaaccgaaaaacagaacattctgaaatggaagacaggaagccggatattgtgacacgtggaggtggtcttccaccacatcctcttccgcaaactacggctggaattagggattacatgtactttgacacatcagattcgattcctaagctgcacaccgattcgagctgttcggaacacgtggtgtcaccggagtttgcaagtgaggtgcagagtgagcctaagtggaacgagtgggaaaagaatcttgagtttccttataattatgttgatgccactctgaacactggttttggctcccaattccaaaatactaatccgttgcaagatatgttcatgtacttgcccaaaaccttttgagcattgaaagacaatgcacactattgattggtcgggagtttgacaaaatcacgatatcgtcttgattctgttaatcttactgtcaatcctacatgcgaggtgccactatgattctgtcaatcttatggtcaatccaaacatacacaacatcacacagatgcattgcacggtagcacgagacgaatgtctatgagtgtgcctgtgcgagtgtgtgcatacaatattgtcatggattaaattttcccaagtccaagccagagaaaatcgtcgacc

SEQ ID NO: 9567 - DNA, 876 bp, Corylus heterophylla
atgaccgcggagttacagttacctcctgggttcaggttccatccaacggacgacgagcttgtgatgcactacctgtgccgaaaatgtgcgtcgcagtcaatcgccgtgccgattattgccgaaatcgatctctacaaatacgatccctgggagcttccaagaatggccttgtacggagaaaaggagtggtacttcttttcgccgagggaccggaaatacccgaacggttcgaggccgaaccgagcggcggggacggggtactggaaggcgaccggagctgataagcctatcgggcatccgaaggcgatggggatcaagaaggcgttggtgttctatgccggaaaagcccccaaaggagagaaaactaactggatcatgcatgagtatcggctggccgatgtggatcgctcggctcgcaaaaagaacagcttaaggctggacgattgggttttgtgccgcatatacaacaagaagggcaccacggagaagcaacagcagggaatcaacctgcaaaaaatgagcgattcggaaatggaggacaagaagccggaaaatctgacaattggcggggccacgtctgcaatactttctggcccggcggcgacgcggacggcagctggggatgattacgtgtatttcgacacttcggattcagtgccgaggttgcacacggattcgagttgctcggagcacgtggtgtcgccggagttcacgtgcgaggtgcagagcgagcccaagtgctgggaaaagaccatagactaccactttaattacatggatgccaccctggacaatgggttcggcgcacagtttcagagcagtaatcagatgtcgccgttgcaggatatgttcatgtacatgcagaagcccttttaa

SEQ ID NO: 9568 - DNA, 1511 bp, Gossypium hirsutum
ataaaaagtttcaagagccgtcgaccgcgtagaataccaaagaagattgtagaaaaaaccacctagagcgagtgtgaaaaagctcaaaaactagtttattaccttcaaggtgaaaagttcaaaaaatgacagcatcggagttacagctaccacctggattccgattccatccaaccgacgaagagcttgtgatgcactatctttgccggaaatgtgcatcgcagtccatcgctgtgccgattatcgctgaaatcgatctttacaaatacgatccttgggaccttccagatttggcgttgtacggagaggaagaatggtattttttctccccgagggataggaaatatccgaacggttcacggcctaaccgggcagctggttctgggtactggaaggcaaccggagctgacaaaccgattgggcagccgaagccggtcgggattaagaaggctttggtgttttacgctgggaaggcacctaaaggagagaaaaccaattggattatgcacgagtatcggttagctgacgtggaccgatcggctcgcaagaagaacagtttaaggttggacgattgggtgctttgccggatttataacaagaaaggcgccatcgagaaacagtcaccgcaaggaagcattggcaaaagctctgccgtgacggagatcgaagacaagaagccggatatagcgacacttggcgtggacacgcgccagctgcccccgcctcctacggggctaggtaacgattacgtgtactttgacacgtcggagtcggtgccgagactccacacggactcaagctgttcggagcacgtggtgtcaccggagttcacgtgcgaggttcaaagcgagccgcaatggaaggactggggaagtgctaccaacaccaccaccaccaatgcccttgacttcccttataattacatggatgccactgttgataacgggtttcctgcccatttccagagtaataatcagctgtccccgctccaggacatgttcatgtacctgcagaagccattttagacggggaaaaaataaaataaaaaggggttatattgttggaagtcaaaacggtgatggtgaactgcgtttcagggttacacgagactgaaagtctatgagtgtaactgagaagggttgcgcatagattaaataacgaattgaaaaattgaaattgataatattgcagtaaggtagggggagctgttggatttttgcagatgggaatggatggacggtggaagttggatcttatgcaatctagaaaagtagagattagaataggcatgtgtacagataatctgtgatcacgtgtttaggggtttatgtacatgataaatgggtgtgggggaagaaaagttaaaaaaacaaagttttgggagggtctttttactttgaaggctttccacaaaattcttgtattttgtagcagaaaaaagattccataatttctttcaaaattcttagtaataatttatgttatttgagatatatatatttaattttttt

SEQ ID NO: 9569 - DNA, 1403 bp, Malus x domestica
agcttgcttcgcacggagggcgagtgaaataacgactgcgagatggagagagtgcaaacgacacccattgaaatgtcgtccgccgatttacagcttccaccggggttcaggttccacccgacggacgaggagctggtgagacactacctctgccggaaatgcgcgtcgcagccgatatcagttccgatcattgccgaaatcgatctctacaaatacgacccctgggagctcccaggcttggcgttgtacggggaaaaggagtggtatttcttttcgccaagggatcggaagtacccgaacggttcgaggccgaaccgggcggccggaagcggctactggaaggcgaccggggccgataagccgattgggcacccgaaacctgtggggattaagaaagctctggtgttctatgctggaaaagcccctcgcggcgaaaagaccaactggattatgcacgaataccgcctcgccgacgttgaccgctcgccgaggaagaagaacagcctcaggctggatgattgggttctgtgccgaatatacaacaagaaggggaccgtggagaaccagcagcctcagcagcagcaagaacaacagcgaacgactagtcgtaacgcgagcagtggctcggagttcgaggacaggaagccggataatctgaggtgcccgccgccgccggcttccgtggtccccagtcgtcacgtgagcgattacgtgtacttcgacaactctgactcggtgccgaagctgcacacggactcgagctgctcggagcaggtggtgtcgccggagttggcgtgcgaggtgcagagcgagcccaagtggaaggagtgggagaaggcgctggaaatgccgtacagttacatggatacgacggtggagaacgggttcggagcgcagttccagagcgggaatgagatgtcgccgctgcaggatatctttatgtacctgcagaagccgtactgatttggttaaagcatatttagagtcggtgcatgggacggcaacaggagacggaagtcgatgagagtgcgtttgtgcgtcgacggatctggaaaggggaaatgggaatgggaatgggattgggattgggaattcagttgtggagtcctgcattttggggtccaagagtgaattaggaggtttgagtactaaaatatgtacaagatgtgtatatataggttatatatatcgttcacatggtctaatatttgtttgtaattcagttcatggtggtagtagtgaataatatgtttttgtgtttctatcgtctacttaattagtgatattcctagttttttttttcattgaaagaattgtattattattaactcgaatactgtcgttggttaatttaatctcaaatttaaaaaaatctatcatttgacagcaccaaaaaaaaaaaa

SEQ ID NO: 9570 - DNA, 1106 bp, Glycine max
ctccatctctagtctttactcacagagtcactcaaatggcttccgaaaccccaaagccaaaacccgttctaccgtggaaaacccgcgtttcaatttcctttctctctaccctaacggactatgcacgccgttctaacggcaccgttaaccgccgtctcatgaacttcctcgatcgcaaatcccaacctaacgccaaacccgttaacggtgtttccacccaagacgtcaccgtcgacgccaaacggaacctctggttccgaatctttaaccccgcagccgcctccggcggcggcctccccgtcgttattttcttccacggcggcggcttcgcgttcctctcgccggattcgtttgcctacgacgccgtctgccggcggttctgccggcgagtccccgccgtcgtcgtctccgtcaactaccgcctcgcgccggagcaccggtaccctttgcaatacgacgacggtgaggacatcctcagattcctcgacgagaaccgcgcggtgctgccggaaaatgctgacgtatcaaaatgcttcctcgccggcgacagcgccggcgcgaatttggcacacaatgtggcggttcgggttgccaagtcgggtccgctccgggaagttcgggttgtggggttggtatcgatccaaccgtggtttggcggggaggcacggaccgcggcggaggtgaagttcgagggggcgccgctggtgtcaacggcaaggacggactggctgtggaaggcgtttttgccagacgggtcggaccgtgaccacggggcttcgaatgtgagcgggccgaattctgaggatttgtcgggtttgaattacccggatacccttgtgtttgtgggtgggtttgacccattgcaagattggcaaaagaagtattgtgagtggttgaagaaatcagggaaaaaggctcaattgattgagtattcaactatgattcatgcattttatatatttcctgaattgcccgagtcatctcagttgatctcagaggttaaggatttcatcaccaagagaatttccgatttaaaatcaaatatgtaataagttcatgttggagtcaagtgtaaggctatgcaagttcttgtttcaagtcttcta

SEQ ID NO: 9571 - DNA, 1063 bp, Glycine max
atggcttccgaaactccaaaagcaaaagccgttctaccatggacaacccgcgtttcaatttcctttctctctaccctaacggacttttcacgccgctctaacggcactgttaatcgccgtctcatgaacttcctcgatcgcaaaacccaagccaacgccaaacccgttaaaggcgtttccaccaaagacgtcaccgtcgacgccaaacggaacctctggttccgaatctacaaccccaccgccgccgatgccgacgacggcctccccgtcttcattttcttccacggcggcgccttcgcattcctctcgccggattctttcgcatacgacgccgtctgccgacgtttctgccggcgaatccccgccgtcgtcgtctccgtcaactaccgcctcgcaccggagcaccggtacccttcccaatacgacgacggcgaggatatcctcaggttcctcgacgagaaccgcgcggtgctgccggacaatgctgacttgtcgaaatgcttcctcgccggcgacagcgccggcgcgaatttggctcacaatgttgcggttcggatcggcaagtcggggctccagttgattcgggtcgtcgggttggtttcaatccagccgtggttcggcggggaggagcggacggctgcggaggttaagttggacggggcaccgctggtatcgatggcgaggacggactggctgtggaaggcgtttctgccggaggggtcggatcgcgatcatggggcggcgaatgtgagcgggccaaattcggaggatttgtcgggtttatattacccggatacccttttgtttgtgggtgggtttgacccgttacaagattggcaaaagaagtattatgagtggttgaaaaaatcagggaaaaatgctcaattgattgagtatccatcgtcgattcatgcgttttatatatttcctgaattgcccgagtcatctcagttgatctcacaggtcaaggatttcgtcaccaagaaaatttctgattttcaatcaaatgtatattaagttcatgttggagtcaagtgtgtatggctatgcaagttcttgtttc

SEQ ID NO: 9572 - DNA, 1096 bp, Medicago truncatula
atgtcatcaccaaacaaacccaaaccctttctctcttggaaatctcgcatttcaatttcatttataagcgctttatcagacgcatcacgtcgctctaacggcaccgttaaccgccgttttcttaatttcttagatcgcaaatcttcccctaacgccatccctgttaacggcgtttccaccaaagacgttatcgttaacgcagaagataacgtttggttccgtctcttcacacccaccgccgccgtcaactccgccggagaagataacaccgacaccaaaactgccacccttccggtgatcgttttcttccatggaggtggattcacctatctcacccctgattcatttgcttacgatgctgtttgccggagattctgccggaaaatcaatgctgttgtcgtctccgtcaactaccgtcacacaccggagcatcggtatccatcgcaatacgaagacggagaagctgttttgaaatatttggacgagaataaaacggttttaccggaaaatgctgacgtgtcaaaatgtttcctcgccggagacagtgccggtgcaaatttagcacatcatgttgcggttcgggtttgtaaagcggggctccgggaaatccgggttattgggttggtatccatccagccgttttttggaggggaggagaggacggaggcggagattaggctcgagggatcacccttagtgtcgatggcgaggacggattggatgtggaaagcgtttttaccggagggatcagaccgggatcatggcgcggttaatgtatgtgggccgaacgcggaggatttgtcgggtttggattatccggatacgcttgtttttattggtggatttgatcctttaaatgattggcaaaagaggtattatgattggttgaagaaatgtgggaaaaaagctgagttaattcaatatccaaatatgattcatgctttttatatttttcctgatttgcctgaatctggtcagttgattatgcaagtcaaggatttcatcagcaaagtgtccaattctagattatgatttttttagtaataatattgttatgattgttatattaataataataaattcatagctgtgtggt

SEQ ID NO: 9573 - DNA, 1707 bp, Medicago truncatula
atgtccataagttggataaccatgaggggcattctttctttaaagagggcagtgttggttcgacaacatagcgaaaagttgggtcttggtgttagattatttagcactcagggtgcctcaactgcaagtactccgcagcctccaccaccacctccacctccagagaaaacccattttggtggacttaaggatgaggacaggatttttaccaacttgtatgggctgcatgatcctttcctgaaaggtgccatgaaacgtggtgattggcatcgcactaaagatttggtaattaagggtactgattggatcgttaatgaaatgaagaagtctggtctccgcggacgtggtggtgccggttttccttctggccttaaatggtcatttatgccaaaagtatctgatggtcgtccttcttaccttgttgttaatgctgatgaaagtgaacctggcacctgcaaagacagggaaatcatgcgccacgacccacataagttgttagaaggttgcttaattgctggagtgggaatgagggctactgctgcttacatctacatcaggggtgaatatgtgaatgaacgtttaaatcttgaaaaggctaggaaagaggcttatgcagctggtcttttgggtaagaatgcttgtggctcaggctatgattttgatgttcatatccactatggtgctggagcttatatttgtggtgaggaaacagctctcttggagagccttgaagggaaacaaggtaaaccaagattgaagcctcctttcccagccaatgcaggattgtatggttgtcccaccactgtcacaaatgtggaaaccgtagctgtctctccaaccattttaaggcgtgggccagaatggtttgccagttttggtaggaagaacaacgctgggacaaagttgtattgtgtgtcaggacatgtgaacaagccttgcactgttgaggaggaaatgagtatgccactgaaggaattgattgagaggcactgtggaggtgttagaggaggatgggacaatttgcttgctattattccaggaggatcatctgttccactgattccaaaacatgtatgtgatgatgttctgatggattatgatgcgttgaaggctgttgggtcagggttggggactgcagctgtgattgtgatggataagtctactgatgttgtggatgccattgcaaggctctcgtacttctacaagcatgaaagctgtgggcagtgcacaccatgcagggagggaacaggatggctttggatgatcatggaaagaatgaaagttggtaatgccaagctagaagaaattgatatgcttcaggaggtgactaagcaaattgaagggcacacaatctgtgccttgggtgacgctgctgcatggccagtgcagggacttatcaggcatttcaggcccgagcttgagagaaggattaaagagaatgcacagagggagttgctgcaggccactggggttgtgactgtactgatgatagctaaaatcaaaataaagcagtgccagtcattttggaaagataggtggctcaggttcctttggctttattgctacttcgttttacttttatgccatagcaattatggctggataataccagagaatcatctgggccggtataaactatgctacctagacttgtcatttggcacattttcatgtgatttgttaataatatctgtatactgtcattaa

SEQ ID NO: 9574 - DNA, 1857 bp, Glycine max
caagagaaggcaacctgagagtaataacggaagcaacccacaaaagcagcacaagaacactcatcagatcccagtgatcaattcaatttgcgttcatcactggtaaggcaaacatgaggggcattctttccgtaaggacagccttggttcaacatcatagtgagaaattgggccttggtttcagagtatttagcactcagggtgcttccactgctagtaccccacagccgccaccaccacctcctccgccggagaaaacccattttggcggccttaaggatgaggacaggatatttactaacttatatgggctgcatgatccttttctcaaaggtgccatgaaacgtggggattggcatcgaacgaaagatttggtagttaagggtactgattggattgtgaatgaaatgaagaagtctggcctccgtgggcgtggtggtgctggtttcccttcgggtctcaaatggtcattcatgccaaaagtatctgacggccgcccttcatatcttgttgttaatgctgatgaaagtgaacctggaacttgcaaagacagggaaatcatgcggcatgacccgcataaattgttggaaggttgcttgattgctggagtgggaatgagggctagtgccgcttacatctacatcaggggtgaatatgtcaatgaacgtaagaatctcgaaaaggctagggaagaggcttatgctgctggtttgttgggtaagaatgcttgtggctcaggctatgattttgatgttcatatccactacggtgctggagcttatatttgtggtgaggaaacagccctcttggagagccttgaagggaaacaaggtaaaccaagattgaagccgcctttcccagccaatgctgggttgtatggatgtcctaccactgtcacaaatgtggaaactgtggctgtgtctccaaccattctaaggcgtggacctgaatggtttgccagttttggtaggaagaacaatgctgggacaaagttgttttgtgtgtcagggcatgtgaacaagccttgcactgttgaggaggaaatgagtattccactgaaggaattgatagagaggcactgtggaggtattcgaggaggatgggataatctacttgcagtgattccaggaggatcatccgttcctctgattccaaagcatgtatgtgatgatatcttgatggattatgatgcattgaaggctgttgggacagggttggggactgcagctgtaattgtgatggataaatctacggatgttgtggatgctattgcaaggctttcctatttctacaagcatgaaagctgtgggcagtgcaccccatgcagagaggggactggttggctttggacgatcatggaaagaatgaaagttgggaatgccaagttagaagaaattgatatgcttcaggagttgactaaacaaattgaagggcatacaatttgtgccttgggtgatgctgctgcatggccagtgcagggtcttatcaagcatttcaggcctgagcttgagagaaggattagagagcatgcagaaagggagcttctgcaggccactggctaggcgtttactaaggggtgtgactgtactggtggatagcaagagtcagaataagacagtgccagtcattttggaatgataggtggctcaggttactgcagctttatcgctacttctgttttcttttatgctgcagcaattatggctggaccatacctgggaaaccatttgggcgagtttaaactgtgtacccacattttcgtgtaatttgttaataatatctgtatactgttattaattttgaaaaacaattcatgattatatgcatgttatcaagtgaatgatgagggatgatgtc

SEQ ID NO: 9575 - DNA, 2080 bp, Glycine max
aacacaaagcagcacaagaaggtgttccattttcaacactcatcagatcccagtaaggcaaccatgaggggcattctttctgtaaggacagccttggttcaacatcgtagtgagaaattgggccttggtttcaggctatttagcactcagggtgcttccactgctagtaccccacagccgccgccaccacctccaccaccagagaaaacccattttggtggccttaaggatgaggacaggatatttactaacttatatgggctgcatgatccttttctcaaaggtgccatgaaacgaggggattggcatcgaacgaaagatttggtacttaagggtactgattggattgtgagtgaaatgaagaagtctggcctccgtgggcgtggcggtgctggtttcccttcgggcctcaaatggtcattcatgccaaaagtatccgatggccgcccttcatatcttgttgttaatgctgatgaaagtgaacctggaacttgcaaagacagggaaattatgcggcatgacccacataaattgttagaaggttgcttgattgctggagtaggaatgagggctagtgctgcttacatctacatcaggggtgaatatgtgaacgaacgtaagaatctcgaaaaggctaggcaagaggcttatgcagctggtttgttgggtaagaatgcttgtggatcaggctatgattttgatgttcatatccactacggtgctggagcttatatttgtggtgaggaaacagccctcttggagagtcttgaagggaaacaaggtaaaccaagattgaagccgcccttcccagccaatgctgggttgtatggatgtcctaccactgtcacaaatgtggaaactgttgctgtttctccaaccattctaaggcgtgggcctgaatggtttgccagttttggtaggaagaacaatgctgggacaaagttgttttgtgtgtcggggcatgtgaacaagccttgcactgttgaggaggaaatgagtattccactgaaggagttgatagagaggcactgtggaggtattcgaggaggatgggataatttacttgcagtgattccgggaggatcatctgttcctctgattccaaagcatgtatgtgatgatatctttatggattatgatgcattaaaggctgttgggacagggttggggactgcagctgtaattgtaatggataaatctacggatgttgtggatgctattgcaaggctttcctacttctacaagcacgaaagttgtgggcagtgcacaccatgcagggagggaactggttggctttggacaatcatggaaagaatgaaagttgggaatgccaagctagaagaaattgatatgcttcaggagttgactaaacaaattgaagggcatacaatttgtgccttgggtgatgctgctgcatggccagtgcagggtcttatcaagcatttcaggcctgagcttgagagaaggattagagaacatgcagaaagggagctgctgcaggccactggttaggctttcactaaggggtgtgattgtactgctggatagcaagagtgagaataagacagtgccagtcattttggaaagataggtggctcaggttactgtagctttattgctacttctattttcttttatgctgtagcaattatggctggatcatacctgggaaaccatttgggcgagtttaaactgtacctgcttgtcatttggcacattttcatgtaatttgttaataatatctgtatactgttattagttttgaaacacaattcatgattatgcatgttatcagtgaatatgatgagggatgatgtccactggataacctaacttatttgtgattgagttattcatttggaataactttttagaagaacatgttattgttcaacaacgtcctcaacttgcttgtatgaagtctgttgatccatgcatggactaaaacatgtccatacatgattttcagctagttataatcctggtaccaaggtcgtttgcatatttcttttgccatgcaagagacatatttgcctttcaaggaattttcttgagtgtttccaattccactagtattttc

SEQ ID NO: 9576 - DNA, 1827 bp, Solanum tuberosum
cagcttcaatctcaccctaatctgctggagaatcagctgaatttcaccgattcatcacatttctgcttcaatattcatggcacctataaagggccttctttctctgcaacggactgcattagctcaacgttctagtgaaagatggggcctatatggtaggttatttagcactcaggctgcatcaactgctagcactccccaacctacacccccacccccacctcccgagaggactcactttggtggccttaaagatgaggatcgtattttcacaaatctctacggattgcatgacccttacctcaaaggtgccatgaagcgaggagattggtacagaacaaaagatcttgtcatcaagggttctgactggatcgtgaatgaaatgaagaaatctggtcttcgaggacgtggtggtgctggttttccatctggtctcaaatggtccttcatgccaaagacaacagatggccgtccttcatatcttgtcgtcaatgctgatgaaagtgaacctggaacctgtaaagacagggaaatcatgcggcatgacccacacaagttgttggaaggctgtctgattgcaggagtggggatgagggctaaagctgcttatatttatatcaggggagagtatgtgaatgaaaggaagagccttcagaaggctagacaagaagcctatgaagctggattgttggggaaaaatgcttgtggatctggttatgattttgacgtatatattcattttggtgctggtgcctatatttgtggtgaagagacagctcttctggagagccttgagggcaaacaaggcaaaccaagattgaagcctccatttccagctaatgcaggactatatggatgtccaacaactgtcacaaatgttgaaacagtagctgtttcaccaaccatcttaaggcgtgggccggagtggtttgctagttttggccggaagaataatgccgggacaaagctgttttgcatctcaggccatgttaacaagccctgcacagttgaagaggaaatgagtatttcattgaaggagctgatagagaggcactgtggtggtgttcgtggaggatgggacaatttgcttgctgttataccaggaggttcatctgttccattgcttcccaagaacatatgtgaggatgtacttatggattttgatgcactcaaagctgtgcagtcagggttggggactgctgctgtaattgtcatggacaagtcaactgatgttgtagatgcaattgcaaggctctcgtacttctataagcacgagagctgtggtcaatgtacaccatgtagggaaggcacagggtggctttggatgatcatggaaagaatgaaggttggcaatgcaaagttggaagagattgacatgctccaagaggtgacaaaacagattgaagggcataccatttgtgccttgggtgacgctgctgcttggccagtgcagggtcttattaggcactttagaccagagctagaaaggaggatcagggagcacgcagagagagagctacaacaggcggctgctgcttgatttttttaaaagtttgctgtttgataccatggaataaattttgagaagtaccagaagtatgaatgtgggaggggaaagcaggacgcagagcttccctatatccagcctctttttattgtcaaacttgtgtaaaactattgttacattgttggcccaatgggtaatttatgtttcagagctggtacatctaatgtcttaatgtttccttacattatcattgtcatggctttgatagttgaaagatgctttaatatttgtcatgttgaataagagctacactttggcaa

SEQ ID NO: 9577 - DNA, 1864 bp, Zea mays
attgttagggaagaggtgctcctctctctctatctcctccacgctctccgttccttcccctccccgacctccccaatccgaccagaccggcaggcaccttcgactcgagcggagcaggcgaggcagagatggcgatgcgacgggcgctcctcagatcggtcgacttctcccccgacagcaaggctgcagttgagtacttttattctttctcaagggcacagtctgcttgttctctcaatggtgctggtctttgtcctgctagtagatcatttagcacccaggctgccactacgtcaagcacaccacagcctccacctccaccaccccctccagagaagactcactttggtggcctcaaagatgaggatcgcattttcaccaacctctatggtctgcatgacccttttctgaaaggcgcggtgaagagaggtgactggtataggaccaaggatttggtgattaagggggcagactggatagttaatgaaatgaagaaatcaggtcttcggggtcgtggaggtgcaggttttccctctggtctgaaatggtcctttatgcccaaggtttctgatggacgcccttcttatcttgttgttaatgctgatgagagtgagcctggaacttgcaaagatagagaaatcatgcgccatgacccccacaagcttctggaaggatgccttattgctggagttggaatgagggcatcagctgcttacatctacattcgaggtgaatacgtgaatgagcgtctcaacctcgagaaagctcggcaggaagcatatgcagctggacttctcggtaagaatgcttgtggatctggttatgattttgatgtgcatattcattttggtgctggtgcgtacatctgtggtgaagagactgccctattagagagccttgaagggaagcagggcaaacctaggctgaagccacctttcccagccaatgctgggctttacggctgccccacaactgtgaccaatgttgaaactgtggctgtatccccaacaattcttaggcgtggtccagaatggttcgcaagctttgggcgcaagaacaactccggaaccaaactctactgcatctcaggtcatgtgaacaagccttgcaccgtggaagaggaaatgagcatacctctgaaggagttgctcgagaggcactgtggaggtgtgagaggaggatgggacaacctgcttgcagtaattcccggcggttcatccgttccccttttaccaaagcacatatgtgacgatgtgttgatggactacgacgcgctgaaggctgtgcagtctggattgggtaccgcagctgtcatcgtgatggacaaatctacggacgttgtcgacgcgattgccaggctgtcctacttctacaaacacgagagctgtgggcagtgcacgccctgccgagagggcacgccctggctctggatgatcatggagaggctcaaggttggtgacgcgaagctagaggaaatcgacatgcttcaggaggtcacgaagcaaatcgaagggcatactatctgtgccctcggggacgctgcggcgtggcctgttcagggacttatcaggcacttcaggccggagttggagaagaggatccgcgagcgagctgaaagggagctgttggcggcttctgcctgatgtgccagccgcatgtactagttttctgatttctttctaccgaaataatacaaactgatggagctcctttctgtgtaagcaaatgctagccttcctgatttctttgaaccgtttatgtggatgtttatttgatgcactcaagcatctgacggattttgatggactaggtacaccttttcatagtagaaacaaacttgagggttgaaaaaaaaaaaaaaaaa

SEQ ID NO: 9578 - DNA, 1960 bp, Brachypodium distachyon
gtccacgagggcagaacaggtaggagacacaaacgaaaatgctgcgccgcgccgcccaccgcctcgcctcccgcgccgccgccacgggcggcgctggctccgtcgcccgcaggaccctggccgcggcggaggtgcccgtgcaggcgcccgcggactccgcgttcgtgggaatcgccgccaacaaggaggttgagcatttgaattatctatcaaggccacagcctactcgttctatcacatgtgccagactgtatcctgctggcagatcattcagcacccaggctgctagtacatcaagcacaccacagcctccaccaccaccaccacctccagagaagactcactttggtgatcttaaagatgaagatcgcatttttaccaacctctatggtctgcatgatccttttctgaaaggtgcaatgaagaggggtgactggtatagaaccaaggacttagtgattaaaggggcggattggatagtgaatgaaatgaagaaatcaggtttgcgaggccgtggaggcgcaggttttccttcaggcctcaaatggtccttcatgcccaaggtctctgatggacgcccatcttatcttgttgttaatgctgatgagagtgagccaggaacttgtaaagacagggaaatcatgcgccatgacccccacaagcttctggaagggtgcctgattgctggagttggaatgagggcatcagccgcttacatatatattagaggtgaatatgtgaatgagcgtctcaaccttgagaaagcccgactggaagcatatgcatctggacttcttggtaagaatgcttgtggatctggttatgattttgatgtgcatatacattttggtgctggtgcctacatctgcggtgaagagactgccctactcgagagccttgaaggcaagcagggaaaaccaagactgaagccgcctttccctgccaatgctgggctgtatggttgccccacaactgtcacgaatgttgaaactgttgctgtagctccaacaattcttaggcgtggcccagaatggtttgcaagttttggacgtaagaacaactcagggacaaaactgtactgtatctcaggccatgtcaacaaaccttgcaccgtggaggaggaaatgagcatacctctgaaggaattgatcgagaagcattgtggaggtgtaagaggaggatgggacaacctgcttgcagttattcctggtggttcatctgttcccctgttaccaaagcacatatgtgatgatgtgttgatggactatgacgccctaaaggctgtccaatctggattagggactgcagcagttatggtgatggacaaatccacggatgttgttgatgcaatcgctagactgtcatacttctacaagcatgagagctgtgggcagtgcacaccttgccgtgaaggcacaggatggctttggatgatcatggagaggctcaaggtaggcaatgccaagctagaggagatcgatatgcttcaggaggtcacaaagcagattgaagggcatacgatctgtgcccttggggatgctgcagcatggcctgtgcagggtcttatcaggcacttcaggcctgagctggaaaggaggatccgcgaccgagctgatagggagctgctgacagcagcttctgcataagcaccattgcacacctgttctagtttcctgatttctttcacagaaataatccaaactgatggagctcatttctgtacaacgagatgcagcatcctgatttgtttaaacctttatgtggatgtttatttgatgcgctgaagcagctggtgtattttgatggacaagcgacacttttgaagtagaaacaaatatgaaggtttgtaccctgtatgttacataagcctgcttgtttctgatgaatgttaagtaagattgtctcctaagttctccagaatctgagtaaatttgttgaaaatatactaccatgtttggcc

SEQ ID NO: 9579 - DNA, 1915 bp, Hordeum vulgare subsp. vulgare
gggagctcgccccgcttctcctccccacaacacaacagtctctccctgttttttttcttccaaatccgacggactcgaggccaaccggaggcggagatggcgttgcggtgggcgctgttcagatcggccgagatctctcccggtcgcaaggctgcatttgagtacttgcattctctatcaagggcacagcctactcgttctccctcgtgtgccgacctgtatcctgctggcagatcattcagcacccaggctgctactacatcaagcacaccacagcctccaccaccacccccacctccagagaagactcactttggtgaccttaaagatgaagatcgcattttcaccaacctctatggtcttcatgatccttttctgaaaggtgcgatgaagagaggtgactggaatagaaccaaggatttagtgattaaaggggcagactggatagtgaatgaaatgaaaaaatcaggtctgcgagggcgcggaggtgcaggttttccttctggcctcaaatggtccttcatgcccaaagtctctgatggacgtccttcttatcttgttgttaatgctgatgagagtgaaccaggaacttgtaaagacagggaaatcatgcgtcatgacccccacaagcttctggaagggtgccttattgctggagttggaatgagggcatcagctgcttacatctacatcagaggtgaatatgtgaatgagcgtctgaaccttgagaaagctcggcaggaagcatatgcatcaggacttcttggtaagaacgcttgcgggtcaggctatgatttcgatgtgcatatacattttggtgctggtgcgtacatttgtggtgaagagactgccctactggagagccttgaaggcaagcagggtaaaccaaggctgaaaccacctttccctgccaatgctgggctgtatggctgccccacaactgtcacaaatgttgaaactgttgctgtgtctccaacaattcttaggcgtggcccagaatggtttgcgagttttggacgcaagaataactcgggaacaaaactgtactgtatctcaggtcatgtgaacaaaccttgtactgttgaggaggaaatgagtatacctctgaaggaattaatcgagaagcactgcggaggtgtgagaggaggatgggacaacctgcttgcagttatccctggcggttcgtctgttcctcttttgccaaagcacatatgtgatgacgtgttgatggactatgatgcactaaaggctgtacagtccggattaggcactgcagcagttatggtgatggacaaatccacagatgtagttgatgcgattgctagactgtcatacttctacaagcatgagagctgtgggcagtgcacgccttgccgtgagggtacaggatggctctggatgatcatggagaggctcaaagtgggtaatgcgaagctggaagagattgatatgcttcaggaggtcacgaagcagattgaaggccacacgatctgtgccctcggggatgctgcagcatggcctgtgcagggtcttatcaggcacttcagacctgagttggagaggaggatccgcgatcgtgctgatagggagctgctgatggcagcttctgcataagcaccacttcttgtttgctgattttattcacagaaataatgcaaactggtgaagctcatttctgcacatgcagatgtagcttaccttattggttgaaccttttatgtcgatgtttatttgatgcactgatgaagccagtgtactttgatggcgaagtggaaacgaatatgaaggattgtaccttgcatgttacatgaagctgtttttcttctttaatgttataaataatgacttgcttctaaatcctcataatctgagcgaactctgaaattatgttggcatcgatggctaatgtttgctt

SEQ ID NO: 9580 - DNA, 1923 bp, Arabidopsis thaliana
agcttatctcgagttcgtcggtctcaggtgggcagtgattataacttcgtctccgtgtctgttcaagctcccattcttgtggccttcacgcttcaggaacaaagaccagtatctctctgaaagactacttctcggaaattttcgtctccatggcacccgtgagggggattcttggcttgcaaagggcagtgtccatttggaaggaaagtaacagactgactccagctttgagatcattcagcactcaagctgcatccacttccaccactccacagcctcctccacctcctccgcctccggaaaagactcatttcggtggtctcaaggatgaagatcggatttttactaatctctatggtctgcatgacccatttctcaaaggcgcgatgaagagaggtgattggcataggaccaaagatttggtgctcaagggtactgattggattgtcaatgaaatgaagaaatctggacttcgtggacgtggtggtgctggtttcccttctggtcttaagtggtcctttatgcctaaagtttctgatggccgtccctcctatttggttgtcaatgctgatgagagtgagcctggaacttgtaaagatagggagatcatgcgtcatgaccctcacaaattgttggaagggtgtttgattgctggtgttggaatgagagctagtgctgcgtatatttacatcaggggtgaatatgtgaatgagcgtttgaatctagagaaggctagaagagaagcgtatgcagctggtctcttggggaagaatgcatgtggttctggttatgattttgaagtttatatccactttggtgctggtgcgtacatttgtggtgaagagactgcgcttcttgaaagccttgaagggaagcaaggaaaacctaggttgaagcctccgttccctgctaatgctggtttatatggttgtcccacaactgttaccaatgtggaaacagtggctgtttcgcctaccattttaaggcgtggacctgagtggttttctagtttcggtaggaagaataacgctgggacaaagctcttttgtatatcaggccatgtaaacaagccatgcacggtggaagaggagatgagtatacctctcaaggaactgattgagaggcattgtggaggtgttaggggtggatgggacaatctacttgctatcatccctggtggttcatctgttcctctgatccctaagaacatttgcgaggatgtgctgatggatttcgatgcgctcaaggctgtccaatcagggttaggaactgcagcagtcattgtgatggataaatcaaccgatgttgtggatgcaattgcaaggctctcttacttctacaagcatgaaagctgtgggcagtgcactccttgcagagagggaacaggttggctttggatgatcatggagagaatgaaagttggcaatgcaaagctggaagagattgatatgctgcaggaggtaaccaaacagatcgaaggacacacaatctgtgcattgggtgatgcagctgcatggcctgtgcaaggtctgataagacactttaggccagagctcgagagaaggatcagggaacgcgctgaaagggagttgctacaggctgctgcttaagtaccttgttaaccagagggagtttgctattattctccatggaaataaaatctgaatgaacaactagtaacggttttgggatgcaaagctacttcagaaggagaagaaggtaatgtaatttgtttgaatggttaatgttaaaactctcttaaagttgtatcagaaagagcgcgatttgctcttttgcattactctactttctttattgtttgcttgttatgtttattcgagtatgaaagcacattttgggaacaaccaaagaaacccttttcatgtttgaaataaagaatgctcctttttgggtttataagta

SEQ ID NO: 9581 - DNA, 1917 bp, Medicago truncatula
ctcattccattccattccattcaattccatggcttcttcaacatctctgttccaatcttcacctttctctctcaacaccaaaaccaaaccctattcttctcttcccaaatcaccaaaacccactcatttcatcatcaaatctcaacaacaaccgcaccccgttactcaaaacaacacccccattcctactcccacacccactcctcccaccacccgtcgtcccgccgatgaaaacatccgcgacgaagcccgtcgcaaaaacgtctcccaacatctcttctccgccaaatacgtccctttcaacgccgatccatcttccaccgaatcctactctctcgacgagatcgtctaccgttctcaatccggcgatcttctcgacgtgcagcacgacctaaccgccttgaagaaattcgacggcgcttattggcgtaacctcttcgattcacgcgtcggtaaaactacatggccttatgggtctggtgtttggagcaaaaaggaatgggttttgcctgagatcgatgatgatgatattgttagtgcttttgaaggtaattctaatcttttttgggctgaacgttttggcaaacagtttctaggcatgagtgatttgtgggttaagcattgtggtattagtcatactggtagttttaaggatctgggtatgactgtgcttgttagtcaagttaaccgcttgcgaaaaatgaaccgtccagttgttggtgttggttgtgcttcgactggggatacttcggctgctttgtcggcttattgtgcatcggcagggataccttcgattgttttcctgcctgctaataggatttcaattgctcagttggttcaaccgattgcaaatggtgcttttgttcttagcattgatactgattttgatgggtgtatgcagttgataagagaggtgactgctgaattgccgatttatttggcgaattcgcttaatagtttgaggcttgaaggacagaaaacagctgccattgagattttgcagcagtttgattggcaggtgccggattgggttattgtgccgggtgggaatcttgggaatatttatgctttttataaagggtttcatatgtgtagagagttgggtcttgtggataggattccaaggcttgtttgtgctcaggctgccaatgcgaatccgttgtatttgtattttaagtcggggtggaaagagtttaaggcagtgagggcacaaactacttttgcatctgctatacagatcggtgatccggtttctattgatagagctgttcatgctttgaagaactgcaatgggattgttgaggaagctactgaggaggaattgatggatgctatggctcaagctgattcgacggggatgtttacttgtcctcacactggtgttgctttgactgctttgtttaaactcaggaatagtggggttattaagcctactgataggactgtggtggtgagtactgctcatggtttgaagtttactcagtctaaaattgattaccattcaaagggtatcaaggatttggcttgccaatttgccaatcctccaacgcaagtcaaggctgattttgggtctgttatggatgttttgtccaagtatttgcagagcaaggctccaaagtatcattaggttagcacgtagcactgctggttttgctcctttgtccttgctgcttgtttactttttaggcattgtgttgtcttttgtattagcttttccttctttatgatgatttacttgcattctgtatgcatgctgctctctaatattgagaaagcttgctggatttgttgtagattatctttgttgagcattttgtagctcccttagaaattaattggataagatgaggaatgttcatcattggctttgttactgcattattaatatattatagatcaatgcccccacccccggat

SEQ ID NO: 9582 - DNA, 2096 bp, Glycine max
atggcttcctcatctctttttcagtctctccctttctctctcaaaaccactaaaccctacgcgcttcccaaacccgccgccaatttcgtaatccgcgcccaatcccccctcactcagaacaccaacgccgcctcctccgcctccaagcatcgccgccccgccgacgagaacatccgcgacgaggcccgccgcatcaatgctccccacgaccaccacctcttctcggccaaatacgtccctttcaatgccgacccttcctcctccacgacggagtcctactcgctcgacgagatcgtctaccgctcccaatccggtggcctcctcgacgtccagcacgacatggacgccctcaagcgcttcgacggcgagtactggcgcaacctcttcgactctcgcgtcggcaagaccacctggccctacggctccggcgtctggagcaaaaaagagtgggtcctccctgagatccacgacgacgacatcgtctccgccttcgaaggaaactccaacctcttctgggccgagcgtttcggcaaacagttcctcggcatgaacgatttgtgggtcaaacactgcggaatcagccacaccggcagcttcaaggatctcggcatgaccgtcctcgttagccaggtcaaccgcttgagaaaaatgaatcgccccgtcgtcggtgtcggttgcgcctccaccggtgacacctccgccgctttatctgcttattgcgcttcggcggcgattccttccattgtgtttctgcctgctaataaaatctcgcttgctcaacttgttcagcctattgccaatggtgcctttgtgttgagtatcgacactgattttgatggttgcatgcagttgatcagagaggtcactgctgagttgcctatttatttggctaactctctcaacagtttgagattggaagggcagaaaactgctgctattgagattctgcagcagtttgattggcaggttcctgattgggtcattgtgcctggtggcaaccttggcaacatttatgccttttacaaaggcttcaagatgtgtcaagagcttggtcttgtggataagattccaaggcttgtttgtgcccaggctgccaatgctgatcctttgtatttgtactttaaatccggctggaaggagtttaagcctgtgaagtcaagcactacctttgcctctgccattcaaattggtgatcctgtttccatcgacagggcggttcacgccctaaagagttgcgatgggatcgtggaggaggccaccgaggaggagttgatggatgctacggcgcaggcagattccactgggatgtttatctgcccccacactggggttgctttgactgctttgtttaagctcaggaacagtgggcttattaaggccactgataggactgtggtggttagcactgctcatggcctcaagttcactcagtccaagatcgattaccattctaaggacatcaaggacatggcttgccgctatgctaaccctcccatgcaagtcaaggctgattttgggtcggttatggatgttttgaagacgtatttgcagagtaagactcattaggttagcattgcaactttttctcctctcttcctgagtttgctgctgattatttacttactattattagccacttctactcctgttttgtcttttctataagctaggtttgagtattgtagtaatttgcctgctgcattatgtatgctgtgctccatattggggcatcttagtatttgttgtagattttctttgttgagcatttaatataatagctcaagtagaaaaaaattaattggatacaatgagggaggaatgcacattgttggcttgttattactggattccagaccagaccacgccatccccaaaagaaaataattccaaaaaatataattagaacagatttctttcactttcatgttatgctgttggcattaagctaagtgtgggtattaccaagcaactctatgcaatctgtgacaagtaattaaatcaagaaataaaaaattacagcgaaggagcggcattgttggactgagtcacattgctatgtagtcatatttcgttgaattaagtgaaggcagaactac

SEQ ID NO: 9583 - DNA, 2412 bp, Glycine max
aggctttcggttttccacatcgtagatctggagtgagtcgcggcggcggctggcaagtagtagtattaaaaaagttgatgggataattggcattggttgagtttggttcaaattgagaaaatcattactccattaaccattcattcaccaatcctccatggcttcctcttctctgtttcagtctctccctttctctctccaaacctctaaaccctacgcgcctcccaaacccgccgcccacttcgttgtccgcgcccaatcccccctcactcagaacaacaactcctcctccaagcatcgccgccccgccgacgagaacatccgcgacgaggcccgccgcatcaatgcgccccacgaccaccacctcttctcggccaagtacgtccccttcaacgccgactcctcctcctcctcctccacggagtcctactcgctcgacgagatcgtctaccgctcccaatccggcggcctcctggacgtccagcacgacatggatgccctcaagcgtttcgacggcgagtactggcgcaacctcttcgactcgcgcgtgggcaaaaccacctggccttacggctccggcgtctggagcaaaaaagaatgggtcctccccgagatccacgacgacgatatcgtctccgccttcgagggtaactccaacctcttctgggccgagcgtttcggcaaacagttcctcggcatgaacgatttgtgggtcaaacactgcggaatcagccacaccggcagcttcaaggatctcggcatgaccgtcctcgtcagccaggtcaatcgcttgagaaaaatgaaccgccccgtcgtcggtgttggttgcgcctccaccggtgacacatcggccgctttatccgcctattgcgcttccgctgccattccttccattgtgtttttgcctgctaataaaatctctcttgcccaacttgttcagcctattgccaatggagcctttgtgttgagtatcgacactgattttgatggttgcatgcagttgatcagagaggtcactgctgagttgcctatttatttggctaactctctcaacagtttgaggttggaagggcagaagactgctgctattgagattctgcagcagtttgattggcaggttcctgattgggtcattgtgcctggaggcaaccttggcaacatttatgccttttacaaagggtttaagatgtgtcaagagcttgggcttgtggataagattccaaggcttgtttgtgctcaggctgccaatgctgatcctttgtatttgtactttaaatccgggtggaaggagtttaagcctgtgaagtcgagcactacatttgcctctgccattcaaattggtgatcctgtttccattgacagggcggttcacgcgctaaagagttgcgatgggattgtggaggaggccacggaggaggagttgatggatgctacagcgcaggcggattctactgggatgtttatttgcccccacaccggggttgctttaactgcattgtttaagctcaggaacagcggggttattaaggccactgataggactgtggtggttagcactgctcatggcttgaagttcactcagtccaagattgattaccattctaaggacatcaaggacatggcttgccgctatgctaacccgcccatgcaagtgaaggcagactttggctcggttatggatgttttgaagacgtatttgcagagtaaggctcattaggttagcattgcaagttttgctcctcctgagtttgctcattatttacttacttttaggcactactgctgtattgtcttttctatgagctaggtttgagtgttgtaataatttgcttgctgcattatgtatgccgtctagtgttccatattggggcatccttagtatttgttgtagattttctttgctgagcatttgatataatagctcaagtaggaaaatgaattgggtactatgaggaatgcatatcattggcttgttattactggattccagaccaccccaaaagaaaataattccaaaaaatataattagaacaaatttcgtccttgttatgctgttggcattaagctcagtgtgggtattaccaagcaactcgaaatcaagagaaaaaaaaattgacagcaaaggagctgcattgttggactgagtcacatcacttcattgctatgtcgtcatatttcgttgaattacgggaaggcagcatgcacagcaatatgcagcgattaactgaagccacaccgcacacattgaagtagtagtcaatttagacactccatcttgtactttctacaaaaatgaatttttcttagccattaagtataatattttattctatggaacttgcgtataaacaggccatcaactgtatcgggttatatacacgaatggagttgaatgaaatatagtgtgctgaa

SEQ ID NO: 9584 - DNA, 1857 bp, Vitis vinifera
acctaagagccaaggcttgcaagccatctccatacacctttcgctacaatggtctcctctactgtcttccaatcgccgcgtttctctttctcctccgccaccaaatccaccgccaaacccatcaccaccaccaccgccgccgtccattttcccatcagagcctgctcatccaccgaggcggctggctctatcaaaacccaccaccgccgccccgcggatgagaacatccgcgacgaggcccgccgccagtcctctggaaaccaccatggcttctctgctgtttacgtccccttcaatgctgatccctcctccacggagtcctactccctcgacgagatcgtctaccgctcgcgctccggcggcctcctcgacgtcagccatgatctcgacgctctcaagaagtacgatggccagtactggcgctccctgttcgactcccgcgtaggaaaaaccacctggccctatggctccggcgtctggtccaagaaggagtgggtacttcccgagatcgacagcgacgacatcgtcagcgccttcgaaggtaactccaacctattctgggccgaacgtttcggtaaacagtttctgggtatgaacgacttgtgggtaaaacactgtggcattagccataccggaagtttcaaggatctgggcatgaccgttttggtcagccaagttaaccgattgcgaaaaatgaaccgccctgttgtaggcgtcggttgtgcctcgacgggggacacctccgctgctctctccgcctactgcgcggcggcggggattccctcgattgtgttcctacccgctaatcggatttcgattgcgcagctggtgcagccgattgcgaatggggcgtttgtgttaagccttgacactgattttgatgggtgtatgcagttgatcagggaggtcactgctgaattgccgatttacttagcaaattcgttgaatagtttgaggcttgaggggcagaagacggctgcaatcgagattttgcagcagtttgattgggaagtgccggattgggtgatagttcctggtggaaatcttggtaacatttacgccttttacaaagggtttcacatgtgcaaagaattgggacttgttgataggattcctaggcttgtttgtgctcaggctgcaaatgccaatcccctttatctccattacaagtcaggttggggagagtttaaaccagtgaaggccaacactacttttgcctctgccattcagattggagatcctgtttctatagatagggctgtttatgcgcttaagaactcagatgggattgtggaggaagccactgaggaggagttgatggatgccacggctaaagctgattccactggcatgttcatatgtcctcatactggggttgcattgactgcattgtttaagcttagggagagtggggtaataaggcctacagataggactgtggtggttagcacggctcatggtctcaagtttacgcagtccaagattgattatcactcgaaagacattccagacattgcttgccggttcgctaacccaccagtgcaagtgaaggctgattttgggtcagttatggatgtcttgaagaagtacttgttaagtagggaccctaggtgttagaccccaaataagcattataagttgggcttgtgtactcttctaattatttggactagtgcttggtagcgttgtttcgttgtatttgctttgttatgggatgccttcttgtagaactaggagccgttttggtatgtcgtattcgagaagaagaaaccatttgtaaggctgcattgcccctcttggatacaattatgattatctgaatttaatgagagttctctcaatgagcttttggcatct

SEQ ID NO: 9585 - DNA, 1840 bp, Arabidopsis thaliana
aaaatcctcagccgcatctcacttctcattctctagaaaaaatggcttcgtcttgtctcttcaatgcctctgtatcgtccttaaaccctaaacaagaccccatccgccgccaccggtcaacctctctcctccgccaccgccccgtcgtcatctcctgtaccgccgatggcaacaacatcaaagccccgatcgagacagcggtcaagcctcctcaccgtaccgaggataacattcgagatgaggctcgtcgtaatcgttccaacgccgtgaatccattttcagctaaatacgttccgtttaatgcagctcctggatccacggagtcttactctctcgacgagatcgtgtaccgtagccgctccggtggtttgcttgatgtcgaacacgatatggaggctttgaagcgattcgatggcgcgtattggcgtgatctcttcgattcgcgtgttggtaaaagcacatggccttatggatcgggtgtttggtcgaagaaagagtgggttcttcctgagatcgatgacgacgacatcgtttcagcttttgaaggaaactcgaatctgttctgggcagagagatttggtaagcagtttctaggtatgaatgatctgtgggtgaaacactgtgggattagtcatacaggaagtttcaaggatcttggaatgactgttttggttagtcaagttaatcgtctgagaaagatgaaacgacctgtggttggtgtcggatgtgcttccaccggagatacttctgctgctctatctgcttactgcgcctccgctggaatcccatcgattgtgtttttaccggcgaacaagatctctatggctcagctggttcagccgatagctaatggtgcgtttgttttgagtattgacactgattttgatgggtgtatgaagctgattagagagataactgcggaattgccgatttatttggcgaattcgttgaatagtttgaggttagaagggcagaaaactgcagctattgagattttgcagcagtttgattggcaagttcctgattgggtgattgttcctggaggtaacctaggaaacatctatgccttttacaaagggtttaagatgtgtcaagaactgggacttgtcgataggatcccgaggatggtctgtgcacaagcagctaatgctaatcctctttacttgcactacaagtctggttggaaggacttcaagcccatgactgcaagtaccactttcgcctctgcgattcagatcggtgaccctgtctccatcgatagagctgtgtacgctctcaagaagtgcaatggtattgtagaagaagccacagaggaggagctgatggatgcgatggctcaagcggattcgacaggaatgtttatctgtcctcatacaggtgttgctctaactgctctgttcaagctgaggaatcaaggagtgattgcaccgactgatcgaactgtggtagtgagtactgctcatgggttgaagtttactcagtctaagatagattatcactccaatgccatccctgacatggcttgcagattctccaatcctcctgttgatgtgaaagcagatttcggagctgtcatggatgttctcaagagttacttaggaagtaatacacttacgtcataagagacaagaccataatctttagctgttttgttttttgaaaacttttagacgtttgtttgcgttactcttcaactcatctctctgtgatctttatctgtttctcagttttccaataaagttctatcgcaaagtttgaatcattttatcttctttgttttttgtgtaagcgataaatctaaagactccggtcaaaatcaacctgttgcagattatattgt

SEQ ID NO: 9586 - DNA, 1717 bp, Arabidopsis thaliana
ctttcgtcttgtctcttcaatgcctctgtatcgtccttaaaccctaaacaagaccccatccgccgccaccggtcaacctctctcctccgccaccgccccgtcgtcatctcctgtaccgccgatggcaacaacatcaaagccccgatcgagacagcggtcaagcctcctcaccgtaccgaggataacattcgagatgaggctcgtcgtaatcgttccaacgccgtgaatccattttcagctaaatacgttccgtttaatgcagctcctggatccacggagtcttactctctcgacgagatcgtgtaccgtagccgctccggtggtttgcttgatgtcgaacacgatatggaggctttgaagcgattcgatggcgcgtattggcgtgatctcttcgattcgcgtgttggtaaaagcacatggccttatggatcgggtgtttggtcgaagaaagagtgggttcttcctgagatcgatgacgacgacatcgtttcagcttttgaaggaaactcgaatctgttctgggcagagagatttggtaagcagtttctaggtatgaatgatctgtgggtgaaacactgtgggattagtcatacaggaagtttcaaggatcttggaatgactgttttggttagtcaagttaatcgtctgagaaagatgaaacgacctgtggttggtgtcggatgtgcttccaccggagatacttctgctgctctatctgcttactgcgcctccgctggaatcccatcgattgtgtttttaccggcgaacaagatctctatggctcagctggttcagccgatagctaatggtgcgtttgttttgagtattgacactgattttgatgggtgtatgaagctgattagagagataactgcggaattgccgatttatttggcgaattcgttgaatagtttgaggttagaagggcagaaaactgcagctattgagattttgcagcagtttgattggcaagttcctgattgggtgattgttcctggaggtaacctaggaaacatctatgccttttacaaagggtttaagatgtgtcaagaactgggacttgtcgataggatcccgaggatggtctgtgcacaagcagctaatgctaatcctctttacttgcactacaagtctggttggaaggacttcaagcccatgactgcaagtaccactttcgcctctgcgattcagatcggtgaccctgtctccatcgatagagctgtgtacgctctcaagaagtgcaatggtattgtagaagaagccacagaggaggagctgatggatgcgatggctcaagcggattcgacaggaatgtttatctgtcctcatacaggtgttgctctaactgctctgttcaagctgaggaatcaaggagtgattgcaccgactgatcgaactgtggtagtgagtactgctcatgggttgaagtttactcagtctaagatagattatcactccaatgccatccctgacatggcttgcagattctccaatcctcctgttgatgtgaaagcagatttcggagctgtcatggatgttctcaagagttacttaggaagtaatacacttacgtcataagagacaagaccataatctttagctgttttgttttttgaaaacttttagacgtttgtttgcgttactcttcaactcatctctctgtgatctttatctgtttctcagttttccaataaagttctatcgcaaagtttgaatc

SEQ ID NO: 9587 - DNA, 2235 bp, Glycine max
gtgtactttttttgttgtcgagtgaatggtgctatcggctattcactagatcttgattagctttaagaatcaagcaaaaccgaatcacgagcttctcagtacaaaatcgtatggccacgaaaacacttaattgggcctcagcccagcccaaaatatttttataattgttgaatatagaacagaaaaactaggagaaattcgaatttcgaaagtgcctcgcgaaacaaatgaatgaggatccgtaacctggtggcacccacccttcaatttcaaacacaatcgacagtaaccggtaacctccgacgaaggctctccccccccggcgtcgacttcgccgcctatggctcggccctccagcactgctccgaccaccgcctcctccgccagggcaagcagctccacgctcgcctcatcctactctccgttacacccgataacttcctcgcctcgaaactcatcctcttctactccaaatccaaccacgcgcacttcgcgcgtaaggtgttcgacacgaccccccacagaaacaccttcacgtggaacgccatgctcctcggctactccttcaacagcatgttccgccacgcgctcaacctcttcgggtcgttcactttctccacaacccccaacgcctcccccgataacttcaccatatcctgcgtcttgaaagccttagcttcgtctttttgtagccccgaattggcgaaagaggttcactgtttaatccttcgacgcgggttgtactctgatattttcgttctcaacgcgttgatcacgtgctactgcaggtgcgacgaggtttggcttgcgcggcacgtgttcgacggaatgtccgagagagatatcgtaacgtggaacgcgatgattggtgggtattctcagaggaggttatatgatgagtgtaagaggttgtacttggagatgttgaatgtttccgcggttgcacccaatgtggttacggcggtgagcgtgatgcaggcgtgtggacagtccatggaccttgcgtttggaatggagcttcaccgtttcgtgaaggagagtggaattgagattgatgtttcgctctccaatgctgtggttgctatgtatgccaagtgtggtaggttggattatgcgcgggagatgtttgagggaatgcgtgagaaggacgaggttacttatggggcaattatttcggggtacatggattatgggcttgttgatgatgccatgggtgtttttcgaggggtggagaaccctggattgaatatgtggaatgctgtgatttctggtatggttcagaataagcagtttgaaggggtttttgatttggtacggcaaatgcagggttctggtttgagtcccaatgctgtcacacttgctagcattcttccttcgttttcgtacttctcaaacctgcgaggagggaaagaggtgcatggttatgctatcaggagaggttatgagcaaaatgtatatgtgtcaacttctattattgatgcttatggaaagttggggtgtatttgtggggcacggtgggtttttgatctatcacagagtaggagcttgataatttggacatcaattatatctgcttatgctgctcatggtgatgctggtttggcacttggtctctatgctcagatgctagataagggaattcgacctgacccggtgacattaacttctgtattgacagcttgtgctcactctggattggttgatgaagcttggaatatcttcaattcgatgccctcaaaatatggcattcaacctttggtggagcactatgcttgcatggtgggtgttcttagtcgagctggtaagctctcagaagcagtgcaattcatttctgaaatgccaattgaaccaagtgctaaagtttggggtcctctactacacggggcttctgtttttggtgatgttgaaatcggcaagtttgcttgtgatcatttgtttgagattgagcctgaaaatactgggaattacatcattatggccaatttatatgcacatgcagggaaatgggaacaagctggtgaggttagggaaagaatgaaagtaattgggttacaaaagatccgtggaagtagctggattgaaacgagtggagggctactgagtttcattgccaaggatgtgtcaaatggaagatctgatgagatttatgcattgctggaagggttgcttggtttgatgagggaagaaggatgtgtattacaggaagagttagattatgagaatgtttttagttaa

SEQ ID NO: 9588 - DNA, 3243 bp, Glycine max; identical to SEQ ID NO: 9524

SEQ ID NO: 9589 - DNA, 2228 bp, Glycine max; identical to SEQ ID NO: 9553
  misc_feature (1356)..(1356): n is a, c, g, or t

SEQ ID NO: 9590 - DNA, 2001 bp, Medicago truncatula; identical to SEQ ID NO: 9551

SEQ ID NO: 9591 - protein, 517 aa, Glycine max
MKREREQLGSIAGTSSCGYSSGKSNLWEEEGGMDELLAVVGYKVRSSDMAEVAQKLERLEEAMGNVQDDLPEISNDVVHYNPSDISNWLETMLSNFDPLPSEEPEKDSASSDYDLKAIPGKAIYGASDALPNPKRVKADESRRAVVVVDSQENGIRLVHSLMACAEAVENNNLAVAEALVKQIGFLAVSQVGAMRKVAIYFAEALARRIYRVFPLQHSLSDSLQIHFYETCPYLKFAHFTANQVILEAFQGKNRVHVIDFGINQGMQWPALMQALAVRTGGPPVFRLTGIGPPAADNSDHLQEVGWKLAQLAEEINVQFEYRGFVANSLADLDASMLDLREGEAVAVNSVFEFHKLLARPGAVEKVLSVVRQIRPEIVTVVEQEANHNRLSFVDRFTESLHYYSTLFDSLEGSPVNPNDKAMSEVYLGKQICNVVACEGMDRVERHETLNQWRNRFVSTGFSSVHLGSNAYKQASMLLALFAGGDGYRVEENNGCLMLGWHTRPLIATSAWQLAATR

SEQ ID NO: 9592 - protein, 523 aa, Glycine max
MKRERQQLGSNAGTSSCGYSSGKSNLWEEEGGMDELLAVVGYKVRSSDMAEVAQKLERLEEAMGNVQDDLTDLSNDAVHYNPSDISNWLQTMLSNFDPLPSEEPEKDSASSDYDLKAIPGKAIYGGGSDALPNPKRVRTDESTRAVVVVDLQENGIRLVHSLMACAEAVENNNLAVAEALVKQIGFLALSQVGAMRKVATYFAEALARRIYRVFPQQHSLSDSLQIHFYETCPYLKFAHFTANQAILEAFQGKNRVHVIDFGINQGMQWPALMQALALRNDGPPVFRLTGIGPPAADNSDHLQEVGWKLAQLAERIHVQFEYRGFVANSLADLDASMLDLREDESVAVNSVFEFHKLLARPGAVEKVLSVVRQIRPEILTVVEQEANHNGLSFVDRFTESLHYYSTLFDSLEGSPVNPNDKAMSEVYLGKQICNVVACEGMDRVERHETLNQWRNRFGSTGFSPVHLGSNAYKQASMLLSLFGGGDGYRVEENNGCLMLGWHTRPLIATSVWQLATKSVVAAH

SEQ ID NO: 9593 - protein, 523 aa, Glycine max
MKRERQQLGSNAGTSSCGYSSGKSNLWEEEGGMDELLAVVGYKVRSSDMAEVAQKLERLEEAMGNVQDDLTDLSNDAVHYNPSDISNWLQTMLSNFDPLPSEEPEKDSASSDYDLKAIPGKAIYGGGSDALPNPKRVRTDESTRAVVVVDLQENGIRLVHSLMACAEAVENNNLAVAEALVKQIGFLALSQVGAMRKVATYFAEALARRIYRVFPQQHSLSDSLQIHFYETCPYLKFAHFTANQAILEAFQGKNRVHVIDFGINQGMQWPALMQALALRNDGPPVFRLTGIGPPAADNSDHLQEVGWKLAQLAERIHVQFEYRGFVANSLADLDASMLDLREDESVAVNSVFEFHKLLARPGAVEKVLSVVRQIRPEILTVVEQEANHNGLSFVDRFTESLHYYSTLFDSLEGSPVNPNDKAMSEVYLGKQICNVVACEGMDRVERHETLNQWRNRFGSTGFSPVHLGSNAYKQASMLLSLFGGGDGYRVEENNGCLMLGWPPRPLIATSVWQLATKSVVAAH

SEQ ID NO: 9594 - protein, 516 aa, Phaseolus vulgaris
MKRGRQNLASTAGTSSSGYSTGKSNLWEDEGGMDELLAVVGYKVRSSDMAEVAQKLERLEEAMGNVQDGLKELSDDAVHYNPSDISNWLQTMLSNFDSLTPEEPDKGYDLKAIPGKAIYDGGVGTAPNPKRLKSAESTQAFVVVDSQENGIRLVHSLMACAEAVENNNLAVAEALVKQIGFLAVSQVGSMRKVATYFAEALARRIYRVFPLQQSLSDSLQIHFYACPYIKFAHFTANQAILEAFQGKSRVHVIDFGINQGMQWPALLQALALRPGGPPAFRLTGIGPPAADNSDHLQEVGWKLAQLAEMINVRFEYRGFVANSLADLDASMLDLRDDEPVAVNSVFEFHKLLARPGAIEKVLSVVRQIRPEILTVVEQESNHNGLSFRDRFTESLHYYSTLFDSLEGSPVNPQDKAMSEVYLGKQICNVVACEGTDRVERHETLNQWRSRFSSTGFSPVHLGSNAFKQASMLLALFAGGDGYRVEENSGCLMLGWHTRALIATSAWQLAEKPVVAV

SEQ ID NO: 9595 - protein, 532 aa, Pisum sativum
MKREHNQEHEDASMTGKSEICWEDDGGMDELLAVVGYKVKSSDMAEVAQKLEQLEQAMGNFQDQDEATIAQHLSNDTVHYNPADISNWLQTMLSNFDSQPNPSVSSSSDNDLNAIPGKAIYANTDSQTEESLPSRKRVKRVGSSSSTESTRPVVMVVETQEKGIILVHTLMACAEAVEQNNRPVAEALVKQIGNLAVSQEGAMRKVATYFAIGLARRIYDVFPQHSVSDSLQIHFYETCPYLKFAHFTANQAILEAFQGKSRVHVIDFSINQGMQWPALMQALALRPGGPPAFRLTGIGPPASDNSDHLQQVGWRLAQFAQTIHVQFEYRGFVANSLADLDASMLELRSPETESVAVNSVFELHKLNARPGALEKVFSVIRQIRPEIVTVVEQEANHNGPAFLDRFTESLHYYSTLFDSLESSLVEPQDKAMSEVYLGKQICNVVACEGTDRVERHETLNQWRNRFGSAGFSPVHLGSNAFKQASMLLALFAGGDGYKVEENDGCLMLGWHTRPLIATSAWKLAANSMVVSH

SEQ ID NO: 9596 - protein, 600 aa, Populus trichocarpa
MKREHPNLHPQQISDPSTLAAAGYSTSTSAMAPHNGKAKIWEEGEGHQADGGMDELLAVLGYKVRSSDMAEVAQKLEQLEEVMGHAQEDGLSHLASDSVHYNPSDLSTWLESMISELNPNLNFDPSADSLLAPAESSTITSIDFSDHKHHQQQKLFEESSSSDYDLKVIPGKAVFSQTQIDSRESKRLKTDLYQTSSSSSLSSATTLGSFGISTESTRPVVLVDSQENGIRLVHLLMACAEAVQESNFTLAEALVKQIGFLAVSQAGVMRKVATYFAEALARRIYKLCPQNSTDHSLSDILQIHFYETCPYLKFAHFTANQAILEAFEGKKRVHVIDFSMNQGMQWPALMQALALRPGGPPAFRLTGIGPPAHDNTDHLQEVGWKLAQLAETIHVEFEYRGFVANSLADLDASMLELRPTESVAVNSVFELHKLLSRPGAIEKVLSVVKQMKPEIVTVVEQEANHNGPIFLDRFTESLHYYSTLFDSLEGSVSTQDKIMSEVYLGKQICNVVACEGPDRVERHETLTQWRTRLGSVGFAPVHLGSNAFKQASMLLALFAGGDGYRVEENNGCLMLGWHTRPLIATSAWRLNTNQPVVGAA

SEQ ID NO: 9597 - protein, 590 aa, Vitis vinifera
MKREYHHPHHPTCSTSPTGKGKMWDADPQQDAGMDELLAVLGYNVKASDMAEVAQKLEQLEEVIVNAQEDGLSHLASETVHYNPSDLSNWLGSMLSEFNPTPNCALDNPFLPPISPLDYTNCSTQPKQEPSIFDSPSLDYDLKAIPGKALYSHIEQPPQQPPAPPLYQRDNKRLKPTTSATANSVSSVIGGWGVPTESARPVVLVDSQETGIRLVHTLMACAEAVQQENLKLAEALVKQIGFLAVSQAGAMRKVATYFAEGLARRIYRLYPDKPLDSSFSDILQMHFYETCPYLKFAHFTANQAILEAFEGKKRVHVIDFSMKQGMQWPALMQALALRPGGPPSFRLTGIGPPSTDNTDHLHEVGWKLAQLAETIHVEFEYRGFVANSLADLDASMLELRDGESVAVNSVFELHSLLARPGGIERVLSAVKDMKPDIVTIVEQEANHNGPVFLDRFTESLHYYSTLFDSLEGCGVSPVNTQDKLMSEVYLGQQICNVVACEGPERVERHETLAQWRARLGSAGFDPVNLGSNAFKQASMLLALFAGGDGYRVEENNGCLMLGWHTRPLIATSAWQLANKPALPSSTPASN

SEQ ID NO: 9598 - protein, 569 aa, Brassica oleracea var. italica
MKRDLHQFQGPPDTRFPNHETANTGSSSKDKMMKVKEEEDGGNMDELLAVLGYKVRSSEMAEVALKLEQLETMMGNVQEDGLSNLATDTVHYNPSELYSWLDNMLTEFNPPPPEINNSFLAGAGGSDYDLKAIPGNAIYARSNQFAIDSSSSSNQAGDNSQSTKRLKSCSSPDSLVTGTTVTTTTIESTRSMVLVDSQENGVRLVHALMACAEAIQNNDLSIAEALVKQIGFLAVSQAGAMRKVATYFAEALARRIYRLSPPQTQIDHSLSDTLQMHFYETCPYLKFAHFTANQAILEAFEGKKRVHVIDFSMNQGLQWPALMQALALREGGPPVFRLTGIGPPAADNSDHLHEVGCKLAQLAEAIHVEFEYRGFVANSLADLDASMLELRPSEIEAVAVNSVFELHKLLGRTGGIEKVLGVVKQIKPVIFTVVEQESNHNGPVFLDRFTESLHYYSTLFDSLEGVPSSQDKVMSEVYLGKQICNLVACEGPDRVERHETLSQWANRFGTSGFAPAHLGSNAFKQASMLLALFNGGEGYSVEENNGCLMLGWHTRPLITTSAWKLLAAH

SEQ ID NO: 9599 - protein, 590 aa, Vitis vinifera
MKREYHHPHHPTCSTSPTGKGKMWDADPQQDAGMDELLAVLGYNVKASDMAEVAQELEQLEEVIVNAQEDGLSHLASETVHYNPSDLSNWLGSMLSEFNPTPNCALDNPFLPPISPLDYTNCSTQPKQEPSIFDSPSLDYDLKAIPGKALYSHIEQPPQQPPAPPLYQRDNKRSKPTASATANSVSSVIGGWGVPTESARPVVLVDSQETGIRLVHTLMACAEAVQQENLKLAEALVKQIGFLAVSQAGAMRKVATYFAEGLARRIYRLYPDKPLDSSFSDILQMHFYETCPYLKFAHFTANQAILEAFEGKKRVHVIDFSMKQGMQWPALMQALALRPGGPPSFRLTGIGPPSTDNTDHLHEVGWKLAQLAETIHVEFEYRGFVANSLADLDASMLELRDGESVAVNSVFELHSLLARPGGIERVLSAVKDMKPDIVTIVEQEANHNGPVFLDRFTESLHYYSTLFDSLEGCGVSPVNTQDKLMSEVYLGQQICNVVACEGPERVERHETLAQWRARLGSAGFDPVNLGSNAFKQASMLLALFAGGDGYRVEENNGCLMLGWHTRPLIATSAWQLANKPALPSSTPASN

SEQ ID NO: 9600 - protein, 575 aa, Medicago truncatula
MESVKTNSKYSSILIAIFVLSSFALALANPKTHEHEFVVEATPVKRLCKTHNTITVNGQYPGPTLEINNGDTLVVKVTNKARYNVTIHWHGVRQMRTGWADGPEFVTQCPIRPGGSYTYRFTVNGQEGTLWWHAHSSWLRATVYGALIIRPREGEPYPFPKPNHETSILLGEWWDGNPIDVVRQAQRTGAAPNISDAYTINGQPGDLYKCSTKGTTIIPIHSGETNLVRVINAALNQPLFFTIANHKLTVVGADASYVKPFTTNILMLGPGQTTDVLIHANQPPSKYYIAARAYQSAQNAPFDNTTTTAILQYHNSIKTKPIMPPLPSYNNTNIVTKFSRSFFSLRKAEVPTEIDENLFFTIGLGLNNCPKNFRKRRCQGPINGTRFTASMNNVSFTLPNNISILQAHYHGIPGVFTTDFPAKPPVKFDYTGNVSRSLWQPVPGTKAYKLKFGSRVQIVLQDTSIVTPENHPIHLHGYDFYIVAEGFGNFDAKKDTSKFNLVDPPMRNTVAVPVNGWAVIRFVADNTRIKKVSAWILHCHLDVHIGWGLATILLVEDGVGKLQSIQSPPQDLPIC

SEQ ID NO: 9601 - protein, 587 aa, Glycine max
MESVKFINMNAKHSSIFLLAMIFVLILASANAKIHEHEFVVEATPVKRLCKTHNSITVNGQYPGPTLEINNGDTLVVKVTNKARYNVTIHWHGVRQMRTGWADGPEFVTQCPIRPGGSYTYRFTVQGQEGTLWWHAHSSWLRATVYGALIIRPREGEPYPFPKPKHETPILLGEWWDANPIDVVRQATRTGGAPNVSDAYTINGQPGDLYKCSSKDTTIVPIHSGETNLLRVINAALNQPLFFTVANHKLTVVGADASYLKPFTTKVLMLGPGQTTDVLITGDQPPSPYYMAARAYQSAQNAAFDNTTTTAILEYKSPHHSNHSHHHSKGALKKKTKPIMPSLPAYNDTNTVTAFSKSFRSPRKVEVPAEIDQSLFFTVGLGINKCPKNFGPKRCQGPINGTRFTASMNNVSFVLPNNVSILQAHHLGIPGVFTTDFPGKPPVKFDYTGNVSRSLWQPVPGTKAHKLKFGSRVQIVLQDTSIVTPENHPIHLHGYDFYIVAEGFGNFDAKKDTAKFNLVDPPLRNTVAVPVNGWAVIRFVADNPGAWLLHCHLDVHIGWGLATVLLVENGVGKLQSIEPPPLDLPLC

SEQ ID NO: 9602 - protein, 589 aa, Glycine max
MEPAKTIHNNVKYSPIFLAIFVLILASALSSANAKIHEHEFVVEATPVKRLCKTHNSITVNGQYPGPTLEINNGDTLVVKVTNKARYNVTIHWHGVRQMRTGWADGPEFVTSVPDCPGGSYTYRFTVQGQEGTLWWHAHSSWLRATVYGALIIRPREGEPYPFPKPKRETPILLGEWWDANPIDVVRQATRTGGAPNVSDAYTINGQPGDLYKCSSKDTTIVPIHAGETNLLRVINAALNQPLFFTVANHKLTVVGADASYLKPFTTKVLILGPGQTTDVLITGDQPPSRYYMAARAYQSAQNAAFDNTTTTAILEYKSPNHHNKHSHHRAKGVKNKTKPIMPPLPAYNDTNAVTSFSKSFRSPRKVEVPTEIDQSLFFTVGLGIKKCPKNFGPKRCQGPINGTRFTASMNNVSFVLPNNVSILQAHHLGIPGVFTTDFPGKPPVKFDYTGNVSRSLWQPVPGTKAHKLEFGSRVQIVLQDTSIVTPENHPIHLHGYDFYIVAEGFGNFDPKKDTAKFNLVDPPLRNTVAVPVNGWAVIRFVADNPGAWLLHCHLDVHIGWGLATVLLVENGVGKLQSIEPPPVDLPLC

SEQ ID NO: 9603 - protein, 569 aa, Glycine max
MEALKTIFLALSVVLASALYSVNAKIQEHEFVIQATPVKRLCNTHNTITVNGQFPGPTLEVNNGDTLVVKVTNKARYNVTIHWHGIRQMRTGWADGPEFVTQCPIRPGESYTYRFTIQGQEGTLWWHAHSSWLRATVYGALIIHPREGEAYPFTKPKRETPILLGEWWDANPIDVVRQATQTGAAPNISDAYTINGQPGDLYKCSSQGSTIVPIDSGETNLLRVINAALNQPLFFKVANHKLTVVGADASYLKPFTTNVIMLGPGQTTDVLIQGDQPPTRYYMAARAYQSAQNAPFDNTTTTAILEYKSAPCPAKGSSIKPVMPSLPAYNDTNTVTAFSKSFRSPRKVEVPAEIDENLFFTIGLGLNNCPKNFNANQCQGPNGTRFTASMNNVSFVLPNNVSILQAHHLGVQGVFTTDFPTQPPVKFDYTGNVSRSLWQPVPGTKVTKLKFGSRVQIVLQDTSIVTPENHPIHLHGYDFYIVAEGFGNFDPNKDTSKFNLIDPPMRNTVAVPVNGWAVIRFVADNPGAWIMHCHLDVHIGWGLATVLLVDNGVGLLQSIEPPPEDLPLC

SEQ ID NO: 9604 - protein, 569 aa, Glycine max
MEALKTLFLAIFVVLASALYSANAKIQEHEFVIQATPVKRLCNTHSTITVNGQFPGPTLEVNNGDTLVVKVTNKARYNVTIHWHGIRQMRTGWADGPEFVTQCPIRPGESYTYRFTIQGQEGTLWWHAHSSWLRATVYGALIIHPREGEAYPFTKPKRETPILLGEWWDANPIDVVRQATQTGAAPNTSDAYTINGQPGDLYKCSSQGTTIVPIDSGETNLLRVINAALNQPLFFTVANHKLTVVGADASYLKPFTTNVIMLGPGQTTDVLIQGDQPPTRYYMAARAYQSAQNAPFDNTTTTAILEYKSAPCPTKGSSIKPVMPSLPAYNDTNTVTAFSKSFRSPRKVEVPAEIDDNLFFTIGLGLNNCPKNFNANQCQGPNGTRFTASMNNVSFVLPNNVSILQAHHLGVQGVFTTDFPTQPPVKFDYTGNVSRSLWQPVQGTKVTKLKFGSRVQIVLQDTSIVTPENHPIHLHGYDFYIVAEGFGNFDPNKDTSKFNLVDPPMRNTVAVPVNGWAVIRFVADNPGAWIMHCHLDVHIGWGLATVLLVDNGVGLLQSIEPPPEDLPLC

SEQ ID NO: 9605 - protein, 567 aa, Medicago truncatula
MEVFNTIFLAIFLLFASLANAKVHEHEFVVQATPVKRLCNTQMSITVNGQFPGPTLEINNGDTLVVKVINKARYNVTIHWHGVRQIRTGWADGPEFVTQCPIRPGESYTYRFTINGQEGTLWWHAHSSWLRATVYGALIIHPKEGDAYPFTKPKRETPILLGEWWDANPIDVVRQATQTGAAPNISDAYTINGQPGDLYKCSSKGTTIVPIDSGETNLIRVINAALNQPLFFTIANHKLTVVGADASYVKPFTTNVLMLGPGQTTDVLIQGDQPPSRYYIAGRAYQSAQNAAFDNTTTTAILEYKSSPCPAKGGANIRPIMPSLPAYNDTNTVTSFSKSFRSLRNVEVPNEIDEDLFFTIGLGLNNCPSNFNSNQCQGPNGTRFTSSMNNVSFVLPSNFSILQAHKLGVQGVFTTDFPTKPPVQFDYTGNVSRSLWQPIQGTKVTKLRFGSRVQVVLQDTSIVTPENHPIHLHGYDFYIVAEGFGNFDPKKDASKFNLVDPPMRNTVAVPVNGWAVIRFVADNPGVWIMHCHLDVHIGWGLATVFLVEDGEGLLESIEAPPEDLPLC

SEQ ID NO: 9606 - protein, 577 aa, Ricinus communis
MGDITNHIFANSCFLFFGLLLLLASTLSLANAKVHHHDFVVQATKVKRLCKTHNTITVNGMFPGPTIEVNSGDTLVVKVTNKARYNVTVHWHGIRQMRTGWADGPEFITQCPIRPGGSYTYRFTIEGQEGTLWWHAHSSWLRATVYGALIIYPKDGTSYPYAKPKRETPILLGEWWDANPIDVVREATRTGAAPNISDAYTINGQPGDLYNCSSKETVIVPIGSGETHLLRVINAALNQPLFFTIANHKFTVVGADALYLKPFSTSVIMLGPGQTTDVLISGDQPPARYYIAARAYQSAQNAPFDNTTTTAILEYKSAPCPAKCLTSKPIMPPLPAFNDTPTVTAFSKSLRSPRKVDVPTEIDENLFFTIGLGLNKCPKNFRARRCQGPNGTRFTSSMNNVSFVLPSNFSLLQAARQNIPGVFTTDFPAKPPVKFDYTGNVSQSLWQPVPGTKLYKLKYGSRVQIVLQDTSIVTPENHPIHLHGYDFYVIAEGFGNFNPKKDTAKFNLVDPPMRNTVAVPSNGWAVIRFVADNPGVWIMHCHLDVHITWGLAMAFLVEDGIGELQKLEPPPNDLPLC

SEQ ID NO: 9607 - protein, 575 aa, Populus trichocarpa
MEVIKSIFADRHCSFFLVVLLLASTMSLAIAEIHHHDFVVQATKVKRLCKTHNSITVNGMFPGPTLEVKNGDTLVVKVVNKARYNVTIHWHGIRQMRTGWADGPEFVTQCPIRPGGSYTYRFNIEGQEGTLWWHAHSSWLRATVYGALIIHPREGSSYPFAKPKRETPILLGEWWDANPVDVVREATRTGAAPNISDAYTINGQPGDLYNCSSEDTTIVPIASGETNLLRVINAALNQPLFFTIANHKFTVIGADASYLKPFTTSVIMLGPGQTTDVLISGDQLPGRYYMAARAYQSAQNAPFDNTTTTAILEYKSALCPAKCTTKPVMPRLPAYNDTATVTAFSGSLRSPRKVEVPTDIDENLFFTIGLGLNNCPKNSRARRCQGPNGTRFTASMNNVSFVFPSNIALLQAYQQKVPGIYTTDFPAKPPVKFDYTGNVSRSLFQPVRGTKLYKLKYGSRVQIVLQDTSIVTPENHPIHLHGYDFYIIAEGFGNFNPKTHKSKFNLVDPPMRNTVAVPSNGWAVIRFVADNPGVWLMHCHLDVHITWGLAMAFLVEDGIGELQSVEPPPADLPIC

SEQ ID NO: 9608 - protein, 550 aa, Populus trichocarpa
MSLAIAKTHHHDFTVQATKVKRLCKTHNSITVNGMFPGPTLEVKNGDTLVVKVVNRARYNVTIHWHGIRQMRTGWADGPEFVTQCPIRPGGSYTYRFTIEGQEGTLWWHAHSSWLRATVYGALIIHPREGSSYPFSKPKRETPILLGEWWDANPIDVVREATRTGAAPNISDAYTINGQPGDLFNCSSKDTTIVPIDSGETNLLRVINAALNQPLFFTIANHKFTVVGADASYLKPFTTSVIMLGPGQTTDVLISGDQLPGRYYMAARAYQSAQNAPFDNTTTTAILEYKSVLCPAKCTKKPFMPPLPAYNDTATVTAFSRSFRSPRKVEVPTDIDENLFFTIGLGLNNCPKNFRARRCQGPNGTRFTASMNNVSFVFPSKASLLQAYKQKIPGVFTTDFPAKPQVKFDYTGNVSRSLFQPARGTKLYKLKYGSRVQIVLQDTSIVTPENHPIHLHGYDFYIIAEGFGNFNPKTDKSKFNLVDPPMRNTVAVPVNGWAVIRFVADNPGVWLMHCHLDVHITWGLAMAFLVEEGIGILQSVEPPPADLPIC

SEQ ID NO: 9609 - protein, 574 aa, Populus trichocarpa
MEVINRIFANRHCSFFLLLLLASAMSLAIAKTHHHDFTVQATKVKRLCKTHNSITVNGMFPGPTLEVKNGDTLVVKVVNRARYNVTIHWHGIRQMRTGWADGPEFVTQCPIRPGGSYTYRFTIEGQEGTLWWHAHSSWLRATVYGALIIHPREGSSYPFSKPKRETPILLGEWWDTNPIDVVREATRTGAAPNISDAYTINGQPGDLFNCSSKDTTIVPIDSGETNLLRVINAALNQPLFFTIANHKFTVVGADASYLKPFTTSVIMLGPGQTTDVLISGDQLPGRYYMAARAYQSAQNAPFDNTTTTAILEYKSVLCPAKCTKKPFMPPLPAYNDTATVTAFSRSFRSPRKVEVPTDIDENLFFTIGLGLNNCPKNFRARRCQGPNGTRFTASMNNVSFVFPSKASLLQAYKQKIPGVFTTDFPAKPQVKFDYTGNVSRSLFQPARGTKLYKLKYGSRVQIVLQDTSIVTPENHPIHLHGYDFYIIAEGFGNFNPKTDKSKFNLVDPPMRNTVAVPVNGWAVIRFVADNPGVWLMHCHLDVHITWGLAMAFLVEEGIGILQSVEPPPADLPIC

SEQ ID NO: 9610 - protein, 574 aa, Glycine max
MKRFVFSLAWVFALVLASSLAHAAVVEHTFNVEDITVQRLCRQQLITAVNGTLPGPTINAREGDTIVVHVFNKSPYNLTLHWHGIIQFLTPWSDGPEFVTQCPIPSGSRYTYKFNLTGQEGTLWWHAHSSFLRATVYGALLIRPRVGHSYPFPKVYQEVPILLGEWWNANVVEVEHNATESQTAPIPSAAYTINGLPGDSYNCSENQMYQLKVKQGKTYLLRIINAALNEQHFFKIANHTFTVVAIDALYTQHYKTDVVVLAPGQTVDVLFSTNQHVDSYYMAFTPYHSAPQIPINNSTTRGLVIYEGATSVEKPILPNLPAQTDTPTAHKFYTNITGLAGGPHWVPVPRQVDEHMFITFGLNFDLCKNVSTPNGCSARQPPLSASMNNESFVLPRGKGLSMLEAFYNNDVNGVYTRDFPNQPPIVFDYTDPNITSTTELAFKIAPKSTKVKTLKFNSTVQIVLQNTAIVSAENHPIHIHGFNFHVLAQGFGNYNATRDEPKFNLVNPQIRNTISVPVGGWSVVRFQANNPGVWLVHCHLETHLPWGLAMAFEVENGPTPSLSVPPPPADLPRC

SEQ ID NO: 9611 - protein, 571 aa, Glycine max
MKRFVFALARAFALFLACSLASGAVVEHIFNVENITVQRLCRQQVITAVNGTLPGPTINAREGDTVVVHVFNKSPYNLTIHWHGIFQFLTPWSDGPEFATQCPIASGSSYTYRFNLTGQEGTLWWHAHSSFLRATVYGALLIRPRLGHSYPFPKVYQEIPILVGEWWNANVVEVEQNATETQQPPIESDAYTINGLPSDLYNCSQDGTYQVKVKQGKTYLLRIINSALNNQHFFEVANHTLTVVAIDATYTNHYDTKVVVLAPGQTVDVLLRTNQSVGSYYMAFTPYHSAPLVQINANMTRGVIIYEGATSAKPIMPDLPAQTDTPTAHKFYTNITGLAGGPHWVPVPRQVDEHMFITFGLSFDICRSDTGVCPGPVPLFSANMNNESFVLPHGKGVSMLEAFFRNDVTGVYTRDFPDQPAVVFDFTNPNITSSPDTPREFLIAPKSTKVKTLKFNSTVQIVLQNTAIIAAENHPIHLHGFNFHVLAQGFGNYNATRDEPKFNFVNPQIRNTIAVPVGGWSVIRFQANNPGVWLMHCHLETHLPWGLSTAFEVENGPSIRVPPPPADLPKC

SEQ ID NO: 9612 - protein, 567 aa, Glycine max
MKRLVFSLAWAFALLLACSLVSGAVVEHTFNIGNLTVSRLCNEEVITTVNGSLPGPTIYVEEGDTLVVHANNNSPYNITLHWHGIFQILTAWADGPESVTQCPIRPGGKYTYRFNITGQEGTLWWHSHSSFLRATVYGALIIRPRRGNSHPFPSVYQEVPILLGEWWNGNVVDVENNAIETGIGPNLSDAYTINGLPGDTYNCSQNQTYQLQVKHGETYLLRIINAALNAQHFFKIANHTFTVVAIDASYTQPYNTDVIILAPGQTVDAIITTNQTLGSYYMAFTPYHSAPGVSINNNITRGVVIYENATSASPVMPDLPAQTDTPTAHKFYTNITGLAGGPHWVPVPLNVDQHMLITFGIGLDHCPELDPEGCGGRNFRLSASMNNESFVLPKGLSMMEAFFRNVSGVYTRDFPDNPPFVFNYTDPTLETNGTDIAFAPKSTKVKPLTFNSTVQVVLQNTAILARENHPIHLHSFNFHVLAQGFGNYDSNVDESKFNLDNPQIRNTISVPVGGWAVIRFQANNPGIWLVHCHLETHLPWGLAMAFEVENGPEPWVLPPPPADLPQC

SEQ ID NO: 9613 - protein, 584 aa, Glycine max
MTTTIPSSHSFFVAFLFATSFLWSFPEFALATSKHGSVTRHYKFDIRLRNITRLCHTKSMVTVNGKFPGPRVVAREGDRIVVKVVNHVPNNVSIHWHGVRQLQSGWADGPSYITQCPIQTGQSYVYNFTIVGQRGTLFWHAHISWLRATLYGPLILLPRRNESYPFEKPYKEVPILFGEWWNADPEAVIAQALQTGAGPNVSDAYTFNGLPGPLYNCSNNDTFRLKVKPGKTYLLRLINAALNDELFFSIANHTLVTVEADATYVKPFESEIIVIGPGQTSNFLLKTKPEYPNVNFLMLARPYFTGMGTFDNSTVAGILEYKKPLVAPKNTIPTLKPSLPAINDTSFVANFSSKFLSLNTDKYPAKVPQTVDKSFFFTIGLGTSPCPKNQTCQGPNNSSKFAASMNNISFTLPSIALLQQHFFGQANNGIYTTDFPAMPLMPFNYTGTPPNNTRVSNGTKTVVIPFNTRVQVVLQDTSILGAESHPLHLHGFNFYVVGQGFGNFNPNTDPPKFNLVDPVERNTVGVPSGGWVAIRFLADNPGVWLMHCHFDVHLSWGLRMAWIVEDGKLPNQKLPPPPADLPKC

SEQ ID NO: 9614 - protein, 584 aa, Glycine max
MIKPIPSSPSLFVAFLFATSFLWSFPEFVLATSKHGSATRHYKFDIRLRNVTRLCHTKSMVTVNGKFPGPRVVAREGDRIVVKVVNHVPNNVSIHWHGVRQLQSGWADGPSYITQCPIQTGQNYVYNFTIVGQRGTLFWHAHFSWLRATLYGPLILLPRRNESYPFEKPYKEVPIIFGEWWNADPEAVIAQALQTGAGPNVSDAYTFNGLPGPFYNCSNNDTDTFRLKVKPGKTYLLRLINAALNDELFFSIANHTLVTVEADATYVKPFESDIIVLGPGQTSNVLLKTKAEYPNANFLMLARPYFTGMGTFDNSTVAGFLEYKNKPLAAPKNINIPTLKPFLPAINDTSFVANFSNKFFSLNPAKVPQIVDKSFFFTIGLGTSPCPKNQTCQGPNNSSKFAASMNNISFTLPSIALLEQHFFGQANNGIYTTDFPAMPLMPFNYTGTPPNNTLVGNGTKTVVIPFNTSVQVVLQDTSILGAESHPLHLHGFNFYVVGQGFGNFNPNTDPQIFNLFDPVERNTVGVPSGGWVAIRFLADNPGVWLMHCHFDVHLSWGLRMAWIVEDGKLPNQKLPPPPADLPKC

SEQ ID NO: 9615 - protein, 585 aa, Medicago truncatula
MHIKMIVTVPLSKALFAAFLFVTTFLLTSPGFVLATSQHGSVTRHYKFDIRLANVTRLCHTKSMVTVNGKFPGPRIVVREGDRLLVKVVNHVPNNISLHWHGVRQLRSGWSDGPSYITQCPIQTGQSYVYNFTIVGQRGTLFWHAHFSWLRATVYGPLILLPRHNESYPFQKPYKEVPILFGEWWNADPEAVIAQALQTGGGPNVSDAYTINGFPGPLYNCSKDTYKLKVKPGKTYLLRLINAALNDELFFSIANHTLIIVEADASYIKPFESNTIILGPGQTTNVLLKTKPNYPNSTFYMLARPYFTGQGTFDNSTVAGILEYTKPNDQTNLNLPILKPVLPVINDTNFVANFSNKFLSLNSPKYPANVPKTIDKNFFFIVGLGTSPCPKNQTCQGPNNSSKFAASMNNVSFALPSIALLQQHFFGANNGFTTDFPVVPLRPFNYTGTPPNNTLVSNGTKTVVIPYNTRVQVILQDTSILGAESHPLHLHGFNFFVVGQGFGNFNASSDPAKFNLVDPVERNTVAVPSGGWVAIRFLADNPGVWLMHCHFDVHLSWGLRMAWIVEDGKLPDQKLPPPPKDLPKC

SEQ ID NO: 9616 - protein, 585 aa, Vitis vinifera
MGASFLPLPAFLGVLLLSCVTFCLLPEIALAKDTGLTRHYKFEIKLQNVTRLCHTKSIVTVNGLFPGPRIVAREGDRLLIKVVNHVQDNISIHWHGIKQLQSGWADGPAYVTQCPIQTGQSYVYNFTIVGQRGTLFWHAHISWLRSTLYGPIIILPRRNASYPFEKPHKGVPIIFGEWWNADPEAVISQALQTGGGPNVSDAYTINGLPGPLYNCSAKDTFKLKVKPNKTYLLRFINAALNDELFFSIANHTLTVVDVDAIYVKPFETKTLLITPGQTTNVLLKTKPNFPNATFLMTARPYVTGLGTFDNSTVAGILEYELPSGSPHSTLFIKKLPLFKPTLPPLNDTSFAANFTSKLRSLASPQFPANVPQKVDRHFFFTVGLGSSPCDQNQTCQGPNGTKFSASFNNISFALPTTALLQAHFFGQSNGVYKPDFPITPIIPFNYTGTPPNNTLVSNGTKVVVLPFNTSVELVVQDTSILGAESHPLHLHGFNFFVVGQGFGNYDPNKDPAKFNLVDPIERNTVGVPSGGWVAIRFLADNPGVWFMHCHLEIHTSWGLKMAWVVLDGKLPNQKLPPPPADLPKC

SEQ ID NO: 9617 - protein, 559 aa, Vitis vinifera
  misc_feature (38)..(38): Xaa can be any naturally occurring amino acid
MIALAKDTGLTRHYKFEIKLQNVTRLCHTKSIVTVNGXFPGPRIVAREGDRLLIKVVNHVQDNISIHWHGIKQLQSGWADGPAYVTQCPIQTGQSYVYNFTIVGQRGTLFWHAHISWLRSTLYGPIIILPRRNASYPFEKPHKGVPIIFGEWWNADPEAVISQALQTGGGPNVSDAYTINGLPGPLYNCSAKDTFKLKVKPNKTYLLRFINAALNDELFFSIANHTLTVVDVDAIYVKPFETKTLLITPGQTTNVLLKTKPNFPNATFLMTARPYVTGLGTFDNSTVAGILEYELPSGSPHSTLFIKKLPLFKPTLPPLNDTSFAANFTSKLRSLASPQFPANVPQKVDRHFFFTVGLGSSPCDQNQTCQGPNGTKFSASFNNISFALPTTALLQAHFFGQSNGVYKPDFPITPIIPFNYTGTPPNNTLVSNGTKVVVLPFNTSVELVVQDTSILGAESHPLHLHGFNFFVVGQGFGNYDPNKDPAKFNLVDPIERNTVGVPSGGWVAIRFLADNPGVWFMHCHLEIHTSWGLKMAWVVLDGKLPNQKLPPPPADLPKC

SEQ ID NO: 9618 - protein, 576 aa, Populus trichocarpa
MGAPVPASPGILLTILLFAMSCLWAFPEVAGAKHAGITRHYKFNIKLTNVTRLCHTKSMVTVNGKFPGPRVVAREGDRLVVKVVNHVPNNISIHWHGIRQLQSGWADGPAYITQCPIQTNQTYVYNFTVTGQRGTLFWHAHLSWLRASVYGPLIIFPKRNVSYPFAKPHKEVTIMLGEWFNADPEAVIRQALQTGGGPNVSEAYTFNGLTGPLYNCSANNTYKLKVKPGKTYLLRLINAALNDELFFSIANHTFTVVEVDATYVKPFETNLLVITPGQTTNVLLKTKPIAPNASFYMLARPYFTGQGTFDNTTVAGILEYETSSNSTTFKPTLPPINATNAVANFTRKLRSLANFQFPVNVPQTVDKKFFFTVGLGNNPCPKNQTCQGPNGTKFSASVNNISMALPSTALLQSYFFKKSNGVYTSDFPSSPLHPFNYTGTPPNNTFVTNGTKLIVLPFNTNVEVVMQGTSILGAESHPLHLHGFNFYVVGEGFGNFDPNNDPKNFNLVDPVERNTVGVPSGGWVAIRFHADNPGVWFMHCHFDVHLSWGLRMAWIVLDGTLPSQKLPPPPSDLPKC

SEQ ID NO: 9619 - protein, 585 aa, Vitis vinifera
MGVSFLPSPPFVGVFVFSCMALCLLPELALAQDSGITRHYKFDIKLQNVTRLCHTKSILTVNGQFPGPRIVAREGDRLLIKVVNHVQNNISIHWHGIRQLRSGWADGPAYVTQCPIQTGQSYVYNFTVVGQRGTLFWHAHISWLRSTLYGPLIILPKRNVPYPFEKPHKEVPIIFGEWWNADTEAVISQALQTGGGPNVSDAYTINGLPGPLYNCSAKDTFKLRVKASKTYLLRLINAALNDELFFSIANHTLTVVDADAIYVKPFETDTLLIAPGQTTNVLLKTKPHFPNAAFLITARPYVTGLGTFDNSTVAGILEYELPSASPHSTVSIKKLPLFKPTLPPLNDTSFATNFTNRLRSLASPQFPANVPQKVDRHFFFTIGLGTSPCDQNQTCQGPNGTKFAASVNNVSFASSTTALLQAHFSGQSNGVYNPDFPITPIIPFNYTGTPPNNTLVSNGTKVVVLPFNTSVELVMQDTSILGAESHPLHLHGFNFFVVGQGFGNYDPNKDPANFNLVDPIERNTVGVPSGGWVAIRFLADNPGVWFMHCHLEIHTSWGLKMAWVVLDGKLPNQKLLPPPADLPKC

SEQ ID NO: 9620 - protein, 584 aa, Vitis vinifera
MGASLLSSTAIFRVMFIVLNTLWLSPELASSAGVTRHYKFHIKLQNVTRLCHTKSIVSVNGQFPGPPIIAREGDQVVVKVINHVQNNVTIHWHGVRQLRSGWADGPAYVTQCPIQTGQTYVYNFTITGQRGTLFWHAHISWLRATLYGPIIILPKKNVPYPFVKPYKEVPIIFGEWWNADPEAVITQALQNGGGPNVSDAYTINGLPGPLYNCSAQDTFKLKVKPGRTYLLRLINAALNDELFFSIANHTLTVVDVDAIYVKPFKTDTILITPGQTTNLLLKAKPHFPNATFLMAARPYATGRGTFDNSTVTGLLHYETPPKSSPSASSFKNLPLFKPTLPPLNDTSFAANFTHKLRSLANSQFPANVPQKVDKRFFFTVGLGTNPCPQNQTCQGPNNSTKFSASVNNVSFVLPTTAILQAHFFQQSNGVYTTDFPATPIFPFNYTGTPPNNTMVNNGTKVVVLPFNTSVELVLQDTSILGIESHPLHLHGFNFFVVGQGFGNFDSKKDPPKFNLVDPVERNTVGVPSGGWVAIRFLADNPGVWFMHCHFEVHMSWGLKMVWMVMDGKLPNQKLPPPPSDLPQC

SEQ ID NO: 9621 - protein, 566 aa, Vitis vinifera
MALCLLPELALAQDSGITRHYKFDIKLQNVTRLCHTKSILTVNGQFPGPRIVAREGDRLLIKVVNHVQNNISIHWHGIRQLRSGWADGPAYVTQCPIQTGQSYVYNFTVVGQRGTLFWHAHISWLRSTLYGPLIILPKRNVPYPFEKPHKEVPIIFGEWWNADTEAVISQALQTGGGPNVSDAYTINGLPGPLYNCSAKDTFKLRVKASKTYLLRLINAALNDELFFSIANHTLTVVDADAIYVKPFETDTLLIAPGQTTNVLLKTKPHFPNAAFLITARPYVTGLGTFDNSTVAGILEYELPSASPHSTVSIKKLPLFKPTLPPLNDTSFATNFTNRLRSLASPQFPANVPQKVDRHFFFTIGLGTSPCDQNQTCQGPNGTKFAASVNNVSFASSTTALLQAHFSGQSNGVYNPDFPITPIIPFNYTGTPPNNTLVSNGTKVVVLPFNTSVELVMQDTSILGAESHPLHLHGFNFFVVGQGFGNYDPNKDPANFNLVDPIERNTVGVPSGGWVAIRFLADNPGVWFMHCHLEIHTSWGLKMAWVVLDGKLPNQKLLPPPADLPKC

SEQ ID NO: 9622 - protein, 567 aa, Glycine max; identical to SEQ ID NO: 9612

SEQ ID NO: 9623 - protein, 574 aa, Glycine max; identical to SEQ ID NO: 9610

SEQ ID NO: 9624 - protein, 557 aa, Glycine max
MDSHWVRMVLLIACILPALVECRVRHYKFHVVSKQTNRLCSSKSIVTINGKFPGPTLYAREDDTVLVKVINQVNHNVTIHWHGVRQLRTGWADGPAYVTQCPIQPGQTYLYNFTLTGQRGTLLYHAHVNWLRSTLHGALVILPKRGVPYPFPKPDDELVVVLGEWWKSDTEAIINEALKSGLAPNVSDAHTINGLPGAVTNCSTQDVYNLPVESGKTYLLRIINAALNEELFFKIAGHKLTVVEVDATYVKPFKIETILIAPGQTTNVLLNADQKFGKYLVAASPFMDAPIAVDNLTATATLHYTGTLAATPTILTTPPPKNSTQIANNFISSLRGLNSKKYPVNVPLTVDHSLFFTVGLGISPCPSCKAANGSRVVAAINNVTFIMPTIALLQAHYFNIKGVFTTDFPANPPHLFNYSGPGPANLNTETGTKVYRVPFNATVQVVLQDTGIIAPENHPVHLHGFNFFVVGRGVGNFNPKIDPKNFNLVDPVERNTIGVPAGGWTAFRFRADNPGVWFMHCHLEVHTTWGLKMAFLVDNGKGPKQSVIPPPKDLPKC

SEQ ID NO: 9625 - protein, 557 aa, Glycine max
MYSHWVRLMLLIACILPALVECRERHYKFHVVSKQTNRLCSSKSIVTINGKFPGPTLYAREDDTVLVKVINQVNHNVTIHWHGVRQLRTGWADGPAYVTQCPIQPGQTYVYNFTLTGQRGTLLYHAHVNWLRSTLYGALVILPKRGVPYPFPKPDDELVVVLGEWWKSDTEAVINEALKSGLAPNVSDAHTINGLPGTVTNCSTQDVYNLPVESGKTYLLRIVNAALNEELFFKIAGHKLTVVEVDATYVKPFKIETIVIAPGQTTNVLLNANQKSGKYLVAASPFMDAPVAVDNLTATATLHYTGTLAATPTILTTPPPKNATQIANNFISSLRGLNSKKYPVNVPLTVDHSLIFTVGLGINPCPSCKAANGSRVVAAINNVTFIMPTIALLQAHYFNIKGVFTTDFPANPPHVFNYSGPGPANLNTETGTKVYRLPFNATVQVVLQDTGIIAPENHPVHLHGFNFFVVGRGVGNFNPKIDPKNFNLVDPVERNTIGVPAGGWTAFRFRADNPGVWFMHCHLEVHTTWGLKMAFLVDNGKGPKQSVIPPPKDLPKC

SEQ ID NO: 9626 - protein, 557 aa, Medicago truncatula
MVSWIRVLLLICCIFPALVECKVRHYKFHVVAKNTSRLCSSKAIVTVNGKFPGPTLYAREDDTVIVKVRNQVNNNITIHWHGIRQLRTGWADGPAYITQCPIQPGHSYTYNFTITGQRGTLLWHAHVNWLRSTVHGAIVILPKKGVPYPFPKPDDELVLVLGEWWKSDTEAVINEALKSGLAPNVSDAHTINGLPGTVANCSTQDVYKLPVESGKTYLLRIINAALNEELFFKIAGHKLTVVEVDATYTKPFQIETIVIAPGQTTNVLLKANQKSGKYLVAASPFMDAPVAVDNLTATATLHYSGTTLTNTPTFLTTPPPTNATQIANNFLNSLKGLNSKKYPVNVPLKIDHSLFFTVGLGVNPCPSCKAGNGSRVVAAINNVTFVMPTTALLQAHYFNIKNVFTADFPPNPPHIYNFTGAGPKNLNTTSGTKLYKLSFNDTVQLVMQDTGIIAPESHPVHLHGFNFFVVGRGVGNYDSKNDSKKFNLVDPVERNTVGVPAGGWVAIRFRADNPGVWFMHCHLEVHTTWGLKMAFLVDNGKGPKQSVIAPPKDLPKC

SEQ ID NO: 9627 - protein, 557 aa, Populus trichocarpa
MEYSCFRFMLLAVCLFPAVVECRIRHYKFNVVMKNTTRLCSSKPIVTVNGLFPGPTLYAREDDTVLVKVVNRVKYNLSIHWHGIRQLRTGWADGPAYITQCPIQPGQSYVYNFTITGQRGTLLWHAHILWLRATVHGAIVVLPKLGVPYPFPAPHKEVVVVLAEWWKSDTEAVINEALKSGLAPNVSDAHTINGHPGAVSTCSSQGGFTLPVQSGKTYMLRLINAALNEELFFKIAGHKLTVVEVDATYVKPFKTDTVLIAPGQTTNVLVTTNKNTGKYLVAASPFMDAPIAVDNMTATATLHYSGALSNSPTTLTIPPPKNATAIANQFTNSLRSLNSKTFPAKVPLTVDHSLFFTVGLGINPCPTCKAGNGSRVVASINNVTFVMPTTALLQAHFFNISGVFTTDFPAKPPHVFNYTGTPPTNLQTTSGTKAYRLPYNSTVQLVMQDTGIISPENHPIHLHGFNFFAVGRGVGNYNPKTDPKKFNLVDPVERNTIGVPSGGWVAIRFRADNPGVWFMHCHLEVHTTWGLKMAFLVDNGKGPNESLLPPPSDLPKC

SEQ ID NO: 9628 - protein, 556 aa, Ricinus communis
MESLFRFLLLFVCFLPVFVDCRVRRYNFNVVTKTSTKLCSSKPIVTVNGKFPGPTLYAREDDTVLVRVVNKVKYNVSIHWHGVRQLRTGWADGPAYITQCPIQPGQNYVYNFTLTGQRGTLLWHAHILWLRSTVHGAIVILPKRGVPYPFPKPHKEEVVILAEWWKSDTEAVINEAMKSGLAPNVSDAHTINGHPGAVPNCPSQSGFRLPVESGKAYLLRLINAALNEELFFKIAGHQLTVVEIDACYVKPLKTDTVLLAPGQTTNVLVTANKNSGKYLVTASPFMDAPVAVDNRTATATLHYSGTLASAPTTVATPPPQNASAVANNFINSLRSLNSQKYPARVPLKVDHNLLFTVGLGINACPSCKAANGSRVVASINNVTFVMPTTALLQAHFFKISGVFTTDFPSKPPHVFNFTGSGPKNLNTVRATKVYRLKYNDTVQLVMQDTGVIAPESHPIHLHGFNFFVVGRGLGNYNPNTDPQNFNLVDPAERNTIGVPTGGWAAIRFRADNPGVWFMHCHLEVHTTWGLKMAFLVDNGKGPNESLLPPPSDLPKC

SEQ ID NO: 9629 - protein, 556 aa, Vitis vinifera
MKYSWVRVLVLVACLLPALVECRVRQYTFNVVLKNTNRLCASKPIVTVNGRFPGPTLYVREDDTVLVRVVNHVKYNVSIHWHGIRQLRTGWSDGPAYITQCPIQTGQSYLYNFTVTGQRGTLLWHAHVLWLRATVHGAIVILPKRGVPYPFPKPHKEVVVILGEWWKSDVEAVINQALSSGLAPNVSDAHTINGHPGPVSNCPSQGGFSLQVEAGKTYLLRIINAALNEELFFKIAGHQLSVVEVDAVYTKPFKIDTLVIAPGQTTNALITADQSSGKYLMAASPFMDSPIAVDNLTATATLHYSGTLASSPTSLTSPPPPNATAVANKFVNSLRSLNSKKYPAKVPLTVDHSLFITVGLGINPCATCVAGNGSRAVASMNNVTFVMPTTAILQAHYFNISGVYTTDFPANPPVAFNYTGSPANLQTTNGTKVYRVPYNSTVQVVLQDTGIIATENHPVHLHGFNFFAVGKGLGNYNPKTDPQNFNLIDPVERNTIGVPSGGWTAIRFLADNPGVWFMHCHLEVHTTWGLKMAFLVDNGKGPNQSIIPPPSDLPKC

SEQ ID NO: 9630 - protein, 557 aa, Populus trichocarpa
MEYSWFRFMLLAVSLFPALVECRVRHYKFNVVMKNTTRLCSSKPVVTVNGRFPGPTLYAREDDTVLVKVVNHVKYNVSIHWHGIRQLRTGWADGPAYITQCPIQTGQSYVYNFTITGQRGTLLWHAHILWLRATVHGAIVVLPKRGVPYPFPAPHKEFVVVLAEWWKSDTEAVINEALKSGLAPNVSDAHTINGHPGAVSACPSQGGFTLPVESGKTYMLRLINAALNEELFFKIAGHKLTLVEVDATYVKPFKTDTVLIAPGQTTNVLVTTNKNTGKYLVAASPFMDAPIAVDNMTATATLHYSGALSGTPTTLTIPPPKNATAVANQFTNSLRSLNSKRFPAKVPLTVDHNLFFTVGLGINPCPTCKAGNGSRVVASINNVTFVMPTTALLQAHFFNISGVFTTDFPSKPPHVFNYTGTPPTNLQTTSGTKVYRLRYNSTVELVMQDTGIISPENHPIHLHGFNFFGVGRGVGNYNPKTDPKKFNLVDPVERNTIGVPSGGWVAIRFRVDNPGVWFMHCHLEVHTTWGLKMAFLVDNGKGPNESLLPPPSDLPKC

SEQ ID NO: 9631 - protein, 550 aa, Populus trichocarpa
FMLLAVCLLPALVECRIRHYKFNVVMKNTTRLCSRKPIVTVNGRFPGPTLYAREHDTVLVKVVNHVKYNVSIHWHGIRQLRTGWADGPAYITQCPIQPGQSYVYNFTITGQRGTLLWHAHILWLRATVHGALVVLPKRGIPYPFPAPHKEVVVVLAEWWKSDTEAVINEALKSGLAPNVSDAHTINGHPGAVSACSSQGGFTLPVKSGETYMLRLINAALNEELFFKIAGHKLTVVEVDATYVKPFKTDTVLIAPGQTTNVLVTTNKNTGKYLVAASPFMDSPIAVDNMTATATLQYSGALANSPTTLTTPPPKNATAVANQFTNSLRSLNSRRFPAKVPLNVDHNLFFTVGLGVNPCPSCKAGNGSRVVASINNVTFVMPTTALLQAHFLNISGVFTTDFPAKPPHVFNYTGTPPTNLQTKSGTKVYRLSYNSTVQLVMQDTGIISPENHPIHLHGFNFFAVGRGVGNYNPKTDTKKFNLVDPVERNTIGVPSGGWVAIRFRADNPGVWFMHCHLEVHTTWGLKMAFLVDNGKGPKESLLPPPSDLPKC

SEQ ID NO: 9632 - protein, 559 aa, Glycine max
MDSWVRMLFLIACIVPALVECKVRHYKFNVVLKNTTRLCSSKPIVTVNGKFPGPTLYAREDDTVLVKVNNLVNHNVTIHWHGVRQLRTGWADGPAYITQCPILSGQSYLYNFTLTGQRGTLLWHAHVNWLRSTLHGAIVILPKRGVPYPFPKPDKELVVILGEWWKSDTEDVINEALKSGLAPNVSDAHTINGLPGIVSVANCSTQDVYKLPVESGKTYLLRIINAALNEELFFKIAGHPFTVVEVDASYVKPFKTDTLSIAPGQTTNALLTADQNSGKYTIVASTFMDSPVVAVDNLTATATLHYTGTLATTPTLLTTPPPRNATQVANNFTNSLKSLNSKKYPAKVPQKVDHSLLLTVGLGINPCPSCTAGNGSRVVAAVNNVTFVMPTTALLQAHYFNIKGVFTTDFPGNPSHVYNYTATPPAAAWQTTNGTKAYRLAFNSTVQVVLQDTGVIAPESHPVHLHGFNFFVVGSGVGNYDPKTDQNNFNLADPVERNTIGVPTGGWVAFRFRADNPVWFLHCHFEVHTTWGLKMAFLVDNGKGPNESLLPPPKDLPKC

SEQ ID NO: 9633 - protein, 557 aa, Nicotiana tabacum
MNSWIRLFIVLAACLFPLVVECRIRHYKFNVVMKNTTRLCSSKPIVTVNGKFPGPTIYAREGDTVLVKVVNHVKYNLSIHWHGIRQLRTGWADGPAYITQCPIQPGQNYVYNFTITGQRGTLFWHAHILWLRATVHGAIVILPNLGVPYPFPKPNHEAVVILAEWWKSDTEAVINEAIKSGLAPNVSDAHTINGHPGPVSNCASQGGYKLNVDPGKTYMLRVINAALNEELFFKIAGHKMTVVEVDATYIKPFKTDTIVIAPGQTTNVIVTANQGSGKYMVAASPFMDAPIAVDNVTAIATLHYSGTQGNSHISLTSTPPKNATPVANTFLDSLRSLNSKKYPAKVPKKIDHSLFFTVGLGINPCPTCKQGNGSRVVASVNNVTFVMPTVALLQAHFFGTKGVFTTDFPANPPFAFNYTGTGPTNLATMNGTKVYRLRYNDTVQLVLQDTGIIAPENHPIHLHGFNFFLVGKGIGNFNPKTDPKNFNLVDPVERNTVGVPAGGWVAIRFRADNPGVWFMHCHLEIHTTWGLKMAWLVDNGKGPNESLLPPPKDLPKC

SEQ ID NO: 9634 - protein, 547 aa, Vitis vinifera
  misc_feature (10)..(10): Xaa can be any naturally occurring amino acid
  misc_feature (525)..(525): Xaa can be any naturally occurring amino acid
MGASLIPSTXIFKVLFLVLNSLWFLPELANGSGITRHYKFNIELQNVTRLCHTKSIVSVNGQFPGPPIIAREGDRVVVKVVNHVQNNVTIHWHGVRQLRSGWADGPAYVTQCPIQTGQTYVYNFTITGQRGTLFWHAHISWLRSTLYGPIIIFPKKNVPYPFAKPYKEVPIIFGEWWNTDPEAVITQALQNGGGPNVSDAYTINGLPGPLYNCSAQDTFKLKVKPGKTYLLRLINAALNDELFFSIANHTLTVVDVDAIYVKPFKTDTILITPGQTTNLLLKAKPHFPNATFLMAARPYATGRGTFDNSTVAANFTRKLRSLANTQFPANVPQKVDKRFFFTVGLGTNPCPQNQTCQGPNNSTMFSASVNNVSFVLPTTAILQAHFFQQSNGVYTTDFPATPIFPFNYTGTPPNNTMVSNGTKVVVLPFNTSVELVLQDTSILGIESHPLHLHGFNFFVVGQGFGNFDAKKDPSKFNLVDPVERNTVGVPSGGWVAIRFLADNPGVWLMHCHLEVHTSWGLKMGXIVKDGKMPNQKLPPPPSDLPKC

SEQ ID NO: 9635 - protein, 584 aa, Vitis vinifera
MGASLIPSTTIFKVLFLVLNSLWYLPELANGSGITRHYKFNIELQNVTRLCHTKSIVSVNGQFPGPPIIAREGDRVVVKVVNHVQNNVTIHWHGVRQLRSGWADGPAYVTQCPIQTGQTYVYNFTITGQRGTLFWHAHISWLRSTLYGPIIIFPKKNVPYPFAKPYKEVPIIFGEWWNTDPEAVITQALQNGGGPNVSDGYTINGLPGPLYNCSAQDTFKLKVKPGKTYLLRLINAALNDELFFSIANHTLTVVDVDAIYVKPFKTDTILITPGQTTNLLLKAKPHFPNATFLMAARPYATGSGTFDNSTVAGILHYEPPPKSSPSAPSFENLPLFKPTLPPLNDTSFAANFTRKLRSLANTQFPANVPQKVDKRFFFTVGLGTNPCPQNQTCQGPNNSTMFSASVNNVSFVLPTTAILQAHFFQQSNGVYTTDFPATPIFPFNYTGTPPNNTMVSNGTKVVVLPFNTSVELVLQDTSILGIESHPLHLHGFNFFVVGQGFGNFDAKKDPSKFNLVDPVERNTVGVPSGGWVAIRFLADNPGVWLMHCHLEVHTSWGLKMGWIVKDGKMPNQKLPPPPSDLPKC

SEQ ID NO: 9636 - protein, 584 aa, Vitis vinifera
MGASLLSSTAIFRVLFVVLNTLWLFPELASSAGITRHYKFNIKLQNVTRLCHTKSIVSVNGQFPGPHIIAREGDRVVVKVVNHVQNNVTIHWHGVRQLRSGWADGPAYVTQCPIQTGQTYVYNFTITGQRGTLFWHAHISWLRSTLYGPIIILPKKNVPYPFVKPYKEVPIIFGEWWNADPEAVITQALQNGGGPNVSDAYTINGLPGPLYNCSAQDTFKLKVKPGKTYLLRLINAALNDELFFSIANHTLTVVDVDAIYVKPFKTDTILITPGQTTNLLLKAKPHFPNATFLMAARPYATGRGTFDNSTVAGILHYEPPPKSSPSASSFKNLPLFKPTLPPLNDTSFAANFTGKLRSLANTQFPANVPQKVDQRFFFTVGLGTNPCPQNQTCQGPTNITMFSASVNNVSFVLPTTAILQAHFFQQSKGVYTTDFPTTPIFPFNYTGTPPNNTMVSNGTKVVVLPFNTSVELVLQDTSILGIESHPLHLHGFNFFVVGQGFGNFDSKKDPPKFNLVDPVERNTVGVPSGGWVAIRFLADNPGVWFMHCHLEVHTSWGLKMAWIVMDGKLPNQKLPPPPSDLPKC

SEQ ID NO: 9637 - protein, 583 aa, Vitis vinifera
MGSSLLSSAAMFRVLFLVLNSLWLFPELASAGITRHYKFNIKLQNVTRLCHTKNIVSVNGQFPGPRIIAREGDRVVVNVVNHVPNNVTIHWHGVRQLRSGWADGPAYVTQCPIQTGQTYVYNFTITGQRGTLFWHAHISWLRSTVYGPIIILPKKNVPYPFVKPYKEVPIIFGEWWNADPEAVITQALQNGGGPNVSDAYTINGLPGPLYNCSAQDTFKLKVKPGKTYLLRLINAALNDELFFSIANHTLTVVDVDAIYVKPFKTDTILITPGQTTNLLLKAKPHFPNATFLMAARPYATGRGTFDNSTVAGLLHYEPPQKSSPSASSFKNLPVFKPTLPPLNDTSFAANFTRKLRSLANSQFPANVPKKVDKRFFFTVGLGTSPCPQNQTCQGPNNSTKFSASVNNVSFVLPTTAILQAHFFQQSNGVYTTDFPATPIFPFNYTGTPPNNTMASNGTKVVVLPFNTTVELVLQDTSILGIESHPLHLHGFNFFVVGQGFGNFDSKKDPPKFNLVDPVERNTVGVPSGGWVAIRFVADNPGVWFMHCHLEVHTSWGLKMAWIVKDGKLPNQKLPPPPSDLPQC

SEQ ID NO: 9638 - protein, 573 aa, Vitis vinifera
  misc_feature (114)..(114): Xaa can be any naturally occurring amino acid
MFRVLFLVLNSLWLFPELASAGITRHYKFNIKLQNVTRLCHTKNIVSVNGQFPGPRIIAREGDRVVVNVVNHVPNNVTIHWHGVRQLRSGWADGPAYVTQCPIQTGQTYVYNFXITGQRGTLFWHAHMSWLRSTVYGPIIILPKKNVPYPFVKPYKEVPIIFGEWWNADPEAVITQALQNGGGPNVSDAYTINGLPGPLYNCSAQDTFKLKVKPGKTYLLRLINAALNDELFFSIANHTLTVVDVDAIYVKPFKTDTILITPGQTTNLLLKAKPHFPNATFLMAARPYATGRGTFDNSTVAGLLHYEPPQKSSPSASSFKNLPVFKPTLPPLNDTSFAANFTRKLRSLANSQFPANVPKKVDKRFFFTVGLGTSPCPQNQTCQGPNNSTKFSASVNNVSFVLPTTAILQAHFFQQSNGVYTTDFPATPIFPFNYTGTPPNNTMASNGTKVVVLPFNTTVELVLQDTSILGIESHPLHLHGFNFFVVGQGFGNFDSKKDPPKFNLVDPVERNTVGVPSGGWVAIRFVADNPGVWFMHCHLEVHTSWGLKMAWIVKDGKLPNQKLPPPPSDLPQC

SEQ ID NO: 9639 - protein, 574 aa, Vitis vinifera
  misc_feature (15)..(15): Xaa can be any naturally occurring amino acid
  misc_feature (297)..(297): Xaa can be any naturally occurring amino acid
  misc_feature (325)..(325): Xaa can be any naturally occurring amino acid
MGASLLSSTAIFRVXFIVLNTLWLFPELASSAGITRHYKFNIKLQNVTRLCHTKSIVSVNGQFPGPHIIAREGDRVVVKVVNHVQNNVTIHWHGVRQLRSGWADGPAYVTQCPIQTGQTYVYNFTITGQRGTLFWHAHISWLRSTLYGPIIILPKKNVPYPFFKPYKEVPIIFGEWWNADPEAVITQALQNGGGPNVSDAYTINGLPGPLYNCSAQDTFKLKVKPGKTYLLRLINAALNDELFFSIANHTLTVVDVDAIYVKPFKTDTILITPGQTTNLLLKAKPHFPNATFLMAAXPYATGRGTFDNSTVAGILHYEPPPKSSXSASSFKNLPLFKPTLPPLNDTSFAANFTGKLRSLANTQFPANVPQKVDQRFFFTNQTCQGPTNITMFSASVNNVSFVLPTTAILQAHFFQQSKGVYTTDFPTTPIFPFNYTGTPPNNTMVSNGTKVVVLPFNTSVELVLQDTSILGIESHPLHLHGFNFFVVGQGFGNFDSKKDSPKFNLVDPVERNTVGVPSGGWVAIRFLADNPGVWFMHCHLEVHTSWGLKMAWIVMDGKLPNQKLPPPPSDLPKC

SEQ ID NO: 9640 - protein, 583 aa, Vitis vinifera
MGASLLQSTAMLRFLFLVLNTLLVVPELASAGITRHYKFNIKLHSVTRLCHTKSIVSVNGQFPGPRIIAREGDRVVVTVVNNVQNNVTIHWHGIRQLQSGWADGPAYVTQCPIQTGQSYVYNFTITGQRGTLFWHAHISWLRSTVYGPIIILPKKNVPYPFAKPYKEVPIIFGEWWNADPEAVITQALQNGGGPNVSDAYTINGLPGPLYNCSAQDTFKLKVKPGKTYLLRLINAALNDELFFSIANHTLTVVDVDAIYVKPFKTDTILITPGQTTNLLLKAKPHFPNATFLMAARPYATGRGTFDNSTVAGLLHYEPPSKSSPSASSFKNLPVFKPTLPPLNDTSFAANFTRKLRSLANSEFPANVPKKVDKRFFFTVGLGTNPCPQNQTCQGPSNNTKFSASVNNVSFVLPTTAILQAHFFQQSKGVYTTDFPTTPTFPFNYTGTPPNNTMVSNGTKVVVLPFNTSVELVLQDTSILGIESHPLHLHGFNFFLVGQGFGNFDSKKDPPKFNLVDPVERNTVGVPSGGWVAIRFFADNPGVWFMHCHLEVHTSWGLKMAWIVTDGKLPNQKLPPPPSDLPQC

SEQ ID NO: 9641 - protein, 567 aa, Glycine max; identical to SEQ ID NO: 9612

SEQ ID NO: 9642 - protein, 585 aa, Medicago truncatula; identical to SEQ ID NO: 9615

SEQ ID NO: 9643 - protein, 584 aa, Glycine max; identical to SEQ ID NO: 9613

SEQ ID NO: 9644 - protein, 581 aa, Medicago truncatula
MGFSLFSSLKIQVFIFSLINFGFFEVALASTTRHYHFDIRYENVTRLCHKKSMVTVNGQFPGPRIVAREGDRLIIKVVNHVQNNISIHWHGIRQLQSGWADGPAYVTQCPIQTGQSYVYNYTIKGQRGTLFWHAHISWLRSTLYGPLIILPKKNVQYPFAKPHKEVPIIFGEWFNTDPEAIIAQALQTGGGPNVSDAYTINGLPGPLYNCSAKDTFKLKVKPRKTYLLRLINAALNDELFFSIANHTLTVVEADAVYAKPFVTNTILIAPGQTTNVLLKTKPHYPNATFLMLARPYATGQGTFDNSTVAGIIEYEIPFNTHHSNSSLKKLPLLKPILPQLNDTSFATNFTNKLHSLANAQFPANVPQKVDKHFFFTVGLGTNPCQNKNQTCQGPNGTMFAASVNNVSFIMPTTALLQTHFFGQNNGIYTTDFPSKPMNPFNYTGTPPNNTMVSNGTKVVVLPFNTSVELVLQDTSILGVESHPLHLHGFNFFVVGQGFGNFDSNSDPQNFNLVDPVERNTVGVPSGGWVAIRFLADNPGVWFMHCHLEIHTSWGLKMAWIVLDGKLPNQKVLPPPVDLPKC

SEQ ID NO: 9645 - protein, 572 aa, Glycine max
FFLFLSFFIFIFLLPFMLWRSTTRHYHFEIRHQNVTRLCHTKSMVTVNGQFPGPRIVAREGDRLLIKVTNHVSNNITIHWHGIRQLQSGWADGPAYVTQCPIQRGQSYVYNYTIVGQRGTLWWHAHISWLRSTLYGPLIILPKLNAQYPFAKPHKEVPIVFGEWWNADPEAVITQALQTGGGPNVSDAYTINGLPGPLYNCSDKDTFKLKVKPGKIYLLRLINAALNDELFFSIANHTLTVVEADAVYVKPFATNTILITPGQTTNVLLKTKSHYPNATFLMTARPYASGLGTFDNTTVAGILQYKTPPNTHHSAASLKNLPLLKPILPALNDTSFATKFNNKLRSLASAQFPANVPQKVDTHFFFTVGLGTTPCPQNQTCQGPTNATKFAASVNNVSFIQPTTALLQTHFFGQSNGVYTADFPAKPLIPFNYTGTPPNNTMVSNGTKVVVLPFNTSVELVMQDTSILGAESHPLHLHGFNFFAVGQGFGNFDPNKDPANFNLLDPIERNTVGVPSGGWVAIRFLADNPGVWFMHCHLEVHTSWGLKMAWVVLDGKLPNQKLFPPPADLPKC

SEQ ID NO: 9646 - protein, 579 aa, Glycine max
MGAPIKSFALPAMLLFSMIIIPQLALGGITRHYHFDIKYQNVSRLCHTKSVVTVNGQFPGPRIVAREGDNLLIKVTNHVQNNISIHWHGIRQLRSGWADGPAYVTQCPIQTGQSYVYNYTVVGQRGTLWWHAHISWLRSTLYGPLIILPQYGVPYPFTKPYKEVPIIFGEWWNADPEAVITQALQTGGGPNVSDAYTINGLPGPLYNCSAKDTFKLKVKPGKTYLLRLINAALNDELFFSIANHTLTVVDVDAIYVKPFDTDTILISPGQTSNVLLKTKSHYPNATFLMSARPYATGQGTFDNSTVAAILEYEVSPHALHSTTSIKKLSLFKPILPALNDTSFATNFSNKLRSLASAQFPANVPQKIDKHFFFTVGLGTTPCSQNQTCQGPTNSTKFAASVNNVSFIQPTTALLQSHFFGQSNGVYSPYFPISPLIPFNYTGTPPNNTMVSNGTKVVVLPFNTSVELVMQDTSILGAESHPLHLHGFNFFVVGQGFGNFDPNKDPANFNLVDPVERNTVGVPSGGWVAIRFLADNPGVWFMHCHLEVHTSWGLKMAWIVLDGELPNQKLLPPPADLPKC

SEQ ID NO: 9647 - protein, 570 aa, Glycine max
MKLSVFWFAWAFSLLISMASAATVEHTFIVQNKAVTRLCKERVIVTVNGLYPGPRIDVREGDAVVVHVINKSPYNITIHWHGVFQLFSAWADGPEYITQCNIRPQNSYTYKFNVIQQEGTLWWHAHSGVLRATVHGAFIIHPRSGLFPFPKPHKQVPIILGDWYDGNIVDIYQQVLLLGDVRPSAAYTINGLPGDLYNCSRNQMFKLKVKPGKTYLLRMINAAFNNNLFVKIANHSFTVVAMDASYIEPYVTDIITIAPGQTADVLFKADQPIGSYYMAASPYVVGQPEALFDTTTTRGIVAYEGYTTSLKDSKPIVPLLPPFNATPIAHKFFSNITSLVGAPHWAPVPLEVDQHMFITININLERCPKNGTCQGVFGQKFSASMNNESFVHPVGKGYSMLEASFYNVSGVYTTDFPDKPPIIFDFTNPKIALDTKYLFTPPKSNKVKKLKFNSTVEVVFQNTQIMNAQSHPMHLHGFSFHVLAQDFGNFNYTKDKYKFNLVNPIFRNTIAVPAGGWAVIRFKANNPGMWFVHCHVDDHQLWGLDMVFEVENGPTPSTSLPPPPADLPKC

SEQ ID NO: 9648 - protein, 571 aa, Glycine max
MKLSVFWFAWAFALLVSMASAATVEHTFIVQNKAVTRLCKERVIVTVNGLYPGPRIDVREGDAVIVHVINKSPYNITIHWHGVFQLFSAWADGPEYITQCNIRPQKSYTYKFNVIQQEGTLWWHAHSGVLRATVHGAFIIHPRSGLFPFPKPYKQVPIILGDWYDGNVVDIYQQVLLLGDVRPSAAYTINGLPGDLYNCSRNQMFKLKVRPGKTYLLRMINAAFNNNLFVKIANHSFTVVAMDASYIEPYATDIITIAPGQSADVLFKANQPIGSYYMAASPYVVGQPEVLFDTTTTRGIVVYEGYKTSSKNYSKPIVPILPHFNDTPIAHKFFSNITSLMGAPHWVPVPLEVDEHMFITININLERCPKNGTCQGVFGQKFSASMNNESFVHPVGKGYSMLEASFYNVSGVYTTDFPDKPPIIFDFTDPKIALDTKYLFTPPKSTKVKKLKFNSTVEVVFQNTQIMNAQSHPMHLHGFSFHVLAQDFGNFDYTKDKHKFNLVNPIFRNTIAVPAGGWAVIRFQANNPGMWFVHCHVDDHQLWGLDMVFEVENGPTPSTSLPPPPADLPKC

SEQ ID NO: 9649 - protein, 572 aa, Glycine max
MKLFVFFLAWAMALLASSFASAAVVERTFKVQNKTIKRLCNERVIVTVNGTFPGPKINVREGDTVIVHLLNEGPYNITIHWHGVFQLFSAWADGPEYVTQCTISPGTKYTYKFNVTQQEGTLWWHAHASVLRATVHGAFIIHPRSGQFPFPKPFKQVPIILGDWYDANVVDVETQALASGGPPNVSNAFTINGLPGDLFNCSRTQTFKMKVKQGKTYMLRMINAALNNHLFFKIANHTFTVVALDAAYTDHYITEIIVIAPGQTIDALFTANQPLGSYYMAASPYSIGVPVIDNTTTRGIVVYDYAPPPSSSKPLMPTLPPINDTATAHKFYSNITGKVGAPHWVPVPAKVDEHMFITIGLNLDTCDPKNATNATCQGPSGQRFSSSMNNESFVIPKGRGFSMLEAFFKNVSGVYTADFPNNPPVMFDFTNPNISFNPNLLFAPKSTKSKKLKFNSTVEIVFQNTAIVGVQNHPIHIHGFSFHVLAQGFGNFNSTVDSTKFNLVNPQLRNTIAVPVGGWAVIRFQANNPGVWFVHCHVEDHVPWGLDMAFEVENGPTSSTSLPPPPVDLPKC

SEQ ID NO: 9650 - protein, 571 aa, Pisum sativum
MKILMLWLTWALALSFSSMVSAAIVERTFTIQNKTIKRLCHEQVIVTVNGLYPGPNMEVREGDSVIVHVINNSPYNITIHWHGVFQLLSAWADGPEYITQCSIRPENKYTYKFKVTQQEGTVWWHAHASALRATVHGAFIIQPRSGRFPFPKPYKEVPIILGDWYDGNVEDIVRKELETGDKISSDAFTINGFPGDLFNCSKNDVYNLRVKQGKTYLFRMVNAALNNNLFFKIANHNFTVVALDAAYTEPYNTDIIVLAAGQTADVLFTADQRKGPYFMAASPYVLGEPAPLFDNTTTRGIVVYDGYKKSKSSQLKPLMPALPLHNNTPIAHKFFSNITSLVKAPHWVPVPLEVDEHMYITINMALQPCPKNAKCTGPLGQKFSASMNNESFLLPVGKGFSIMEAYFYNVSGLYTTDFPNNPPKIFDFTNPKIFFDANVTFAPKSTKVKKFKFNSTVEIVFQNTAILNAQSHPMHLHGMNFHVLAQGFGSFDPKRDKLKYNLVNPLIHNTVAVPVGGWAAIRFRTNNPGVWFLHCHVDDHNLWGLVTAFIVENGPTPSTSLPPPPADLPKC

SEQ ID NO: 9651 - protein, 1750 aa, Glycine max; identical to SEQ ID NO: 6477

SEQ ID NO: 9652 - protein, 575 aa, Medicago truncatula; identical to SEQ ID NO: 9600

SEQ ID NO: 9653 - protein, 574 aa, Glycine max; identical to SEQ ID NO: 9610

SEQ ID NO: 9654 - protein, 557 aa, Medicago truncatula; identical to SEQ ID NO: 9626

SEQ ID NO: 9655 - protein, 557 aa, Glycine max; identical to SEQ ID NO: 9624

SEQ ID NO: 9656 - protein, 560 aa, Populus trichocarpa
MEYACWLRFMLLAVCLFPALVQCRVRHYKFNVVMKNTTRLCSRKPIVTVNGRFPGPTLYAREHDTVLVKVVNHVKYNVSIHWHGIRQLRTGWADGPAYITQCPIQPGQSYVYNFTITGQRGTLLWHAHILWLRATVHGALVVLPKRGIPYPFPAPHKEVVVVLVAAEWWKSDTEAVINEALKSGLAPNVSDAHTINGHPGAVSACSSQGGFTLPVKSGETYMLRLINAALNEELFFKIAGHKLTVVEVDATYVKPFKTDTVLIAPGQTTNVLVTTNKNTGKYLVAASPFMDSPIAVDNMTATATLQYSGALANSPTTLTTPPPKNATAVANQFTNSLRSLNSRRFPAKVPLNVDHNLFFTVGLGVNPCPSCKAGNGSRVVASINNVTFVMPTTALLQAHFLNISGVFTTDFPAKPPHVFNYTGTPPTNLQTKSGTKVYRLSYNSTVQLVMQDTGIISPENHPIHLHGFNFFAVGRGVGNYNPKTDTKKFNLVDPVERNTIGVPSGGWVAIRFRADNPGVWFMHCHLEVHTTWGLKMAFLVDNGKGPKESLLPPPSDLPKC

SEQ ID NO: 9657 - protein, 557 aa, Glycine max; identical to SEQ ID NO: 9625

SEQ ID NO: 9658 - protein, 566 aa, Vitis vinifera; identical to SEQ ID NO: 9621

SEQ ID NO: 9659 - protein, 611 aa, Vitis vinifera
  misc_feature (597)..(597): Xaa can be any naturally occurring amino acid
MGVSFLPSPPFVGVFVFSCMALCLLPELALAQDSGITRHYKFDIKLQNVTRLCHTKSILTVNGQFPGPRIVAREGDRLLIKVVNHVQNNISIHWHGIRQLRSGWADGPAYVTQCPIQTGQSYVYNFTVVGQRGTLFWHAHISWLRSTLYGPLIILPKRNVPYPFEKPHKEVPIIFGEWWNADTEAVISQALQTGGGPNVSDAYTINGLPGPLYNCSAKDTFKLRVKASKTYLLRLINAALNDELFFSIANHTLTVVDADAIYVKPFETDTLLIAPGQTTNVLLKTKPHFPNAAFLITARPYVTGLGTFDNSTVAGILEYELPSASPHSTVSIKKLPLFKPTLPPLNDTSFATNFTNRLRSLASPQFPANVPQKVDRHFFFTIGLGTSPCDQNQTCQGPNGTKFAASVNNVSFASSTTALLQAHFSGQSNGVYNPDFPITPIIPFNYTGTPPNNTLVSNGTKVVVLPFNTSVELVMQDTSILGAESHPLHLHGFNFFVVGQGFGNYDPNKDPANFNLVDPIERNTVGVPSGGWVAIRFLADNPANDNGDKYVGNRGMVHALSPGNPHQLGLEDGVGCLRWKAPQSEAASSTSRSSQVXILTHSCIHTDHKLP

SEQ ID NO: 9660 - protein, 567 aa, Glycine max
MLLFSMIIIPQLALGGITRHYHFDIKYQNVSRLCHTKSVVTVNGQFPGPHIVAREGDRLLIKVTNHVQNNISIHWHGIRQLRSGWADGPAYVTQCPIQTGQSYVYNYTIFGQRGTLFWHAHISWLRSTLYGPIIILPKQGAPYPFTKPYKEVPIIFGEWWNTDPEAVITQALQTGGGPNVSDAYTINGLPGPLYNCSAKDTFKLKVKPGKTYLLRLINAALNDELFFSIANHTLTVVDVDAIYVKPFDTDTILIAPGQTSNVLLKTKSHYPNATFFMSARPYATGQGTFDNSTVAAILEYEVPPHFVHSTTSVKKLSLFKPILPALNDTSFATNFANKLHSLASAQFPANVPQKVDKHFFFTVGLGTTPCPQNQTCQGPTNATKFAASVNNVSFIQPTTALLQAHFFGQSNGVYSPYFPISPLVPFNYTGTPPNNTMVSNGTKVVVLPFNTSVELVMQDTSILGAESHPLHLHGFNFFVVGQGFGNFDPKKDPANLNPVDPVERNTVGVPSGGWVAIRFLADNPGVWFMHCHLEVHTSWGLKMAWIVLDGELPNQKLLPPPADLPKC

SEQ ID NO: 9661 - protein, 581 aa, Populus trichocarpa
MGASFLPSPAFLAVFLISFVTLSIHPEPALAITRHYKFDVMLQNVTRLCHTKSIVTVNGKFPGPRIVAREGDRLLIKVVNHVQNNISIHWHGIRQLRSGWADGPAYITQCPIQTGQSYVYNYTIVGQRGTLWWHAHISWLRSTLYGPLIILPKLGTTYPFAKPHKEVPIIFGEWFNADPEAIINQAMQTGGGPNVSDAYTINGFPGPLYNCSAKDTFKLKVKPGKTYLLRMINAALNDELFFSIANHTLTVVDVDAIYVKPFDTETLLIAPGQTTNVLLKTKPHHPNASFFMSARPYVTGQGTFDNSTVAGILEYEESNKTIKSSHSPKKLPFYKPNLPPLNDTSFATNFTSKLRSLASAEFPANVPQKVDRQFFFSVSLGTNPCSKNKTCQGPNGTMFAASVNNVSFVMPTKALLQAHHFGQSKGVYSPNFPINPLIPFNYTGTPPNNTMVSNGTKLVVLPFNTSVELIMQDTSILGAESHPLHLHGFNFFVVGEGFGNFDPKKDPANFNLVDPVERNTVGVPSGGWVAIRFLADNPGVWFMHCHLEVHTSWGLKMAWVVLDGKLPNQKLLPPPADLPKC

SEQ ID NO: 9662 - protein, 581 aa, Populus trichocarpa
MGVSFLPSPAFLGLLLFSFVTLSLHPKPAVATTRHYKLDVMLQNVTRLCHTKSMVTVNGKFPGPRIVAREGDRLLIKVVNHVQNNISIHWHGIRQLRSGWADGPAYVTQCPIQTGQSYVYNYTIVGQRGTLWWHAHISWLRSTLYGPLIILPKLGTPYPFVKPYKEVPIIFGEWFNADPEAIINQALQTGGGPNVSDAYTINGLPGPLYNCSAKDTFKLKVKPGKTYLLRLINAALNDELFFSIANHTFTVVEADAVYVKPFDTKTLLIAPGQTTNVLLKTKPHHPNAKFFMTARPYVTGQGTFDNSTVAGILEYEESHKTIQSSHSTKRLPLFKPNLPPLNDTSFATKFTSKLRSLANAQFPANVPQKVDRQFFFTVGLGTHSCPQNQTCQGPNGTMFAASVNNVSFAMPTTALLQAHHFGQSNGVYTPDFPINPLTPFNYTGNPPNNTMVSNGTKLVVLPFNTTVELIMQDTSILGAESHPLHLHGFNFFVVGQGFGNFDPNKDPANFNLIDPIERNTVGVPSGGWVAIRFLADNPGVWFMHCHLEVHTSWGLKMAWVVLDGKLPNQKLLPPPADLPRC

SEQ ID NO: 9663 - protein, 576 aa, Ricinus communis
MGSPFLLPKPSFLGVSLFILVTFCLLPEPAFGRTRHYKFDIKLQNVTRLCHTKSIVTVNGMFPGPRIVAREGDNLLIKVVNHVQNNISLHWHGIRQLRSGWADGPAYITQCPIQTGQHYLYNYTVVGQRGTLWWHAHISWLRSTLYGPIIIFPKRGVPYPFAKPYKEVPITFGEWFNADTETIIKQALQTGGGPNVSDAYTINGLPGPLYNCSAKDTFKLKVKTGKTYMLRLINAALNDELFFSIANHTLTVVDVDAVYVKPFETKILLIAPGQTTNVLLKTKPSFPNAAFFMTARPYVTGQGTFDNSTVAGILEYEPSTLSNKKLPLFKPSLPALNDTAFATNFTNRLRSLASAQFPANVPQVVDKQFFFTVGLGTNPCPKNQTCQGPNGTKFAASINNISFAMPTTALLQAHYSGQSKGVYSPYFPISPIIPFNYTGNPPNNTMVSNGTKLVVLSYNTSVELILQDTSILGAESHPLHLHGFNFFVVGQGFGNFDPKKDPAKYNLIDPVERNTVGVPSGGWVAIRFRADNPGVWFMHCHLEVHTSWGLKMAWVVLDGKLPNQKLRPPPADLPKC

SEQ ID NO: 9664 - protein, 579 aa, Glycine max
MDSPHFPSFASLRVLLFGFCVITLFPEFVVSITRHYTFNVEYLNVTRLCHTRNILSVNGKFPGPRLVAREGDRVVVKVVNHVSNNVSIHWHGIRQITTGWADGPAYVTQCPIQTNQSYTYNFTIVGQRGTLLWHAHISWLRATIYGPIIILPKHNESFPFEKPHKEIPILFGEWFNVDPEAVISQALQTGGGPNVSDAYTINGLPGPLYNCSSKDTYTLKVKPGKTYLLRLINAALNEELFFSIANHTLTVVEADARYTKPFDTDTLLIAPGQTTNVLLKTKPYFPNATFQMSARPYFTGRGTFDNSTTAGTLIYKQPLKNSSVKNLTLLKPTLPPINATSFVANFTAKFRSLASAKFPAKVPQKVDRKFFFTVGLGTSPCPKNTTCQGPSNNTKFAASVNNISFALPSSVSIMQAYYSGQANGVFKTDFPATPLNPFNYTGTPPNNTMVTNDTKLVVLKFNTSVEVVLQDTSILGAESHPLHLHGYDFFIVGQGFGNYDPNNDPAKFNLIDPVERNTVGVPAGGWIAFRFLADNPGVWFMHCHLDLHTSWGLRMAWLVLDGPGPKQKLQPPPSDLPKC

SEQ ID NO: 9665 - protein, 576 aa, Glycine max
MDFPHFPSFASLRVLLFCFCVMTLFPEFVVSITRHYTFNVEYLNVTRLCHTRNILSVNGKFPGPRLVAREGDRVVVKVVNHVSNNVTIHWHGIRQMTTGWADGPAYVTQCPIQTNQSYTYNFTIVGQRGTLLWHAHISWLRATIYGPIIILPKQNESYPFEKPHKEIPILFGEWFNVDPEAVISQALQTGGGPNVSDAYTINGLPGPLYNCSSKDTYTLKVKPGKTYLLRLINAALNEELFFSIANHTLTVVEADAKYTKPFDTDTLLIAPGQTTNVFLKTKPYFPNATFQMAARPYFTGRGTFDNSTTAGTLIYKQHSNVKNLTLLKPTLPPINATSFVANFTAKFRSLASAKFPVKVPQKVDRKFFFTVGLGTNPCPKNTTCQGPSNNTKFAASVNNISFALPSSVSIMQAYYSSQANGVFKTDFPATPLNPFNYTGTPPNNTMVTNDTKLVVLKFNTSVELVLQDTSILGAESHPLHLHGYDFFVVGQGFGNYDPNNDPARFNLIDPVERNTAGVPAGGWIAIRFFADNPGVWFMHCHLDLHTSWGLRMAWLVLDGPEPNQKLQPPPSDLPKC

SEQ ID NO: 9666 - protein, 580 aa, Populus trichocarpa
MGNSPRSTVLPSMAALQLLCFFFFSLVPDFAAAITRQYTFNITHKNFTRLCHTRSLVTVNGQFPGPRLVAREGDQVLVKVVNHVAENITIHWHGVRQLTTGWADGPAYVTQCPIQTGQAYTYNFTITGQRGTLLWHAHISWLRSSLYGPIIILPKLNESYPFKKPYKEIPILFGEWFNVDPEAVIAQALQTGAGPNVSDAYTINGLPGPLYNCSAKDTYKLKVKPGKTYLLRLINAALNDELFFSIANHTLTVVEADAVYVKPFEADTLLISPGQTTNVLLKTKPHLPNATFYMFAGPYFSGMGSFDNSTTAGVLVYKHPSSNNHLKKLPTLKPTLPPINATGFVANFTKKFRSLANAKFPANVPQTVDRKFFFTVGLGTNPCPKNTTCQGPNNNTKFAASINNVSFVLPSVALLQSYFFGQSNGVFTSDFPQNPTIPFNYTGTPPNNTMVSNGTKAVVLTFNTSVELVMQGTSIVAAESHPLHLHGFNFFVVGQGFGNYDPNKDPSNFNLVDPMERNTAGVPAGGWIAIRFLADNPGVWFMHCHLDVHTSWGLRMAWIVLDGPQPNQKIPPPPSDLPKC

SEQ ID NO: 9667 - protein, 577 aa, Ricinus communis
MGNSHRSSFPSMAAALAFTFCILSLLPNFAVAVTRHYTFNIVNQTITRLCHTRSVLTVNGKFPGPRLVAREGDRVIIKVVNHVSSNVTIHWHGIRQLTTGWADGPAYITQCPIQTGQSYTYNFTITGQRGTLLWHAHISWLRSSLYGPIIIFPRRNESYPFQKPYKEIPILLGEWFNVDPEAVIAQALQIGAGPNVSDAYTINGLPGPLYNCSSKDTFKLKVKPGKTYLLRIINAALNDELFFSIASHTLTVVEADAIYTKPFETDTLLITPGQTTNVLLKTKPSLPNATYLMAARPYFTGQGTFDNSTAAAILEYKHPSNISRQLPLFKPTLPPINATGFVANITRRFRSLANAKFPANVPQNVDRKFFFTVGLGTNPCPANTTCQGPTNTTKFSASINNVSFLMPSVSLLQSYYFGKSNGIFTADFPQNPPTPFNYTGTPPNNTNVSNGTRALMLRFNTSVELVMQDTSILGAESHPLHLHGFNFFVVGQGFGNYNSNKDPANFNLVDPMERNTVGVPAGGWVAIRFLADNPGVWFMHCHLDVHTSWGLRMAWLVLNGPQPNQKLQPPPSDLPKC

SEQ ID NO: 9668 - protein, 580 aa, Populus trichocarpa
MGNSPRSTVLPSMAALQLLCFFFFSLVPDFAAAITRQYTFNITHKNFTRLCHTRSLVTVNGQFPGPRLVAREGDQVLVKVVNHVAENITIHWHGVRQLTTGWADGPAYVTQCPIQTGQAYTYNFTITGQRGTLLWHAHISWLRSSLYGPIIILPKLNESYPFKKPYKEIPILFGEWFNVDPEAVIAQALQTGAGPNVSDAYTINGLPGPLYNCSAKDTYKLKVKPGKTYLLRLINAALNDELFFSIANHTLTVVEADAVYVKPFEADTLLISPGQTTNVLLKTKPHLPNATFYMFAGPYFSGMGSFDNSTTAGVLVYKHPSSNNHLKKLPTLKPTLPPINATGFVANFTKKFRSLANAKFPANVPQTVDRKFFFTVGLGTNPCPKNTTCQGTNNNTKFAASINNVSFVLPSVALLQSYFLWTVNGVFTSDFPQNPTIPFNYTGTPPNNTMVSNGTKAVVLTFNTSVELVMQGTSIVAAESHPLHLHGFNFFVVGQGFGNYDPNKDPSNFNLVDPMERNTAGVPAGGWIAIRFLADNPGVWFMHCHLDVHTSWGLRMAWIVLDGPQPNQKIPPPPSDLPKC

SEQ ID NO: 9669 - protein, 580 aa, Populus trichocarpa
MGASILPPPAFRALLFSFSIFCLLPEHAFAVTRHYKFDIKLQNVTRLCHSKSMVTVNGQFPGPRIVAREGDNLFIKVVNHVQNNISIHWHGIRQLQSGWADGPAYITQCPIQTGQSYVYNYTIVGQRGTLWWHAHISWLRSTVYGPLIILPKRGVQYPFAKPYKEVPIIFGEWFNVDPEAVISQALQTGGGPNVSDAYTINGLPGPLYNCSAEDTFKLKVKPGKTYMLRLINAALNDELFFSIANHSVTIVDVDAVYVKPFDTETLLITPGQTTNVLLKTKPYFPNATFFMTARPYATGQGTFDNSTVAAILEYESPKTIHSSQLSLKNLPLFKPTLPPLNDTAFAANFTSKLRSLASAQFPAKVPQKVDMRFFFTVGLGTNPCPKNQTCQGPNGTKFAASVNNVSFSLPTTALLQAHFFGKSNGVYIPDFPITPIFPFNYTGNPPNNTMVSTGTRLVVLPFNTSVELIMQDTSILGVESHPLHLHGYNFFVVGQGFGNFDPNKDPAKFNLVDPVERNTVGVPSGGWAAIRFQADNPGVWFMHCHLEVHTSWGLEMAWVVLDGKLPNQKLIPPPADLPKC

SEQ ID NO: 9670 - protein, 615 aa, Glycine max
MQLKIFLYLRLFLCSMLKAKLPNINVSVKGEMGIAYLNMPGFMRAMFIMLCAMMILPELTHAKHARVTRHYKFNIKMQNFTRLCQTKSIVTVNGRFPGPRIIAREGDRIVVKVVNHVQYNVTLHWHGIRQLKSAWADGPAYITQCPIQTGQSFVYNFTVIGQRGTLWWHAHISWLRTTLYGPIVILPKRHVPYPFPQPFREVPIILGEWWKADTEAVINQAMQTGLAPNISDVHTINGLPGPVSNCAAKETFQLKVKPGKTYLLRLINAALNDEMFFSIANHTLTMVEADAVYVKPFSTKIVLITPGQTVNVLLKAKSKAPNGTFAISTRPYATGPASFDNTTATGFLEYKKTSHASNKSNTKKLPLLRAVFPKFNDTVFAMNFHNKVRSLANARFPAKVPKTVDRHFFFTVGLGISKCSKNQQCQGPNNTRVAAAVNNVTFVTPNIALLQAHFFNKSKGVYTTDFPSNPPFKFNYTGTPPSNIFVSSGTKTVVLPYNTSVELVLQDTSIIGAESHPLHLHGFNFFIVGQGNGNFDPKKDPIKFNLVDPAERNTAGVPSGGWVAVRFLADNPGVWFMHCHLEVHTSWGLKMAWIVQDGKRRNQKLPPPPSDLPKC

SEQ ID NO: 9671 - protein, 584 aa, Glycine max
MGCAYLNMPGFMRAMFVVLCALMILPELTHAKHARVTRHYKFNIKMQNFTRLCQTKNIVTVNGRFPGPRIIAREGDRIMVKVVNHVQYNVTLHWHGIRQLKSAWADGPAYITQCPIQTGQSFVYNFTVIGQRGTLWWHAHISWLRTTLYGPIVILPKRHVPYPFPQPFREVPIILGEWWKADTEAVINQAMQTGLAPNVSDAHTINGLPGPVSNCAAKETFKLKVKPGKTYLLRLINAALNDEMFFSIANHTLTMVEADAVYVKPFSTKVVLITPGQTVNVLLKAKSKAPNATFAISTRPYATGPAAFDNTTATGFLEYKKPSLASSKSNTKKLPLLRAVFPKFNDTVFAMNFHNKVRSLASARFPAKVPKTVDRRFFFTVGLGISQCSKNQQCQGPNNTRVAAAVNNVTFVTPNIALLQAHFFNKSKGVYTTDFPANPPFKFNYTGTPPSNIFVSSGTKAVVLPYNTSVELVLQDTSIIGAESHPLHLHGFNFFIVGQGNGNFDPKKDPKKFNLVDPAERNTAGVPSGGWVAVRFLADNPGVWFMHCHLEVHTSWGLKMAWIVQDGKRRNQKLPPPPSDLPKC

SEQ ID NO: 9672 - protein, 581 aa, Glycine max
MELASFCSLRAIFLFSCALWIMPELTLAKHAKITRHYNFNVQLQNVTRLCQTKSIVTINGRFPGPRVIAREGDRLVIKVTNNVPYNVTIHWHGVRQLRSAWADGPAYVTQCPIQTGQTFVYNFTVTGQRGTLWWHAHISWLRTTLYGPIVILPKKHVPYPFPQTFKEVPIIFGEWWKADTETVINQAMQTGLAPNLSNAYTINGFPGFLYNGTTKDTFKLKVKAGKTYLLRLINAALNNELFFGIANHTLTVVEADAVYVKPFRTNYVLITPGQTINVLLKTKSKAPNAAFVIAARPYATGPAAFDNTTATGLLEYKKSSVSNTKTKNKKLRLLRPVLPKFNDTIFAMKFNKKVRSLANARFPAKVPKTVDKHFFFTVGLGISSCPKNQACQGPNNTRVTAAVNNVSFVMPNIALLQAHFFNKSKGVYTTDFPANPPFRFNYTGTPPNNIMISSGTKAVVLPFNASVELILQDTSIIGAESHPLHLHGFNFFVVGQGNGNFDPKKDPSKFNLVDPAERNTIGVPSGGWVAVRFFADNPGVWFMHCHLEVHTSWGLKMAWIVQDGKLHHQKLPPPPSDLPKC

SEQ ID NO: 9673 - protein, 579 aa, Populus trichocarpa
MGSAFLRILVTALCALWIFSELVVAKHAGITRHYKFDIKLQNVTRLCRTKSIVTVNGQIPGPRIIAREGDRLLIKVVNHVQYNVTLHWHGIRQLRSGWADGPAYVTQCPIQTGQSYVYNFTVTGQRGTLFWHAHISWLRATLYGPIVILPKKGVSYPFPLPHKEVPIIFGEWWKADTEKIISQALKTGGAPNISDAYTINGHPGLLYNCSAKDTFKLKVKPGKTYLLRLINAALNDELFFSIANHSLTVVEADAVYVKPFKTHIVLITPGQTTNVLLMAKAKAPNSTFLMAARPYATGPGSFDNTTTAGILEYDQNPSATNSKSKNKKLPLLKPSLPVFNDTTFATKFVKKIRSLANARFPAKVPKKVDRRFFFTIGLGSLPCSQNKTCQGPNNTMFAASVNNVSFVQPNIALLQSHFLNRSKGVYTTDFPTNPPFKFNYTGTPPSNTMTAKGTKVVVLPFNTSVELVMQDTSIIGAESHPLHLHGFNFFVVGQGFGNFDPKKDPVKFNLVDPAERNTVGVPSGGWVAIRFLADNPGVWFMHCHLEVHTSWGLKMAWVVNDGKRPSQKLPPPPSDLPKC

SEQ ID NO: 9674 - protein, 585 aa, Ricinus communis
MGFNSHLTRAMLIRATVFALFSLCIFPEMIVAKHAGITRHYKFTIILQNVTRLCQTKSIVTVNGQFPGPRIIAREGDRLLIKVVNHVQYNVTLHWHGVRQLRSGWADGPAYIAQCPIQTGQSYVYNFTVTGQRGTLFWHAHISWLRASLYGPIVILPKKDASYPFPQPHKEVPIIFGEWWKADTEVIINQAMRTGGAPNVSDAFTINGLPGPLYNCSAKDTFKLKVKPGKTYMLRLINAALNDELFFSIANHTLTVVETDAVYVKPFKTHTVIITPGQTTNVLLKAKAKAPNATFLMAARPYATGPAAFDNTTTAGILEYENPSLSSSKNKSKKFPLLKPSLPMFNDTAFSMRFSKKVRSLATVKFPAKVPQKVDRHFFFTVGLGILPCSRNQTCQGPNNTRVAASINNVSFVQPNIALLQAHFFDQSKGVYTTDFPANPPFKFNYTGTPPTNIMATSGTKVVVLPFNTNVELVLQDTGIISAESHPLHLHGFNFFVVGQGFGNFDAKNDPAKFNLFDPAERNTIGVPSGGWVAIRFLADNPGAWFMHCHLEVHTSWGLKMAWIVTDGKRPHQKLPPPPSDLPKC

SEQ ID NO: 9675 - protein, 577 aa, Vitis vinifera
MGSGFVRVMLFAFCAFWVLPELVFAKHAGTTRHYKFDIKLQTVTRLCQTKSIVTVNGQFPGPRIIAREGDRVIIKVVNHVQNNITIHWHGIRQLRSGWADGPAYITQCPIQTGQSYVYNFTITGQRGTLFWHAHISWLRATVYGSLVILPKRGVPYPFPQPFKEVPIIFGEWWKADIETMINQAMQTGGAPNVSDAYTMNGLPGPLYNCSAKDAFRLKVKPGKTYLLRLINAALNDELFFSIANHTVTVVEVDAVYVKPFKTNTLVITPGQTTNILLKTKSHSPNATFLMAARSYATGPAAFDNSTTAGILEYEHKSSVSNTKNRKPSVLKPALPMFNDTIFAMKFSKKLRSLASNKFPAKVPQTVNRRFFFTVGLGLIQCSRNQACPGPNNTMVAAAINNVSFVQPSTALLQAHFFGKSKGVYTTDFPANPTFKFNYTGTPPSNILVNSGTKVVVLPFNTRVELVLQDTSIIGAESHPLHLHGFNFYVVGQGFGNFDPKKDPANFNLVDPIERNTVGVPSGGWVAIRFRADNPGVWFMHCHLEVHTSWGLKMAWVVTDGKRPNQKLPPPPSDLPKC

SEQ ID NO: 9676 - protein, 569 aa, Vitis vinifera
MLFALCALWNLPELVLAKHAGITRHYNFDIKLQKVTRLCQTKSIVTVNGQFPGPRIIAREGDRVLIKVVNNVQNNITIHWHGIRQLRSGWADGPAYVTQCPIQTGQSYVYNFTITGQRGTLFWHAHISWLRATLYGPLVILPKRGVPYPFPQPFKEVPIIFGEWWKADTETMINQAMQTGGAPNVSDAYTINGLPGPLYNCSAKDTFRLKVKPGKTYLLRLINAALNDELFFSIANHTVTVVEVDAVYVKPFKTNTLVITPGQTTNILLKTKSHSPNATFLMAARSYATGPAAFDNSTTAGILEYEHMSSMSNTKNKRPSVHRPALPTFNDTLFAMSFSKKLRSLATTKFPAKVPQTVSRRFFFTVGLGLIQCSRNQACPGPNNTMVAAAINNVSFVQPSTALLQAHFFGKSKGVYTTDFPANPPFKFNYTGTPPSNILVNSGTKVVVLPFNTRVELVLQDTSIIGAESHPLHLHGFNFHVVGQGFGNFDPKKDPSNFNLVDPIERNTVGVPSGGWVAIRFRADNPGVWFMHCHLEVHTSWGLKMAWVVMDGKRPNQKLPPPPADLPKC

SEQ ID NO: 9677 - protein, 577 aa, Vitis vinifera
MGSCIMRIIMFAVCAMWFLPDLVLAKHAGSTRHYKFDIKLQKVTRLCQSKNIVTVNGQFPGPRIIAREGDRVIIKVVNHVQNNITIHWHGIRQLRSGWADGPAYITQCPIQTGQSYLYNFTITGQRGTLFWHAHISWLRATVYGSLVILPKRGVPYPFPQPFKEVPIIFGEWWKADIETMINQAMQTGGAPNVSDAYTMNGLPGPLYNCSAKDTFRLKVKPGKTYLLRLINAALNDELFFSIANHTVTVVEVDAVYVKPFKINTLVITPGQTTNILLKTKSHSPNATFLMAARSYATGPAAFDNSTTAGILEYEHKSSVSNTKNRKPSVLKPALPMFNDTIFAMKFSKKLRSLASNKFPAKVPQTVNRRFFFTVGLGLIQCSRNQACPGPNNTMVAAAINNVSFVQPSTALLQAHFFGKSKGVYTTDFPANPPFKFNYTGTPPSNILVNSGTKVVVLPFNTRVELVLQDTSIIGAESHPLHLHGFNFYVVGQGFGNFDPKKDPANFNLVDPIERNTVGVPSGGWVAIRFHADNPGVWFMHCHLEVHTSWGLKMAWVVMDGKRPNQKLPPPPSDLPKC

SEQ ID NO: 9678 - protein, 584 aa, Vitis vinifera
MVYDFCFISLLDQCPSCCPGHGLAVFEMSSCFLRVMLFALCALWNLPELVLAKHAGITRHYNFDIKLQKVTRLCQTKSIVTVNGQFPGPRIIAREGDRVLIKVVNNVQNNITIHWHGIRQLRSGWADGPAYVTQCPIQTGQSYVYNFTITGQRGTLFWHAHISWLRATLYGPLVILPKRGVPYPFPQPFKEVPIIFGEWWKADTETMINQAMQTGGAPNVSDAYTINGLPGPLYNCSAKDTFRLKVKPGKTYLLRLINAALNDELFFSIANHTVTVVEVDAVYVKPFKTNTLVITPGQTTNILLKTKSHSPNATFLMAARSYATGPAAFDNSTTAGILEYEHMSSMSNTKNKRPSKLRSLATTKFPAKVPQTVSRRFFFTVGLGLIQCSRNQACPGPNNTMVAAAINNVSFVQPSTALLQAHFFGKSKGVYTTDFPANPPFKFNYTGTPPSNILVNSGTKVVVLPFNTRVELVLQDTSIIGAESHPLHLHGFNFHVVGQGFGNFDPKKDPSNFNLVDPIERNTVGVPSGGWVAIRFRADNPGVWFMHCHLEVHTSWGLKMAWVVMDGKRPNQKLPPPPADLPKC

SEQ ID NO: 9679 - protein, 576 aa, Glycine max; identical to SEQ ID NO: 9665

SEQ ID NO: 9680 - protein, 579 aa, Glycine max; identical to SEQ ID NO: 9664

SEQ ID NO: 9681 - protein, 548 aa, Glycine max
MLLLAAFLLPLSVEAMVRHYKFNVVQKNTTRLGSTKPIVTINGKFPGPTIYAREDDTVLVKVVNQVKYNVSIHWHGVRQLRTGWADGPAYITQCPILPSQAYVYNFTLTGQRGTLWWHAHILWLRATVHGALVILPKLGVPYPFPKPNMEQVIILSEWWKSDTEAVINEALKSGLAPNASDAHTINGHPGPIQGYASQGGYKLDVQPGKTYLLRIINAALNEELFFKIAGHELTVVEVDAVYTKPLKTDTIVIAPGQTTNVLLTTKHATGKYLVAASPFMDAPIAVDNKTATATLHYLGTLGSTITTLTSMPPKNATPVATTFIDSLRSLNSKEHPARVPLKIDHNLLFTVSLGVNPCATCVNNSRVVADINNVTFVMPKISLLQAHFFKIKGVFTDDFPGNPPVVYNFTGTQPSNLKTMKGTRVYRLAYNSTVQLVLQDTGMITPENHPIHLHGFNFFVVGRGQGNFNPTKDPKKFNLVDPVERNTVGVPAGGWTAIRFRADNPGVWFMHCHLEIHTTWGLKMAFVVDNGKGPNESLLPPPTDLPKC

SEQ ID NO: 9682 - protein, 556 aa, Glycine max
MAAFGIRIMLLMAACLLPLSVEAMVRHYKFNVVLKNATRLCSTKPIVTVNGKFPGPTIYAREDDTVLVKVVNHVKYNVSIHWHGVRQLRTGWADGPAYITQCPIQPGQAFIYNFTLTGQRGTLWWHAHILWLRATVHGALVILPKLGVPYPFPKPNMEQVMILSEWWKSDTEAVINEALKSGLAPNVSNAHTINGHPGPVQGCASQEGFKLDVQPGNTYLLRIINAALNEELFFKIAGHELTVVEVDAVYTKPFKTDTIVIAPGQTTNVLLTTKHAAGKYLVAASPFMDAPIAVDNKTATATLHYSGTLGSTITTLTSMPPKNATPLATSFTDSLRSLNSKKYPARVPLKIDHNLLFTVSLGINPCATCVNNSRVVADINNVTFVMPKISLLQAHFFKIKGVFTDDFPGNPPVVYNFTGTQPSNLRTMKGTRVYRLAYNSTVQLVLQDTGMITPENHPIHLHGFNFFVVGRGQRNFNPTKDPKKFNLVDPVERNTVGVPAGGWTAIRFRTDNPGVWFMHCHLEIHTTWGLKMAFVVDNGKGPNESLLPPPSDLPKC

SEQ ID NO: 9683 - protein, 557 aa, Glycine max
MAMMWIRVILILAACMLPLSVEAMVRHYKFNVVVKNVTRLCSTKPIVTVNGKFPGPTIYAREDDTVLVKVVNHVKYNVSIHWHGVRQLRTGWADGPAYITQCPIQPGQAFVYNFTLTGQRGTLWWHAHILWLRSTVHGALVILPKLGVPYPFPKPHTEKVIILSEWWKSDTEAVINEALKSGLAPNVSDAHTINGHPGSVQNCASQGGYELQVQPGNTYLLRIINAALNEELFFKIAGHQLTVVEVDAVYTKPFKTDTIVIAPGQTTSVLLKANRAAGKYLVAATPFMDSPIAVDNVTATATLHYTGSLGSTITTLTSLPPKNATPVATNFTDSLRSLNSKKYPARVPQKVDHSLFFTISLGVNPCPTCVNGSKVVAAINNVTFVMPKVSLLQAHFFNISGVFIDDFPGKPPVVYDFTGTQQPTNLRTNRGTRVYRLAYNSTVQLVLQDTGMITPENHPLHLHGFNFFVVGRGQGNFNPKKDTKKFNLVDPVERNTVGVPSGGWTAIRFRADNPGVWFMHCHLEIHTTWGLKMAFVVDNGKGPNESLLPPPSDLPKC

SEQ ID NO: 9684 - protein, 554 aa, Glycine max
MWIRIILLVAACMLPLSVEAMVRHYKFNVVVKNVTRLCSTKPIVTVNGKFPGPTIYAREDDTVLVKVVNHVKYNVSIHWHGVRQLQTGWADGPAYITQCPIQPGQAFVYNFTLTGQRGTLWWHAHILWLRSTVHGALVILPKLGVPYPFPKPHTEKVIILSEWWKSDTEAVINEALKSGSAPNVSDAHTINGHPGSVQNCASQGGYKLQVQPGNTYLLRIINAALNEELFFKIAGHQLTVVEVDAVYTKPFKTDTIVIAPGQTTNVLLKANRAAGKYLVAATPFMDSPITVDNVTATATLHYTGSLGSTITTLTSLPPKNATPVATNFTDSLRSLNSKKYPARVPQKVDHSLFFTVSLGVNPCPTCANGSKVVAAINNVTFVMPKVSLLQAHFFNISGVFTDDFPGKPPVVYDFTGTQQPTNLRTNRGTRVYRLAYNSTVQLVLQDTGMITPENHPIHLHGFNFFVVGRGQGNFNPKKDTKKFNLVDPVERNTVGVPSGGWTAIRFRADNPGVWFMHCHLEIHTTWGLKMAFVVDNGKGPNESLLPPPSDLPKC

SEQ ID NO: 9685 - protein, 593 aa, Medicago truncatula
MGIMCIRIIFLLAAYCLLPLSVDAMVRHYKFNMLHVMHLDFIFVLVDSYIYFMTIKVDNVLLLLLIQVVMKNATRLCSTKPIVTINGNFPGPTIYAREDDTVLVKVVNHVKYNVSIHWHGIRQLRTGWADGPAYITQCPIQPGQVYMYNFTLTGQRGTLWWHAHILWLRATVHGAIVILPKLGVPYPFPRPHMEQVIILSEWWKSDTEAIINEALKSGLAPNVSDAHTINGHPGPVQHCASQEGFKFQVEPGKTYLLRIINAALNEDLFFKIAGHKFTVVEVDAAYTKPFKTDTIVITPGQTTNVLLKTNHASGKYMVAASTFMDAPIAIDNVTATATLHYPNTLGSTITTLTSLPPINSTKIANSFTDSLKSLNSHKYPARVPKKIDHSLFFTVSLGVNPCATCPNGSRVVAAINNVTFVMPKISLLQAHFFNISGIFTDDFPRKPEIVYDFTGNKQPSNFRTNKGTRVYRLAYNSTVQLILQDTGMIAPENHPIHLHGFNFFVVGKGQGNFNPKKDTKKFNLVDPVERNTVGVPSGGWTAIRFRADNPGVWFMHCHLEIHTTWGLKMAFVVDNGKGPNESLLPPPSDLPKC

SEQ ID NO: 9686 - protein, 556 aa, Ricinus communis
MEIAPWVRVLVLVACLFPASVECMVRHYKFNVVMKTATKMCSTKPIVTVNGKFPGPTLVAREDDTVLVKVVNHVKYNLSIHWHGIRQVRTGWADGPAYITQCPIQPGQSYVYNFTLTGQRGTLWWHAHILWLRATVHGAIVILPKRGVPYPFPTPDKEEVIVLSEWWKSDVEAVINEALKSGLAPNVSDAHTINGHPGPVPACPSQGGFTLPVHSGKTYMLRIVNAALNEELFFKIAGHQLTVVEVDATYVKPFKTDTIVIAPGQTTNVLLTAGRSSGKYLVAASPFMDAPIAVDNVTAVATLHYSGTLSSSATTLTATPPKNATSIASNFTNALRSLNSKKYPANVPLKIDHSLFFTIGLGVNPCATCVNGSRVVADINNVTFVMPTIGLLQAHFFNISGVFTDDFPSNPPVSYNYTGTQPTNFQTTTGTRLYRLAYNSTVQLVLQDTGMITPENHPIHLHGFNFFQVGRGVGNFNPKKDPKNFNLVDPVERNTAGVPSGGWTAIRFRADNPGVWFMHCHLEVHTTWGLKMAFVVDNGKGPNESLLPPPSDLPKC

SEQ ID NO: 9687 - protein, 556 aa, Populus trichocarpa
MDMAPWIRVLVLVACLFPASVESMVRHYKFNVVMKNSTKLCSTKPIVTVNGQFPGPTLVAREDDTVLVKVVNHVKYNVSIHWHGIRQLRTGWADGPAYITQCPIQPGQSFVYNFTITGQRGTLLWHAHILWLRATVHGAIVILPKRGVPYPFPTPRKEKVIILGEWWKSDVEAVINEATKSGIAPNVSDAHTINGHPGPVSACSSHGGYNLSVHPGKTYMLRIINAALNEELFFKIAGHQLTVVEVDATYVKPFKIDTVVIAPGQTTNVLVTANRGSGQYLVAASPFMDAPIAVDNVTATATLHYSGTLASTITTLTVPPAKNATPVATNFTNALRSLNSIKYPARVPLKIDHSLFFTVGLGVNPCATCINGSRVVADINNVTFVMPTIALLQAHVFNISGVFTDDFPANPPTPFNYTGTQPTNFQTVKGTKLYRLAYNNTVQLVLQDTGMLTPENHPVHLHGFNFFEVGRGVGNFDPNKDPKKFNLVDPVERNTIGVPAGGWTAIRFIADNPGVWFMHCHLEVHTTWGLKMAFVVDNGKGPNESVLPPPPDLPKC

SEQ ID NO: 9688 - protein, 554 aa, Populus trichocarpa
MALWLRVLVLVACLFPASVESMVRHYKFNVVMKNTTRLCSEKPIVTVNGRFPGPTLVAREDDTVLVKVVNHVKYNVSIHWHGIRQLRTGWADGPAYITQCPLQPGQSFVYNFTISGQRGTLLWHAHILWLRATVHGAIVILPKRGVPYPFPTPHREEVIVLGEWWKSDVEAVINEAMNSGRAPNVSDAHTINGHPGPVSGCSSQGGYNLPVRPGKTYMLRIINAALNEELFFKIAGHQLTVVEVDATYVKPFKIDTIVIAPGQTTNVLVTANRGSGKYLVAASPFMDAPIAVDNVTATATLHYSGTLASTTTTLTVPPAQNATPVATNFTDALRSLNSIKYPARVPLKIDHSLFFTIGLGVNPCATCVNGNRVVADINNVTFVMPTIALLQAHFFNIKGVFTDDFPGNPPTPFNYTGTQPKNFQTVNGTKLYRLAYNSTVQLVLQDTGMLTPENHPVHLHGFNFFEVGRGIGNFNPKRDPKKFNLADPVERNTIGVPAGGWTAIRFIADNPGVWFMHCHLEVHTTWGLKMAFVVDNGKGPNESVLPPPPDLPKC

SEQ ID NO: 9689 - protein, 554 aa, Vitis vinifera
MTQWIRVLLLVASLFPILVDCRTRHYKFNVVLRKATRLCSSKPIVTVNGNFPGPTIHAREDDTVLIKVVNHVKYNVSIHWHGIRQLRTGWADGPAYITQCPIQPGQSYIYNFTITGQRGTLLWHAHILWLRATVHGALVILPKLGVPYPFPTPYKEAVVILGEWWKSDVEAVINEAMKSGLAPNVSDAHTINGHPGPFSSCSLQGGFTLPVDPGKTYMLRIINAALNEELFLKIAGHHLTVVEVDATYTKPFSTDTVLIAPGQTTNVLLTAGLGAGKYLVTASSFMDSPIAVDNMTATATVQYSGTLSSTPTTITNPPPQNATSVATKFTDSLRSLNSKKYPARVPLATDHSLLFTVGLGINPCATCVNGGKVVANINNVTFVMPTTALLQAHYFKMKGVYTDDFPGNPPIAFNYTGTQPTNFQTMNGTRLYRLAYNSTVQLVLQDTGMIAPERHPVHLHGFNFFVIGRGLGNYNPKKDPKKFNLVDPVERNTVGVPSGGWTAIRFRADNPGVWFMHCHLEVHTTWGLKMAFVVDNGKGPNESVLPPPSDLPKC

SEQ ID NO: 9690 - protein, 547 aa, Vitis vinifera; identical to SEQ ID NO: 9634
  misc_feature (10)..(10): Xaa can be any naturally occurring amino acid
  misc_feature (525)..(525): Xaa can be any naturally occurring amino acid

SEQ ID NO: 9691 - protein, 593 aa, Medicago truncatula; identical to SEQ ID NO: 9685

SEQ ID NO: 9692 - protein, 548 aa, Glycine max; identical to SEQ ID NO: 9681

SEQ ID NO: 9693 - protein, 502 aa, Glycine max
MEKMLGRNCGKLKTKIVCTLGPSSRSVEMLEKLLKAGMNVARFNFSHGTHSYHQETLDNLRTAMNNTGILCAVMLDTKGPEIRTGFLNEGKPIQIHRGQEITITTDYSIKGDENMISMSYKKLAHHLSPGSNILCADGTISFTVLECDKENGLVRCHCENSAVLGERKNVNLPGVVVDLPILTEKDKEDILEWGVPNKIDIIALSFVRKGSDLVEVRNLLGKHAKSILLMSKVENQEGVANFDEILENSDAFMVARGDLGMEIPIEKIFLAQKVMIHKSNIKGKPVVTATQMLESMIKSPRPTRAEATDVANAVLDGTDCVMLSGETAAGAYPDIAVQTMARICSEAESFIDYGDLFKRVMETAPTPMSPLESMASAAVRTANCINAALILVLTRGGTTSKLVAKYRPSMPILSLVVPEITTDSFEWFCSQEAPARHSLIYRGLIPVLGTGSFGDSMTESTEETIQLALSYAKKNDLCKPGDSVVALHRLESGTVIKILDVC

SEQ ID NO: 9694 - protein, 472 aa, Glycine max
  misc_feature (22)..(22): Xaa can be any naturally occurring amino acid
  misc_feature (154)..(154): Xaa can be any naturally occurring amino acid
  misc_feature (357)..(357): Xaa can be any naturally occurring amino acid
  misc_feature (385)..(385): Xaa can be any naturally occurring amino acid
MTIGERRYNLKKISFNFSHGSXSYHQETLDNLRTALNNTGILCAVMLDTKGPEIRTGFLKQGKPIEIQRGQEITITTDYSIKGDENMISMSYNKLAHHLSPESNILCADGTISFTVLECDMENGLVRCRCENSAVLGERKNVNLPGVVVDLPTXTEKDKEDILEWGVLIRLTSLLSFVRKGSDLVEVRNLLGKHAKSILLMSKVENQEGVANFDEILANSDAFMVARGDLGMEIPIEKIFLAQKVMKHKSSIQGKPVVTATQMLESAIKSPRPTRAEATNVANTVLDGTDCVMLSGETAAGAYPDIAVQTMARICSEAESFIDSTDLFRRVIETAPTPMSPLESMVSAAVRTILQQXAALILVLTRGGTTSKLVAKYTPSMPILXVVVPEIITDSFEWFCSEETPLRHSLIYRGLIPVLGTGSYGDSMTKSTEETIELALSYAKKNDLCKTGDSVVALHRLESSTVIKILDV

SEQ ID NO: 9695 - protein, 500 aa, Populus trichocarpa
MVGEDTRNRKTKIVCTLGPQSRSVEMTERLLRAGMNVARFNFSHGTHAYHQETLDNLGTAMNNTGILCAVMLDTKGPEIRTGFLKDGKPVQLKQGQEILISTDYSLKGDENMICMSYKKLAEDVQPGSVILCSDGTISLTVLACDKEAGLIRCRCENSAVLGEKKNVNLPGVVVDLPTLTEKDKEDILKWGVPNKIDIIALSFVRKGSDLTEVRKLLGDDGKNILLMSKVENQEGVANFDDILANSDAFMVARGDLGMEIPIEKIFLAQKVMIHKANIQGKPVVTATQMLESMIKSPRPTRAEATDVANAVLDGTDCVMLSGETAAGAYPELAVQTMSRICMEAENFIDYGHLFKAIMVTAPMPMTPLESMASSAVRTANTIKAAFILVLTKGGTTAKLVSKYRPSMPILSMIVPEIRTDFFEWSCSDEAPARHSLIYRGLMPVLSSVSGKVYHSESTEETIEQAFHYAKIKGLCKPGDSVVALHKIGAASVIKILQVQQ

SEQ ID NO: 9696 - protein, 499 aa, Populus trichocarpa
MVGEDKRTRKTKIVCTLGPQSRSVEMIERLLRAGMNVARFNFSHGTHAYHQETLDNLRTAMNNTGILCAVMLDTKGPEIRTGFLKDGKPVQLKQGMEILITTDYSLKGDENMICMSYMKLAEDVQPGSVILCSDGTISLTVLACDKDSGLVRCRCENSAVLGEKKNVNLPGVVVDLPTLTEKDKEDILKWGVPNKIDMIALSFVRKGSDLVEVRKLLGNDGKNILLMSKVENQEGVANFDDILANSDAFMVARGDLGMEIPIEKIFLAQKVMINKANIKGKPVVTATQMLESMIKSPRPTRAEATDVANAVLDGTDCVMLSGETAAGAYPELTVQTMSRICMEAENFIDYGHLFKTIMATAPMPMTPLESMASSAVKTANTIKAAFILVLTKGGTTAKLVSKYRPSMPILSMIVPEIRTDSFEGSCSDEAPARHSLIYRGLMPVMTSISGKVYHSESAEETIEMAFQYAKMKGLCKPGDSVVALHKIGTASVIKILRVQ

SEQ ID NO: 9697 - protein, 500 aa, Vitis vinifera
MEGGGGWKRPKTKIVCTLGPASRSVEVIEKLLRAGMNVARFNFSHGSHAYHQQTLDNLRTAMANTETLCAVMLDTKGPEIRTGFLKDGKPVQLKKGQEITISTDYSIKGDDHMICMSYQKLAEDLRPQSVILCADGTITLTVLACDKELGLVRCRCENSAVLGERKNVNLPGVVVDLPTLTEKDKEDILEWGVPNKIDMIALSFVRKGSDLVEVRMLLAEHAKSILLMSKVENQEGVANFDEILANSDAFMVARGDLGMEIPIEKIFLAQKVMIYKCNIQGKPVVTATQMLESMIKSPRPTRAEATDVANAVLDGTDCVMLSGETAAGAYPELAVQTMARICLEAENSLNYGDVFKTIMETAPMPMSPIESLASSAVRAANGSKAALILVLTRGGTTANLVAKYRPSMPILSVVVPEITADSFDWSCSDESPARHGLIFRGLVPVLCSGSAKASDSESTEEALEFSLQYAKTKEMCKPGDSVVALHRVGTASVIKILTVK

SEQ ID NO: 9698 - protein, 508 aa, Ricinus communis
MEKILRGHGSAMAGERRPKTKIVCTLGPQSRSVTMLERLLRAGMNVARFNFSHGTHAYHQETLDNLRTAMNNTGILCAVMLDTKGPEIRTGFLKDGKPVQLKQGQEILISTDYSLKGDENKICMSYKKLAEDVIPGSVILCSDGTISLRVLACDKENGLVHCRCENSALLGEKKNVNLPGVIVDLPTLTEKDKEDILQWGVPNKIDMIALSFVRKGSDLMEVRELLGENAKNILLMSKVENQEGVANFDEILANSDAFMVARGDLGMEIPIEKIFLAQKVMIHKANILGKPVVTATQMLESMIKSPRPTRAEATDVANAVLDGTDCVMLSGETAAGAYPESAVQTMAKICMEAEDFIDYSFLFKKIMENAPMPMSPLESLTSSAVKTANSVNAAFILVLTKGGNTAKLLSKYRPSVPILSVVVPEVKSDSFEWSCSNESPARHSLIYRGLVPVLSSGSIRASHSESTDETVEHALQYAKMKGFCKQGDSVVVLHKIDTASVIKILLVQ

SEQ ID NO: 9699 - protein, 495 aa, Populus trichocarpa
MEKRPNTKIVCTLGPASRSVPVIEKLLKAGMNVARFNFSHGSHDYHQETLDNLMAAMVNTGILCAVMLDTKGPEIRTGFLKDGKPIQLNQGQEITISTDYSLKGDENMICMSYKKLAEDVQPGMVILCADGTLSFTVLSCDTEAGLVRCRCENSAVLGERKNVNLPGVIVDLPTLTEKDKEDILAWGVPNKIDMIALSFVRKGSDLVEVRKLLGKHAKNILLMSKVENQEGVANFDDILANSDAFMVARGDLGMEIPIEKIFLAQKVMIYKCNIQGKPVVTATQMLESMIKAPRPTRAEATDVANAVLDGTDCVMLSGETAAGAYPELAVQTMAKICVEAESTLDYGDVFKRTTKHSPVPMSPLESLASSAVRTANSVKASLILVLTRGGSTAKLVAKYRPGMPILSVVVPEIQTDSFDWSCSDEAPARHSLIFRGLVPVLYAGSAKASHAETTEEALDFALQHAKGKGLCRTGDPVVALHRVGTASVIKIINVK

SEQ ID NO: 9700 - protein, 500 aa, Medicago truncatula
MSTIVEEKKPKTKIVCTLGPASRSIPMVEKLLRAGMNVARFNFSHGSHDYHQETLDNLRAAMENTGILCAVMLDTKGPEIRTGFLKDGKPIQLKQGNEITISTDYSLKGDENTICMSYKKLAEDVKPGSVILCADGTISFTVLSCDKELGLVRVRCENSAVLGERKNVNLPGVVVDLPTLTEKDREDIMVWGVPNKIDMIALSFVRKGSDLVQVRKLLGHHAKNILLMSKVENQEGVANFDDILANSDAFMVARGDLGMEIPIEKIFLAQKVMIYKCNIQGKPVVTATQMLESMIKSPRPTRAEATDVANAVLDGTDCVMLSGETAAGAYPELAVRTMAKICVEAESTINYGDVFKRIMEHSPVPMSPLESLASSAVKMANSAKAALILVLTRGGSTAKLVAKYRAGMPILSVVVPEIKTDTFDWSCSDEAPARHSLIFRGLIPVLSAGSARASHTETTEEALDFAIQYAKTKGLCNNGDSVVALHRVGVASVIKILTVK

SEQ ID NO: 9701 - protein, 496 aa, Medicago truncatula
MAEKKPKTKIVCTLGPASRSVPMVEKLLQAGMNVARFNFSHGSYEYHQETLDNLRTAMQNTGILCAVMLDTKGPEIRTGFLKDGKPVQLKQGQEITISTDYDIKGDENMICMSYKKLAYDVKPGSIVLCADGTISFKVLSCDKKAGLVRCCCENSAMLGERKNVNLPGVIVDLPTLTEKDKEDIMVWGVPNNIDMIALSFVRKGSDLVEVRKLLGKHAKNILLMSKVENQEGVANFDEILTNSDAFMVARGDLGMEIPIEKIFLAQKVMIYKCNIQGKPVVTATQMLESMIKSPRPTRAEATDVANAVLDGTDCVMLSGETAAGAYPELAVRTMAKICVEAESTINYGDVFKRIMEHSPVPMGPLESLASSAVKMANSAKAALILVLTRGGSTAKLVAKYRAGMPILSVVVPEIKTDTFDWSCSDEVPARHSLIFRGLIPVLSAGSARASHAETTEEALDFAIQYAKTKGLCNNGDSVVALHRVGVASIIKILTVK

SEQ ID NO: 9702 - protein, 509 aa, Ricinus communis
MNMMNTGGGTDSVFMEKKPKTKIVCTLGPASRSVPMLEKLLRAGMNVARFNFSHGSHEYHQETLDNLRAAMVNTGILCAVMLDTKGPEIRTGFLKDAKPIQLKQGQEITISTDYSIKGNEKLICMSYKKLAEDVKPGMVILCADGTISFTVLSCDTKAGLVRCRCENSAVLGERKNVNLPGVIVDLPTLTEKDKEDILKWGVPNQIDMIALSFVRKGSDLVEVRKLLGHHAKNILLMSKVENQEGVANFDDILANSDAFMVARGDLGMEIPIEKIFLAQKVMIYKCNIQGKPVVTATQMLESMIKSPRPTRAEATDVANAVLDGTDCVMLSGETAAGAYPELAVRTMAKICLEAESTLDYGDVFKRVMQHSPVPMSPLESLASSAVRTANSAKASLILVLTRGGSTAKLVAKYRPGKPILSVVVPEIKTDSFDWSCSNEAPARHSLIFRGLVPVLYAGSARASHAETTEEALDFAIQHAKAKGLCKIGDSVVALHRVGTASVIKIIYVK

SEQ ID NO: 9703 - protein, 556 aa, Glycine max; identical to SEQ ID NO: 9682

SEQ ID NO: 9704 - protein, 1022 aa, Glycine max
MESVNDLIQEAKLRTLWWALCIFAVSYFLTHTSKSMWMNVPMSILFVVGLRILFNRVEFRWKLQQPRPQTYLSHLEKKQLSLNDPCLTSLPSPAKWKRKIDSPAVEAAMSDFIDKILKDFVVDLWYSEISPDKEFPEQIRAIIMDVLAEISGRVKEINLVDLLTRDLVDLIGVHIELFRRNQAVIGVNIMKTLSSEERNDRLKFHLLNSKELHPALISPESEYKVLQRLMSAVLATVLRQREAQCPVIRSISRELLTCLVMQPIMNLASPGYINELIESLLLLFNDDGTEGMGSDQSTNVASLHHGHSVASKGGHNNLTASNKHPSLNQGTDMILAKMSDQGGTSLQDSTLHQESKQVGPADWARMLEVTTQRRTEILMPENLENMWTKGRNYKRKENKIIKAGSKDLSAKSPSTDSSRPHRKLAQETSASKRGKYEVADGKSSLPPLPAIGSDPLQNVGSAKNSESPKNPGKELSIVGDLASDAYRSPLKRSSSASSLGILSNKEDSRISEFFNPELERHSEGFRGKSSSNMIVRKEGSLVPKLRCRVVGAYFEKIGSTCFAVYSIAVTDAQNKTWFVKRRYRNFERLHRHLKDIPNYTLQLPPKRIFSSSTDDAFVHQRCIQLDKYLQDLLSIANVAEQHEVWDFFSVSSKNYSFGKSPSVMKTLAVNVDDAMDDIVRQFKGVSDGLRRKVVGSSSLINEGSATSNTPWNLSWNADEIDKSIPRQSTAESVSSDNEEGERNNFDRENIDREAAQDSGLHSYNALISKGYSSRISNWDEESRNLDFDRKHDMVVEARAGNGIPATNFILIHDNLEDPVGVPPEWTPPNVSVPILNLVDNIFQLNKRGWIRRQVYWISKQILQLVMEDAIDDWLLRQIHWLRREETVSQGIRWVQDVLWPGGTFFLRVGTPQIISDSDKKSSPTMSRSGGSNITKSESGSFEQELEAARRASDIKKLLFDGAPTTLVSLIGHKQYRRCARDIYYFSQSNVCVKQLAYAILELALVSIFPEIRNVVKSIHQPV

SEQ ID NO: 9705 - protein, 1311 aa, Glycine max
MESVNDLIQEAKLRTLWWALCIFVVSYFLTHTSKSMWMNVPMSILFVVGLRILFNRVEFRWKVPQPRLQTYLSHLEKKQLSLNDPRLTSLPPPAKWKRKIDSPAVEAAMSDFIDKILKDFVVDLWYSEITPDKEFPEQIRAIIMDVLAEISGRVKEINLVDLLTRDLVDLIGVHIELFRRNQATIGVDVMKTLSSEERDDRLKFHLLNSKELHPALISPESECKVLQRLMSAVLATVLRQREAQCPVIRSISRELLTCLVMQPIMNLASPGLALYLLIVPSGFSFTLNTHFQPIGALDGGTGATETVAGEDKDTSAVVTSTLDDASEETEDTVAGGVLGNSEFPCGKGEELDVDKVGVVASGELTDATAVCEAVADRHGTRAGQGVPEPYPVPRSRPRSRGGEFKTEFEDALKTGSETSDELNTTVDWDFGLSWSTDSGLDSSLVELKVSMKLIPDMLGGLTTDESSENITGKSWIEAMIAEVDLVVPKAETQERHYQHHNQLEKHITVEFIKWEISFAVAIGEVTATGVAASALTGIAFTRVALCTGTSLVTSGGRGGYINELIESLLLLFNDDGTQGMGSDQSTNVASHHHGHSVASEGGHNNLTASNKHPSLNQGTGMILAKTSDQGGTLLQDSILHQDSSQVRPADWARMLEVVNQRRTEILMPENLENMWTKGRNYKRKENKIIKTGSQDLPAKSPSTDSSLPHRKLAQETSASKCGKYEVAEGKSSLPPLPVMGSAPLQNVGDAKSLESSKNPDKELSIVGDLASDGYKSPLKRSSSASSLGILSNKEDSIISEFFNPEFERHSEGFRGKSSSDMIVRKEGPLVPKLRCRVVGAYFEKIGSTCFAVYSIAVTDAQNKTWFVKRRYRNFERLHRHLKDIPNYTLHLPPKRIFSSSTDDAFVHQRCIQLDKYLQDLLSIANVAEQHEVWDFFSVSSKNYSFGKSPSVMKTLAVNVDDAMDDIVRQFKGVSDGLRRKVVGSSSLINEGSATSNTTWNLSWNADEIDKSIPRQSTAESVFSSDNEEGEKNNFDRDNIDRAVAQDSGLHSDNALISKGNSSRINICDEESSNLEFDRKHDMVVEARVGNDIPATNFILVHGNLEDPVGVPPEWAPPNVSVPILDLVDNIFQLNKRGWIRRQVYWISKQILQLVMEDAIDDWLLRQIHWLRREETVSQGIRWVQDVLWPGGTFFLRVGTPQIISDSDKKPSPTMSRSGGNNITKSESGSFEQELEAARRASDIKKLLFDGAPTTLVSLIGHKQYRHCARDIYYFSQSNICVKQLAYAILELALVSIFPEIRNVVESIHQPV

SEQ ID NO: 9706 - protein, 1146 aa, Medicago truncatula
MKKKPMESVNDLIQEFKLRTLWWALSIFAVSYFLTHTSKSMWMNVPMSILFVCALRIIVNNVEFRWKVKQPRSHTYLSHLEKKQLSLNDPRLSSVPPPVKWKRKIDSPVVEDAMADFIDKILKDFVVDLWYSEITPDREFPDQIRAIIMDVLAEISARVKEINLVDLLTRDLVDLVGDHLELFRRNQAAIGVDVMKTLSTEERDDRLKFHLLNSKELHPALRSPESEYKVLQRLMSALLATVLRQREAQCPVIRSISRELLTCLVMQPVMNLASPGQNMGRYKRGLNGNDIHRYGAERVSGCVGDRLYGWVPLVWSEETISMPGDNFKQQHIQAGTLQVVLHLESSCSFTPSDVCKTMISFCLANSFVGKEEKELETNKGVLKKEFINELIETLLLLLNDNDSKKWMGGDQSTNVASHHHGNSVANSGGHDNLTASSKHPPLYQGTEMTLAKMSDRGETSLQNNSVHQKSSQPKPADWAQMLEVATQRRTEILMPENLENMWAKGRNYKRKENKIVKTGSQDLHTKSSATDRSLLNRKMNQETLVSKHGKHEAAEVKSSLPSTHALTSDPLQSVASTNISESSQYPDKTSSFEGELRVDKMKGTKDLASDGYKSSLKRSSSASALAIHLNQEGSSIISEFFNPEFERREGFRGKSSSDMIVRKEGQLAPKLRCRVVGAYFEKIASTSFAVYSIAVTDAQNRTWFVKRRNFERLHRHLKDIPNYTLHLPPKRIFSSNTDDAFVHQRCVQLDKYLQDLLSIANVAEQHEVWDFFSVSSKNYSFGKSSSVMKTLAVNVDDAVDDIVRQFKGVSDGLRRKVGGSPSLLNEGPSTSLYLPWNADELDKSTTQQSATTSVLSSDTEDGDRNSNLGHDNFDREEVQDNALILKGYPSLVTDYTDESSNLAIDRQRDLSEEARISNDVPTTNSILTRDNLEDPVGVPPEWSPPNVSVPLLNLVDKIFQLKKRGWIRRQVFWMSKQILQLVMEDAIDDWLLMQIHWLRKEDTVAQGIRWLQDVLWPGGMFFTRVRLPQITNGGSDEKPSQTISGSGGRNITKHESGSFEEQLEAARRESDIKKLLFDGAPTTLVSLIGHNQYRRCARDIYYFSQSPVCMKQLAYAILELLLVSIFPEMRNVVLSVHENMNVHQAP

SEQ ID NO: 9707 - protein, 572 aa, Glycine max
MKLFMFLLAWAFALLGSSLASAAIVEYTFKVQTTTVNRLCNKRVIVTVNGQFPGPNINVSEGDTVVVHLLNEGPYNITIHWHGVLQLFTAWADGPEYVTQCPISPGNNYTYTFNATRQEGTLWWHAHASVLRATVHGAFIIQPRSGRFPFPKPYKQVPIILGDWYDANNVVDIETQALATGGSPNISSAFTINGLPGDLFSCSQNQKFTMSVTQGKTYMLRMINAALNNHLFFKIANHTFTVVAMDAAYTDHYVTNIIVIAPGQTIDALFTADQPLGSYYMAASPYIVGVPVFDNTTTRGVVVYDNAPPSSSQPLMPTLPPFGDTETAHKFYSNITGKVGAPHWIPVPTTVDEHMFITIGLNLALCDPNNANNATCQGPFGHRFSSSMNNESFVLPIGRGFSMLEAFFKNVSGVYTADFPDNPPVTFDFANPSISFDPNLLFAPKSTKVKKLKFNSTVEVVFQNTAILGVQNHPMHVHGFSFHVLAQGFGNFNSTTDSTKFNLVNPQLRNTIAVPVGGWAVIRFQANNPGVWFVHCHIEDHVPWGLNMAFEVENGPTSSTSLPPPPSDLPKC

SEQ ID NO: 9708 - protein, 573 aa, Glycine max
MKLFSFSLACVFVFALLASSLASAAIVEHIFKVQNTTIKRFCKEQVIVTVNGLFPGPTINVHEGGTVIVHVLNEGPYDITLHWHGVLQLFSPWADGPEYITQCTIRPRSKYTYKFNVTQQEGTVWWHAHASYLRATVHGAFIIKPRSGRFPFPKPYKQIPLILGDLYNSRVEDITTEAQASGGGPNISYAFTINGLTSGHLMNCTENETFKMKVKQGKTYMLRMINAALNYDLFFKIANHNFTVVAVDASYTDHYVSDLIVIAPGQSVDVLFTANQPTGSYYMVASPYVVGLEDFDANVARGTVIYENAPPSSKPIMPVLPPFNDTDTAYTKFYNVITSKVRAPHWVPVPRKVDEHMFITIGFNLELCDSKNPNNATCKGPNGHRFSASMNNESFSVPAGVKLSLLEAFYKNKSSVYTRDFPDKPPVLFDFTNLNDANNTNLLFAPKSTRAKKLRFNSTVEVVFQNTALLGGQNHPMHIHGYSFHVLAQGFGNFNRKDRAKFNLVNPQLRNTVGVPMGGWTVIRFQANNPGVWLVHCHMEDHVPWGLAMIFEVENGPTPLTSVPPPPADLPKC

SEQ ID NO: 9709 - protein, 572 aa, Glycine max
  misc_feature (341)..(341): Xaa can be any naturally occurring amino acid
MKLFSFSLACAFALLTSSLASATIQEHTFKVQNTTIKRFCKEQVIVTVNGTFPGPTINVREGDTVIVHVLNEGPYDITLHWHGVLQLFSPWADGPEYVTQCTIRPRSKYTYKFNVTQQEGTVWWHAHASYLRATVHGAFIIQPRSGQFPFPKPYKQIPLILGDLYNSNVEDITTEAQASGGGPNISCAFTINGFTSGLLINNCTENETFKMKVQQGKTYMLRMINAALNYDLFFKIANHNFTVVAVDASYTDHYVTDLIVIAPGQSADVLFTANQPIGSYYMVASPYVVGLDHFDVNVGRGTVIYENAPPSPKPVMPILPPFNDTDTAYNKFYNVITSKVXGPHWVPVPRKVDEHMFITIGFNTEFCDSKNPNNASCKGPNGQRFSASMNNESFAVPAGVKFSLLEAFYENMSGVYTTDFPNKPPVMFDFTNLNNANNMNLLFAPKSTKAKKLRFNSTVEIVFQNTALLGGQNHPMHIHGYSFHVLAQGFGNFHKKDRAKFNLVNPQFRNTVGVPMGGWTVIRFQANNPGVWLVHCHMEDHVPWGLAMIFEVENGPTPSTSVPPPPADLPKC

SEQ ID NO: 9710 - protein, 570 aa, Glycine max; identical to SEQ ID NO: 9647

SEQ ID NO: 9711 - protein, 554 aa, Glycine max; identical to SEQ ID NO: 9684

SEQ ID NO: 9712 - protein, 559 aa, Glycine max; identical to SEQ ID NO: 9632

SEQ ID NO: 9713 - protein, 573 aa, Glycine max; identical to SEQ ID NO: 9708

SEQ ID NO: 9714 - protein, 572 aa, Glycine max; identical to SEQ ID NO: 9707

SEQ ID NO: 9715 - protein, 571 aa, Glycine max; identical to SEQ ID NO: 9648

SEQ ID NO: 9716 - protein, 572 aa, Glycine max; identical to SEQ ID NO: 9649

SEQ ID NO: 9717 - protein, 584 aa, Glycine max; identical to SEQ ID NO: 9614

SEQ ID NO: 9718 - protein, 566 aa, Glycine max
MKLRWSSLSRDDFIIYLDKFEYDIRHQNVTRLCHTKSMVTVNGQFPGPRIVAREGDRLLIKVTNHVSNNITIHWHGIRQLQSGWADGPAYVTQCPIQRGQSYVYNYTIVGQRGTLWWHAHISWLRSTLYGPLIILPKLNAQYPFAKPHKEVPIVFGEWWNADPEAVITQALQTGGGPNVSDAYTINGLPGPLYNCSDKDTFKLKVKPGKIYLLRLINAALNDELFFSIANHTLTVVEADAVYVKPFATNTILITPGQTTNVLLKTKSHYPNATFLMTARPYASGLGTFDNTTVAGILQYKTPPNTHHSAASLKNLPLLKPILPALNDTSFATKFNNKLRSLASAQFPANVPQKVDTHFFFTVGLGTTPCPQNQTCQGPTNATKFAASVNNVSFIQPTTALLQTHFFGQSNGVYTADFPAKPLIPFNYTGTPPNNTMVSNGTKVVVLPFNTSVELVMQDTSILGAESHPLHLHGFNFFAVGQGFGNFDPNKDPANFNLLDPIERNTVGVPSGGWVAIRFLADNPGVWFMHCHLEVHTSWGLKMAWVVLDGKLPNQKLFPPPADLPKC

SEQ ID NO: 9719 - protein, 587 aa, Glycine max; identical to SEQ ID NO: 9601

SEQ ID NO: 9720 - protein, 577 aa, Vitis vinifera
MEALSCCIANSRSFLLGLLLLLASAVFFTEAETHHHDFVVQATPVKRLCKTHNTITVNGQYPGPTLEINNGDTLEVKVTNKARYNVTIHWHGIRQMRTGWADGPEFVTQCPIRPGGSYTYRFTVQGQEGTLWWHAHSSWLRATVYGALIIHPKPGSSYPFTKPKRETPILLGEWWDANPIDVVRQATRTGAAPNVSDAYTINGQPGDLYNCSSKDTVIVPIDSGETNLLRVINSGLNQELFFTVANHKFTVVSADASYTKPFTTSVIMLGPGQTTDVLITGDQPPARYYMAARAYQSAQGAPFDNTTTTAILEYKSAPCPAKKGVSTTPVFPSLPAFNDTATVTAFSKSFRSPAKVEVPTDIDESLFFTVGLGLNRCPPKFKSSQCQGPNGTRFTASMNNVSFVLPSNFSLLQAHQQGIPGVFTTDYPAAPPVKFDYTGNVSRSLWQPVPGTKLYKLKYGSRVQVVLQGTSIFTAENHPIHLHGYDFYIIAEGFGNFNPSTDTSKFNLVDPPLRNTVAVPVNGWAVIRFVADNPGVWLMHCHLDVHITWGLAMAFLVENGVGALQSIETPPADLPLC

SEQ ID NO: 9721 - protein, 584 aa, Glycine max; identical to SEQ ID NO: 9671

SEQ ID NO: 9722 - protein, 615 aa, Glycine max; identical to SEQ ID NO: 9670

SEQ ID NO: 9723 - protein, 306 aa, Glycine max
MASAVEKEGGAREETFSLELPAPPGWKKQFIPKKAGTPKKNEIVFTAATGEEIHNRKQLEKYLKAHPGGPAVSEFDWGTGETPRRSTRISEKAKAAPPSVSEPPKKRTKRSSASQKETSQEEKEQEIKEAEMQEADDTTKDDNDIGKEKDVVKENQDDKCVEDTDVNKSTNSGEEAKAVENVEVPIDEKSNAADGELPALKDKVDDKGTEGSEVFLRKDEVKIEQPQEETKEYRGSGEPEKSETCTTADKTVEVEGVDKEEHVKSTHEFEVGEMEGTKVIGEEHHKLDEINKKAETELTVNGNHGS

SEQ ID NO: 9724 - protein, 305 aa, Glycine max
MASAVEKEGGASEETLSLELPAPPGWKKQFIPKKAGTPKKNEIVFTAPTGEEINNRKQLEKYLKAHPGGPAVSEFDWGTGETPRRSTRISEKAKAAPPTQREPPKKRTKRSSASQKEISQEEKEEETKEAEMQEADDTTKGDNDIEKEKVVVNENHDKSVEDTDVNKSTRYGEEAKAGENVEVPIEEEKSNAADGELPALKDKADDKVTEGSEVFLRKDEEKIEQPQEETKEYSGFGEPEKLETCTTADKTVEVEGVNKEDHVKSTHEFEVGEIEGTKVNGEEHHKLDEINKAEAELTVNGTHES

SEQ ID NO: 9725 - protein, 306 aa, Glycine max
MASSVEKEGGASEETFSLELPAPPGWKKKFIPKKAGTPKKNEIVFTSPTGEEINSRKQLEKYLKAHPGGPAVSEFDWGTGETPRRSTRISEKAKVAPPAESEPPKKRTKRSSASQKETSLEEKEEETKEAEMQEADDTTKDDNVIEKEKDFVKENQDDKSVENTDVNKSAHSGEAKPVENVEVLIEEEKSNAADGELPALKDKVDDKRTEGSEDFLRKDEEKIEHPQEETKEYRGFGEQEKLETCLTADKRVEVEGVNKEEHVKSTCEFDVEEIEGTKVNSEEHHKLDEINKKAEAELTVNGNHGS

SEQ ID NO: 9726 - protein, 287 aa, Glycine max
MASSVEKEGGASEETFSVELPAPPGWKKLFIPKKAGTPKKNEIVFTAPTGEEINNRKQLEKYLKAHPGGPAVSEFDWGTGETPRRSTRISEKAKAAPPIESEPPKKRTKRSSASQKETSQEEKEEKTKEAEMQEADYTTKDDNDIEKEKDVVMENQDVKSVEDTDVNKSTHSGEAKAGENVEVPIEKDKGIEVSEVFLRKDEEKIEQPQEETKEYRGSGEPEKLETCTIADKKVEVEGVNKEENIKSTREFEAEEIEGTKVNSEEYHKLDEINKAEAELTMNGNHGS

SEQ ID NO: 9727 - protein, 292 aa, Glycine max
MASSVEKESGASEETFSLELPAPPGWKKQFIPKKAGTPKKNEIVFTAPTGEEINNRKQLEKYLKAHPGGPAVSEFDWGTGETPRRSTRISEKAKATPPTESEPPKKRTKRSSASQKETSQEEKEEETKEAEMQEVDDTTKDDNDIEKEKDVVMENQDGKSVEDTDVNKSTHSGEAKAGEYVEVPIEEEKSNAADGELPALKDKVDDKVFLRKDEEKIEQPQEETKEYRRTGVPEKSETCTTADKTVEVEGVNKEVRSTRQFEVGIIEGTKVNSDQINKKAEAELTVNGNLGS

SEQ ID NO: 9728 - protein, 292 aa, Glycine max
MASSVEKESGASEETFSLELPAPPGWKKQFIPKKAGTPKKNEIVFTAPTGEEINNRKQLEKYLKAHPGGPAVSEFDWGTGETPRRSTRISEKAKATPPTESEPPKERTKRSSASQKETSQEEKEEETKEAEMQEVDDTTKDNNDIEKEKDVVMENQDGKSVEDTDVNKSTHSGEAKAGEYVEVPIEEEKSNAADGELPALKDKVDDKVFLRKDEEKIEQPQEETKEYRRTGVPEKSETCTTADKTVEVEGVNKEVRSTRQFEVGIIEGTKVNSDQINKKAEAELTVNGNLGS

SEQ ID NO: 9729 - protein, 379 aa, Glycine max
MSTAGQVIKCRAAVAWEAGKPLSIETIEVAPPQKGEVRLKILFNSLCRTDVYWWDAKGQTPLFPRILGHEASGIVESVGKGVTHLKPGDHALPIFTGECGECTYCKSEESNLCELLRINTDRGVMLSDGKTRFSKNGQPIYHFVGTSTFSEYTVLHEGCVAKINPAAPLDKVAVVSCGFCTGFGATVNVAKPKPNNTVAVFGLGAVGLAACEGARVSGASRIIGVDLLTNRFEQAKQFGVTDFVNPKDHNKPVQEVIAEMTNGGVDRAIECTGSIQASISAFECTHDGWGTAVLVSVPKKDAEFKTHPMKFMEGRTLKGTFYGHYRPRTDIPGVVEKYLNKELELDKFITHSVPFSEINTAFDLMLKGEGIRCLICMEE

SEQ ID NO: 9730 - protein, 379 aa, Glycine max
MSTAGQVIKCRAAVAWEAGKPLSIETIEVAPPQKGEVRLKILFNSLCRTDVYWWDAKGQTPLFPRILGHEASGIVESVGKGATHLKPGDHALPIFTGECGECTYCKSEESNLCELLRINTDRGVMLSDGKTRFSKNGQPIYHFVGTSTFSEYTVLHEGCVAKINPAAPLDKVAVVSCGFCTGFGATVNVAKPKPNNTVAVFGLGAVGLAACEGARVSGASRIIGVDLLTNRFEQAKQFGVTDFVNPKDHNKPVQEVIAEMTNGGVDRAIECTGSIQASISAFECTHDGWGTAVLVSVPKKDAEFKTHPMKFMEGRTLKGTFYGHYRPRTDIPGVVEKYLNKELELDKFITHPVPFSEINTAFDLMLKGEGIRCLICMEE

SEQ ID NO: 9731 - protein, 371 aa, Glycine max
MRAAAVAWEAGKPLSIETIEVAPPQKGEVRLRILFNSLCRSDVYWWDAKDQTPLFPRILGHEASGIVESVGEGVTHLKPGDHALPIFTGECGECTYCKSEESNLCELLRINTDRGVMLSDGKTRFSKNGQPIYHFVGTSTFSEYTVLHEGCVAKINPNAPLDKVAIVSCGFCTGFGATVNVAKPKPNNTVAVFGLGAVGLAACEGARVSGASRIIGVDLLPNRFEQAKKFGVTDFVNPKDHNKPVQEVIAEMTNGGVDRAIECTGSIQASISAFECTHDGWGTAVLVGVPKKDVEFKTNPMKFMEGRTLKGTFYGHYRPRTDIPGVVEKYLNKELELDKFITHSVPFSKINTAFDLMLKGEGIRCLICMEE

SEQ ID NO: 9732 - protein, 367 aa, Glycine max
AVAWEAGKPLSIETIEVAPPQKGEVRLRILFNSLCRSDVYWWDAKDQTPLFPRILGHEASGIVESVGEGVTHLKPGDHALPIFTGECGECTYCKSEESNLCELLRINTDRGVMLSDGKTRFSKNGQPIYHFVGTSTFSEYTVLHEGCVAKINPNAPLDKVAIVSCGFCTGFGATVNVAKPKPNNTVAVFGLGAVGLAACEGARVSGASRIIGVDLLPNRFEQAKKFGVTDFVNPKDHNKPVQEVIAEMTNGGVDRAIECTGSIQASISAFECTHDGWGTAVLVGVPKKDVEFKTNPMKFMEGRTLKGTFYGHYRPRTDIPGVVEKYLNKELELDKFITHSVPFSKINTAFDLMLKGEGIRCLICMEE

SEQ ID NO: 9733 - protein, 380 aa, Glycine max
MSSTVGQTIKCKAAIAWEAGKPLVIEEVEVAPPQAGEVRLKILYTSLCHTDVYFWDAKGQTPLFPRIFGHEASGIVESVGEGVTHLKPGDHALPVFTGECGDCAHCKSEESNMCELLRINTDRGVMIHDGQSRFSKNGQPIHHFLGTSTFSEYTVVHAGCVAKINPAAPLDKVCVLSCGICTGFGATVNVAKPKPGSSVAIFGLGAVGLAAAEGARVSGASRIIGVDLVSARFEEAKKFGVNEFVNPKDHDKPVQQVIAEMTNGGVDRAVECTGSIQAMVSAFECVHDGWGLAVLVGVPSKDDAFKTAPINFLNERTLKGTFYGNYKPRTDLPSVVEKYMSGELEVDKFITHTVPFSEINKAFDLMLKGQSIRCIIRMQE

SEQ ID NO: 9734 - protein, 380 aa, Lotus corniculatus; identical to SEQ ID NO: 8010

SEQ ID NO: 9735 - protein, 380 aa, Phaseolus acutifolius; identical to SEQ ID NO: 8008

SEQ ID NO: 9736 - protein, 380 aa, Lotus japonicus; identical to SEQ ID NO: 8011

SEQ ID NO: 9737 - protein, 380 aa, Lotus japonicus
MSTTAGQVIKCRAAVSWEAGKPLVIEEVEVAPPQAGEVRLKILYTSLCHTDVYFWEAKGQTPLFPRIFGHEAGGIVESVGEGVTHLKPGDHALPVFTGECGECPHCKSEESNMCDLLRINTDRGVMISDNQSRFSIKGKPIYHFVGTSTFSEYTVLHAGCVAKINPAAPLDKVCILSCGICTGFGATVNVAKPKPGSSVAIFGLGAVGLAAAEGARISGASRIIGVDLVSSRFEGAKKFGVNEFVNPKDHDKPVQEVIAEMTNGGVDRAVECTGSIQAMISAFECVHDGWGVAVLVGVPNKDDAFKTHPVNFLNERTLKGTFYGNYKPRTDLPNVVEMYMRGELELEKFITHTVSFSEINKAFDYMLKGESIRCIIRMEE

SEQ ID NO: 9738 - protein, 380 aa, Trifolium repens; identical to SEQ ID NO: 8012

SEQ ID NO: 9739 - protein, 346 aa, Glycine max
MLRITRFSGFFSAAMFVTVLVILSPSFQSEAIRSSHRFSFRKAPPFRNAAECASVSGQTTTVCDPSLVHVAITLDVDYLRGSIAAVHSILHNSLCPENIFFHFLVSDTNLQTLVESTFPNLKFNVYFFDPNIVAHLISSSVRQALEQPLNYARNYLVDLLESCVERVIYLDSDLVVVDDVAKLWSASLDSRAIGAPEYCHANFTKYFTAGFWSESRLSGTFAQRRACYFNTGVMVMDLVKWRKEGYTKRIERWMEIQKSDRIYELGSLPPFLLVFAGHVAPIEHRWNQHGLGGDNVKGSCRDLHPGPVSLLHWSGSGKPWLRLSSKRPCPLDSLWAPFDLYTHPSS

SEQ ID NO: 9740 - protein, 346 aa, Glycine max
MFRITRFSGFFSAAMFVIVLVILSPSFQSEAIRSSHRFSFRKAPPFRNAAECGSISGETTTVCDPSLVHVAITLDVDYLRGSIAAVHSILHNSLCPENIFFHFLVSDTNLQTLVESTFPNLKFNVYYFDPNIVAHLISSSVRQALEQPLNYARNYLVDLLESCVERVIYLDSDLVVVDDVAKLWSASLDSRAIGAPEYCHANFTKYFTAGFWSEPRLSGTFAQRRACYFNTGVMVMDLVKWRKEGYTKRIERWMEIQKSDRIYELGSLPPFLLVFAGHVAPIEHRWNQHGLGGDNVKGSCRDLHPGPVSLLHWSGSGKPWIRLSSKRPCPLDSLWAPFDLYAHSSS

SEQ ID NO: 9741 - protein, 359 aa, Glycine max
MLWLMRFSGFFSAAMLVILLSPSLQSFHPAEAIRSSHHLDGLLRLPPPRLSFRPAPRFRNAADANKCASSSVSTSVCDPSLVHVAITLDVEYLRGSIAAVHSILQHSQCPENIFFHFLVSETNLESLVKSTFPQLNFKVYYFDPEIVRNLISTSVRQALEQPLNYARNYLADLLEPCVERVIYLDSDLVVVDDIAKLWSTSLGSRTIGAPEYCHANFTKYFTAAFWSDTRFARAFAGRRPCYFNTGVMVIDLVRWRRIGYSKRIERWMEIQKNDRIYELGSLPPFLLVFAGHVAPIEHRWNQHGLGGDNVKGSCRDLHAGPVSLLHWSGSGKPWTRLDSKQPCPLDALWAPYDLYGHAH

SEQ ID NO: 9742 - protein, 357 aa, Glycine max
MLWLMRFSGFFSAAMLVILLSPSLQSFHPAEAIRSSHHLDGLLRLPPPRLSFRPAAPFRNAADGKCASSVPTSVCDPSLVHVAITLDVEYLRGSIAAVHSILQHSQCPENIFFHFLVSETNLESLVKSTFPQLNFKVYYFDPEIVRNLISTSVRQALEQPLNYARNYLADLLEPCVERVIYLDSDLVLVDDIAKLWSTSLGSRTIGAPEYCHANFTKYFTAGFWSDMRFASAFAGRRPCYFNTGVMVIDLVRWRKIGYSKRIERWMEIQKNDRIYELGSLPPFLLVFAGRVAPIEHRWNQHGLGGDNVKGSCRDLHAGPVSLLHWSGSGKPWTRLDSKHPCPLDALWAPYDLYGHAH

SEQ ID NO: 9743 - protein, 367 aa, Populus trichocarpa
MLWILRFSGFFSAALVMIILSPSFQSFPPAEAIHSSNLDGHLRFPLLLSPADSLTQLSFRKSTIFRNADECGFSDHQSRGKTSVCYPSLVHVAITLDVEYLRGSVAAVHSILQHSMCPENVFFHFLVSETNLESLVRSTFPQLKFKVYYFDPEIVRSLISTSVRQALEQPLNYARNYLADLLEPCVKRVIYLDSDLVVVDDIAKLWTTNLGSRIIGAPEYCHANFTKYFTADFWSDKRFSGTFRGRKPCYFNTGVMVIDLVKWRWAGYTKRIERWMEIQKSHRIYELGSLPSYLLVFAGHVAPIEHRWNQHGLGGDNVRGSCRDLHPGPVSLLHWSGSGKPWLRLDSKQPCPLDALWAPYDLYGRPP

SEQ ID NO: 9744 - protein, 368 aa, Populus trichocarpa
MLWILRFSGFFSAAVVMIILSPSIQSFPPAEAIRSSNLDGYLRFPILPSPPDYLPQLSFRRSTIFRNADECRFSARQIRGKTSVCDPSLVHIAITLDVEYLRGSIAAVHSILLNSLCPENVFFHFLVSETNLESLVRSTFPQLKFKVYYFDPEIVRSLISTSVRQALEQPLNYARNYLADLLETCVKRVIYLDSDLVVVDDIAKLWATNLGSRTIGAPEYCHANFTKYFTSGFWSDKRFSGAFRGRKPCYFNTGVMVIDLVKWRHAQYTKWIERWMEVQKSDRIYDLGSLPPYLLVFAGNVAPIEHRWNQHGLGGDNVRGSCRDLHPGPYSLLHWSGSGKPWLRLDSKQPCPLDFLWSPYDLYGHSRL

SEQ ID NO: 9745 - protein, 361 aa, Arabidopsis thaliana
MLWIMRFSGLFSAALVIIVLSPSLQSFPPAEAIRSSHLDAYLRFPSSDPPPHRFSFRKAPVFRNAADCAAADIDSGVCNPSLVHVAITLDFEYLRGSIAAVHSILKHSSCPESVFFHFLVSETDLESLIRSTFPELKLKVYYFDPEIVRTLISTSVRQALEQPLNYARNYLADLLEPCVRRVIYLDSDLIVVDDIAKLWMTKLGSKTIGAPEYCHANFTKYFTPAFWSDERFSGAFSGRKPCYFNTGVMVMDLERWRRVGYTEVIEKWMEIQKSDRIYELGSLPPFLLVFAGEVAPIEHRWNQHGLGGDNVRGSCRDLHPGPVSLLHWSGSGKPWFRLDSRRPCPLDTLWAPYDLYGHYSR

SEQ ID NO: 9746 - protein, 354 aa, Arabidopsis lyrata subsp. lyrata
MRFSGLFSAALVIIVLSPSLQSFPPAEAIRSSHLDAYLRFPSSDPPPHRFSFRKAPVFRNAADCAAADIDSGVCNPSLVHVAITLDFEYLRGSIAAVHSILKHSSCPESVFFHFLVSETDLESLIRSTFPELKLKVYFFDPEIVRTLISTSVRQALEQPLNYARNYLADLLEPCVRRVIYLDSDLVVVDDIAKLWKTNLGSKTIGAPEYCHANFTKYFTPAFWSDERFSGAFAGRKPCYFNTGVMVMDLERWRRVGYTEVIEKWMEIQKSDRIYELGSLPPFLLVFAGEVAPIEHRWNQHGLGGDNVRGSCRDLHPGPVSLLHWSGSGKPWFRLDSRRPCPLDTLWAPYDLYGH

SEQ ID NO: 9747 - protein, 346 aa, Arabidopsis lyrata subsp. lyrata
MLWITRFSGFFSAAMAVIVLSPSLQSFPPAAAIRSSPSPIFRKAPVVFNNGDECLSSGGVCNPSLVHVAITLDVEYLRGSIAAVNSILQHSICPESVFFHFIVVSEETNLLESLVRSIFPGLKFNIYDFAPETVRGLISSSVRQALEQPLNYARNYLADLLEPCVSRVIYLDSDLVVVDDIAKLWKTSLGSRIIGAPEYCHANFTKYFTGGFWSEERFSGAFRGRKPCYFNTGVMVIDLKKWRRGGYTKRIEKWMEIQRTERIYDLGSLPPFLLVFAGHVAPISHRWNQHGLGGDNVRGSCRDLHPGPVSLLHWSGSGKPWIRLDSKRPCPLDALWTPYDLYRHSH

SEQ ID NO: 9748 - protein, 357 aa, Arabidopsis thaliana
MRFSGLFSAALVIIVLSPSLQSFPPAEAIRSSHLDAYLRFPSSDPPPHRFSFRKAPVFRNAADCAAADIDSGVCNPSLVHVAITLDFEYLRGSIAAVHSILKHSSCPESVFFHFLVSETDLESLIRSTFPELKLKVYYFDPEIVRTLISTSVRQALEQPLNYARNYLADLLEPCVRRVIYLDSDLIVVDDIAKLWMTKLGSKTIGAPEYCHANFTKYFTPAFWSDERFSGAFSGRKPCYFNTGVMVMDLERWRRVGYTEVIEKWMEIQKSDRIYELGSLPPFLLVFAGEVAPIEHRWNQHGLGGDNVRGSCRDLHPGPVSLLHWSGSGKPWFRLDSRRPCPLDTLWAPYDLYGHYSR

SEQ ID NO: 9749 - protein, 824 aa, Glycine max
MVLIPSVCQSDSTTAVYIVTLRQAPASHYHHHELITVGNNSKHGSSGRRRTRVHKQRHQNVSKPVMKRGSYFARVHDSLLNKVFNGEKYLKLYSYHYLINGFAVLVTQQQAEKLSRRREVSNVALDFSVRTATTHTPQFLGLPQGAWLQAGGFETAGEGIAIGFVDTGIDPTHPSFADDKSEHPFPVPAHFSGACEVTPDFPSGSCNRKLVGARHFAASAITRGIFNSSQDYASPFDGDGHGTHTASVAAGNHGIPVIVAGQVFGNASGMAPHSHIAIYKALYKRFGGFAADVVAAIDQAAQDGVDIICLSITPNRRPSGIATFFNPIDMALLSAVKAGIFVVQAAGNTGPSPMSMSSFSPWIFTVGATSHDRVYSNSLCLGNNVTIPGVGLAPGTYENTMFKLIHARHALNKNTTVTDDMYIGECQDASKFSQDLVQGNLLICSYSVRFVLGLSTIQQALETAMNLSAVGVVFSMDLFVTAFQLNPVPMKMPGIIIPSANDSKILLQYYNSSLQIDGDSNKIVKFGAVASIGGGLEANYNNEAPKVVYYSARGPDPEDSLPHEADIMKPNLVAPGNFIWAAWSSVATDSVEFLGENFAMMSGTSMAAPHVAGLAALIKQQFPNFSPAAIGSALSTTASLYDNNGRPIMAQRSYPSIDQNLSPATPFDMGSGFVNATAALNPGLLFDSSYDDYMSFLCGINGSTPTVLNYTGQNCWTYNSTLYGPDLNLPSITIARLNQSRVVQRIIQNIAGNETYNVGWSAPYGTSMKVSPNYFSLASGERLVLSVIFNVTNNSSAASYGRIGLYGNQGHVVNIPVAVIFKIL

SEQ ID NO: 9750 - protein, 824 aa, Glycine max
MVLIPSSCQSDATTTVYIVTLRQAPASHYHQHELITVGNNSRHGSSGRRRTRVHKPRHQNVTKPDRKRGSYFSRVHDSLLNKVFNGEKYLKLYSYHYLINGFAVLVTQQQAEKLSRRREVSNVVLDFSVRTATTHTPQFLGLPQGAWSQAGGFETAGEGITIGFVDTGIDPTHPSFADDKSEHPFPVPAHFSGICEVTPDFPSRSCNRKLVGARHFAASAITRGIFNSSQDYASPFDGDGHGTHTASVAAGNHGIPVVVAGQFFGNASGMAPHSHIAIYKALYKRFGGFAADVVAAIDQAAQDRVDIICLSITPNRRPSGIATFFNPIDMALLSAAKAGIFVVQAAGNTGPSPMSMSSFSPWIFTVGATSHDRVYINSLCLGNNVTIPGVGLAPGTYENTLFKLIHARHALNKNTTVTDDMYIGECQDSSKFSQDLVQGNLLICSYSVQFVLGLSTIQQALETAMNLSAVGVVFSMDPFVTSFQLNPVPMKMPGIIIPSANDSKILLQYYNSSLQIDGDSNKIVKFGAVASIGGGLEANCNNEAPMVVYYSARGPDPEDSLPHEADIMKPNLVAPGNFIWAAWSSVATDSVEFLGENFAMMSGTSMAAPHVAGLAALVKQKFPNFSPAAIGSALSTTASLYDNNRRPIMAQRSYPSIDLNLSPATPFDMGSGFVNATAALNPGLLFDSGYDDYMSFLCGINGSTPTVLNYTGQNCWTYNSTLYGPDLNLPSITIARLNQSRVVQRTIQNIAGNETYNVGWSAPYGTSMKVFPNHFSLASGERLVLSVIFNATSNSSAASYGRIGLYGNQGHVVNIPVAVIFKIL

SEQ ID NO: 9751 - protein, 851 aa, Medicago truncatula
MFGGALHSKTQMEKNTYCVHLVVLLCFFGMLLIPSSCQVDATTAVYIVTLKQALTSHYQGELSRVYNHFRRGSSGRTRLDKPRHRNVTKTDKRHGFNIAQVHDSLLRKVFKGDKYLKLYSYHYLINGFAVVVNQQQAEKLSRRREVSNVVLDFSVRSATTHTPQFLGLPQGAWFQSGGFETAGEGITIAFVDTGIDHTHPSFADDKSEHPFNAPARFSGTCEVTPDFPSGSCNRKLVGARHFAASAITRGMFDSTEDSASPFDGDGHGTNIASIAAGNHGIPVVVAGHHFGNASGMAPRSHIAVYKALYKDFGGFAADVVAAIDQAAQDRVDIICLSITPNRRPPDIATFFNPIDMALLSATKAGIFVVQAAGNTGPSPMSMSSFSPWIFTIGATSHDRVYSNSLFLGNNVTILGVGLAPGTPENTMYKLIHAHHALNDDTTIADDMYVGECQDASKFNKDLVQGNLLMCSYSMRFVLGLSSINQALETAKNLSAAGVVFPMNPSVNGFQLNPVPMKIPSIIIPFANDSKILLEYYNSSLEKDGTSEKIVKLGAVASINGGLTASYSNVAPSVMYYSARGPDPEDSLPHEADILKPNLVAPGSLIWAAWSSVATDSDEFLGENFAMMSGTSMAAPHVAGLAALIKQKFPNFSPAAIGSALSTTASLYDNSGKPIMAQRSYPSPELNQSPATPFDMGSGFVNATSALNPGLLFDSSYDDYMSFLCGINGSASTVLDYTGQNCLNFNSIGYGSDLNLPSITIARLNQSRVVQRTLQNIAENETYSVGWSSPYGVSVKVSPTRFSLANGERQVLSVIFNATSNSSTASFGRIGLFGNQGHVVNIPVSVIVKISQ

SEQ ID NO: 9752 - protein, 824 aa, Populus trichocarpa
LMVMVLTLGLLAGALCQVDDGSDNETTAVYIVTLKQAPASHYYGKLRKNTNVFKHGVPRNPNQFHNRSSSSYVARVHDSLLRRVLRGEKYLKLYSYHYLINGFAVLVTPEQAFKLSRRREVANVALDFSVRTATTHTPQFLGLPQGAWVKAGGYETAGEGIVIGFVDTGIDPTHPSFADDISLNSYPVPSHFSGICEVTRDFPSGSCNRKLIGARHFAASAITRGIFNSSLDYASPFDGDGHGTHTASVAAGNHGIPVIVAGHCFGNASGMAPRAHVSVYKALYKSFGGFAADVVAAIDQAAQDGVDVLSLSITPNRRPPGIATFFNPIDMALLSAVKAGIFIVQAAGNTGPSPKSMSSFSPWIFTVGAASHDRVYSNSIILGNNVTIHGVGLAPGTDEDTMLTLVSALHAVNNETTVTTDMYVGECQDSSTFNQDFIEGNLLICSYSIRFVLGLSTIKQAVETAKNLSAAGVVFYMDPFVIGYQLNPIPMSVPGIIIPSPDDSKVLLQYYNSSLERNGTTKQITKFGAVASILGGLKANYSNSAPKVVYYSARGPDPEDSFLDDADILKPNLVAPGNSIWAAWSSLGTDSVEFQGENFAMMSGTSMAAPHIAGLAALIKQKFPSFSPSAIASALSSTASLYDNNGGPIMAQRAYANPDLNQSPATPFDMGSGFVNATAALDPGLIFDSSYDDYMSFLCGINGSSPVVLNYTGQNCLSYNSTINGTDLNLPSITIAKLYQSRMVQRSVTNIAGNETYKVGWSAPYGVTVKVVPACFSIASGERQVLSVFFDAIMNSSTASHGRIGLFGDQGHVLNIPLSVIVKV

SEQ ID NO: 9753 - protein, 837 aa, Populus trichocarpa
MVLSLGVLAGTLCQVDDGSENGTTAVYIVTLKQAPASHYYGELRKNTNVFKHGVPRNPKQSHNPRNDSRSNQSSSSYIARVHDSLLRRVLRGEKYLKLYSYHYLINGFAVLVTPEQANKLSRRKEVANVALDFSVRTATTHTPQFLGLPQGAWPKAGGYETAGEGIVIGFIDTGIDPSHPSFSDDSSLNSYPVPSHFSGICEVTRDFPSGSCNRKLIGARHFAASAITRGIFNSSQDYASPFDGDGHGTHTASVAAGNHGIPVIVARHHFGNASGMAPRAHVAVYKALYKSFGGFAADVVAAIDQAAQDGVDVLSLSITPNRRPPGIATFFNPIDMALLSAVKAGIFAVQAAGNTGPSPKSMSSFSPWIFTVGAASHDRAYSNSIILGNNVTIHGVGLAPGTHKNTMLTLISALHALNNETTVATDMYVGECQDSSNFNQDLVKGNLLICSYSIRFVLGLSTIKQAIATAKNLSAAGVVFYMDPFVIGFQLNPIPMRVPGIIIPSPDDSKVLLQYYNSSLERNETTKKITRFGSVASILGGLKANYSNSAPKVMFYSARGPDPEDNFLDDADILKPNLIAPGNLIWAAWSSLGTDSVEFQGENFALMSGTSMAAPHIAGLAALIKQKFPSFSPAAIASALSTTASLYDNNGGPIMAQRAYSNPDLNQSPATPFDMGSGFVNATAALDPGLIFDSSYDDYMSFLCGINGSSPVVLNYTGQNCLSYNSTINGTDLNLPSITIAKLYQSKTVQRSVTNIAGGETYKVGWSAPYGVTIKVAPTRFCIASGERQTLSVFFDAKMNSSTASYGRIGLFGDQGHVVNIPLSVIVKVTYNTTTNI

SEQ ID NO: 9754 - protein, 825 aa, Glycine max
MGNIYVAHLVVVVVVFCFLPCLCQGDSDDATTSDVYVVTLRHAPVSHYYGGLRREVNGFKDAAAAPGRTQFNKPRRYGNITKTDKRYGSYISRVHDSLLKKVLNGEKYLKLYSYHYLINGFAVLVTQQQAEKLSRSSEVSNVVLDFSVRTATTHTPQFLGLPQGAWFQDGGFETAGEGVVIGFVDTGIDPTHPSFDDNKYEKPYPVPAHFSGICEVTRDFPSGSCNRKLVGARHFAASAITRGIFNSTQDYASPFDGDGHGTHTASVAAGNHGIPVIVAGHHFGNASGMAPRSHIAVYKALYKSFGGFAADVVAAIDQAAQDGVDIISLSITPNRRPPGVATFFNPIDMALLSAVKQGIFVVQAAGNTGPSPTSMFSFSPWIYTVGAASHDRVYSNSIFLGNNVTIPGVGLAPGTDESKLYKLIHAHHALSNDTTVADDIYSIRFVLGLSTIKRASETAKNLSAAGVVFYMDPFVIGFQLNPVPMKMPGIIIASTNDSKVLTQYYNSSLEIDAVSKKIVKFGAVATICGGLKPNYSNVAPKVMYYSARGPDPEDSLPHEADILKPNLLAPGNFIWAAWSSVGTDSVEFLGENFALMSGTSMAAPHVAGLAALIRQKFPNFSPAAIGSALSTTASLYDKSGGPIMAQRSYASPDQNQPPATPFDMGSGFVNASGALNPGLVFDSGYDDYMSFLCGINGSAPVVLNYTGQNCALYNLTVYGPDLNLPSITISKLNQSRIVQRTVQNIAQNESYSVGWTAPNGVSVKVSPTHFCIGSGERQVLSVLLNATLSSSVASFGRIGLFGNQGHVVNIPLSVMVKISSNTTTS

SEQ ID NO: 9755 - protein, 864 aa, Glycine max
MWVGEELLSSLLLLFTFAGVVFDPTGSSAFVLLFPYKILMGNINVAHLVVVVLFCFGLFLPCLCQGNSDDATTDVYVVTLRHAPVSHYYGELRREVNGFKDAAAPGRTQFNKPRRYDNITKTDKRYDSYISRVHDSLLKKVLNGEKYLKLYSYHYLINGFAVLVTQQQAEKLSRSSEVSNVVLDFSVRTATTHTPQFLGLPEGAWFQDGGFETAGEGVVIGFVDTGIDPTHPSFDDNKYEKPYPVPAHFSGICEVTRDFPSGSCNRKLVGARHFAASAITRGIFNSTQDYASPFDGDGHGTHTASVAAGNHGIPVIVAGHHFGNASGMAPRSHIAVYKALYKSFGGFAADVVAAIDQAAQDGVDIISLSITPNRRPPGVATFFNPIDMALMSAVKQGIFVVQAAGNTGPSPTSMFSFSPWIYTVGAASHDRVYSNAIFLGNNVTIPGVGLASGTDESKLYKLIHAHHSLSNDTTVADDIYSIRFVLGLSTIKQASETAKNLSAAGVVFYMDPFVIGFQLNPVPMKMPGIIIASTNDSKVLMQYYNSSLEIDAVSNKIVKFGAVASICGGLKANYSNVAPKVMYYSARGPDPEDSLPHEADILKPNLLAPGNFIWAAWSSVGTESVEFLGENFALMSGTSMAAPHVAGLAALIRQKFPNFSPAAIGSALSSTASLYDKSGGPIMAQRSYASPDLNQSPATPFDMGSGFVNASGALNPGLVFDSGYDDYMSFLCGINGSAPVVLNYTGQNCGLYNSTVYGPDLNLPSITISKLNQSRIVQRTVQNVAQNESYSVGWTAPYGVSVKVSPTHFCIPSGESQVLSVLLNATLNSSVASFGRIGLFGNQGHVVNIPLSVMVKISYNTTTS

SEQ ID NO: 9756 - protein, 842 aa, Vitis vinifera
MESVYWVHLMVVLCLGTFMGIVCQDGADEVTAVYIVTLKQTPTSHYYGELRKGTNVFRHGVPGKLDRLHTPRRNISRSDPHYNSYISRVHDSLLRRALRGEQYLKLYSYHYLINGFAVFVTSQQAEKLAKRREVANVVLDFSVRTATTHTPQFLGLPQGAWVQEGGYDSAGEGIVIGFIDTGIDPTHPSFAVDRSEVAYPVPAHFSGICEVTPDFPSGSCNRKLVGARHFAASAITRGIFNASQDYASPFDGDGHGTHTASIAAGNHGIPVVVAGHHFGNASGMAPRAHIAVYKALYKSFGGFAADVVAAIDQAAQDGVDIVSLSITPNRRPPGIATFFNPIDMALLSAVKAGIFVVQAAGNTGPSPKSVSSFSPWIFTVGAAAHDRAYSNSIVLGNNVTIPGVGLAPGTHRGRMYTLVSALHALNNDTTIANDMYVGECQDSSSLKQDLVQGNLLICSYSIRFVLGLSTIKQALQTAKNLSAAGVVFYMDPFVIGFQLNPIPMKMPGIIISSPDDSKIFLQYYNHSLERQGSTKEIVKFGAAASISGGLKPNYSNSAPKVMYYSARGPDPEDSFLDDADIMKPNLVAPGNFIWAAWSSLGTDSVEFLGENFAMMSGTSMAAPHVSGLAALIKQKFPKFSPSAIGSALSTTASLYNRNGGPIMAQRAYANPDLNQSPATPFDMGSGFVNATAALDPGLIFDASYDDYMSFLCGINGSAPMVLNYTGEMCGVSTMNGTDINLPSITIARLEQTRTVQRRVTNVDSNETYIVGWSAPYGVSVNVVPTHFFIACGETQTLTVTLSATMNSTAASFGRIGLVGKGGHIVNIPVAVIFKAKYNNTNR

SEQ ID NO: 9757 - protein, 452 aa, Glycine max
MVTSELSNHQNNNSPMMAKPHRNKTSSVFLSDGSLFLGGAFSALILVWGFSSFTTTIPKETPNFESLTKNDAVPHHGTPDFNFDPPDRTFYDDPQMGYTMDKKVRNWDEKREEWLKLHPSFAAGARERVFMVTGSQPKPCRNPIGDHLLLRFFKNKVDYCRLHGCDVFYNNALLDPKMFAYWAKYPVVRAAMVAHPEAEWIWWVDSDALFTDMEFKLPLERYREHNLVVHGWAHLIHEKRSWTGLNAGVFLIRNCQWSLDFMEAWASMGPQTPNYEKWGQTLRSTFKDKFFPESDDQTGLAYLIAIEKDKWADRIYLESEYYFEGYWEEILGTFQNITEKYNEMEKGVSRLRRRHAEKVSETYGEMREEYLKDAGNGKGSWRRPFITHFTGCQPCSGKYNAMYSADDCWNGMQKALNFADNQVMRKFGYMRPDLLDNAISPVPFDYPRSLRH

SEQ ID NO: 9758 - protein, 449 aa, Glycine max
MVKSELSNHYHNNNKSPMMMAKPHRNKSSSLFLSDGCLFLGGAFSALILVWGFSSFTTTIPNDTPNFESLSKNDAASHHIAPDFNFDPPDRTFYDDPQMGYTMDKKVRNWDEKREEWLKLHPSFAAGARERVFMVTGSQPKPCRNPTGDHLLLRFFKNKVDYCRLHGCDIFYNNALLEPKMFAYWAKYPAVRAAMVAHPEAEWIWWVDSDALFTDMEFKLPLERYREHNLVVHGWAHLIHEKRSWTGLNAGVFLIRNCQWSLDFMEAWASMGPQSPNYEKWGQTLRSTFKDKFFPESDDQTGLAYLIAMEKDKWAERIYLESEYYFEGYWEEIQGTFKNITEKYKEMEKGVQRLRRRHAEKVSETYGEMREEYLKDAGNAKGSWRRPFITHFTGCQPCSGKYNAMYSAHDCWNAMHNALNFADNQVMRKFGYSLLDNAVSPLPFDYPRH

SEQ ID NO: 9759 - protein, 446 aa, Medicago truncatula
MVTTELSHSHFSSIMAKPIPRNKSSSIFLSDGFLFLGGAFSALLLVWGFSSFTNPIPNDNLTLKSHKNNVVSYSTPDLRFDPPDQTFYDDPEMEYTMSVKLEDWDEKREEWLKHHPSFSAGAKERVLMVTGSQPSPCKNPIGDHLLLRFFKNKVDYSRIHGYDIFYNNALLHPKMFAYWAKYPVVKAAMMAHPEAEWIWWVDSDALFTDMDFKLPLKRYKDHNLVVHGWPHLIHEKRSWTGLNAGVFLIRNCQWSLDFMEAWAGMGPQSPDYEEWGKTLRSTFKDKFFPESDDQTGLAYLIAIEKEKWGDKIYLEGEYYFEGYWEEIVETFSNISKKYEDIEKVEPKLRRRYAEKVSEAYGVIREEYLKDAGYGKGSWRRPFVTHFTGCQPCSGKYNEMYTADACWNGMKKALNFADNQVMRKFGFVHKDLGDNGVSSLPFDYPQP

SEQ ID NO: 9760 - protein, 449 aa, Senna occidentalis
MAKSVRNKSSLWFSDGCLFLGGAFSALLLVWGFWSFIAPIPITDPNFDSVSTKLKTLKNPRTVPSTVICSTSAAETTTVPNLRHDPPEATFYDDPETSYTLDKPMKNWDEKRQEWLNRHPSFSAGAKSRILLVTGSQPTPCKNPIGDHLLLRFFKNKVDYCRLHGYDIFYNNALLQPKMHTYWAKYPVVRAAMMAHPEAEWIWWVDSDALFTDMEFKLPLNRYKNHNLIVHGWPTLIHEAKSWTGLNAGVFLIRNCQWSLDFMDVWASMGPQTPSYEKWGEKLRTTFKDKAFPESDDQTGLAYLIAVEKEKWADRIYLESEYYFEGYWKEIVETYENITDKYHEVERKVRSLRRRHAEKVSESYGAVREPYVMVAGSGRGSWRRPFITHFTGCQPCSGNHNAMYSPDACWNGMNKALIFADNQVLRKFGYVHPDLQDNSVSPIPFDYPA

SEQ ID NO: 9761 - protein, 346 aa, Glycine max; identical to SEQ ID NO: 9740

SEQ ID NO: 9762 - protein, 346 aa, Glycine max; identical to SEQ ID NO: 9739

SEQ ID NO: 9763 - protein, 360 aa, Medicago truncatula
MSSIIKFSRFFSAVMTVIIISPSLHSSHYPALAIRSSIIHHIPHHDYRFYFHTSPFFRNADQCEPISREIGACHPSLVHVAITLDVEYLRGSIAAVHSILYHASCPENVFFHFLVTDTDLETLVRTTFPQLRFKVYYFDRNIVKNLISTSVRQALEQPLNYARNYLADLLESCVKRVIYLDSDLVLQDDIAKLWNTDLGLNTIGAPQYCHANFTKYFTAAFWSDPVFSTTFEKRKACYFNTGVMVMDLVKWRKKGYTERIERWMEIQKVERIYELGSLPPFLLVFAGHVAAIEHRWNQHGLGGDNVKGSCRDLHPGPVSLLHWSGSGKPWRRLDESKPCPLDALWEPFDLYGHRRRYESL

SEQ ID NO: 9764 - protein, 371 aa, Glycine max; identical to SEQ ID NO: 9731

SEQ ID NO: 9765 - protein, 379 aa, Glycine max; identical to SEQ ID NO: 9729

SEQ ID NO: 9766 - protein, 380 aa, Pisum sativum; identical to SEQ ID NO: 8013

SEQ ID NO: 9767 - protein, 547 aa, Phaseolus vulgaris
MMEEEQKLVKGGTNLEGSEAKLELTVDEVVEEYVGSLGFSQLVHVLLVSLAWIFDAQSTLVTIFSDAQPSAWRCKSGFCNNSSSSSSTGSVCELVPGTWEWVGGHTSSIIAEWNLICDRRFLAAVPASVYFLGSLIGSGVYGHLSDTWLGRKRSVQLSCILTSITAFATSLSPNIWTYAFFRFTNGFARSGIGICCLVLTTESVGRKWRGQVGQYGFFFFTIGFLTLPLVAYPTRTHWRSLYKLLSLLPLAYSVLILPLVSESPRWLLIRGRTKEALQVLDRFARLNGKQKLPTNLTLTNPSGSSNVAPCTTSEGGERTPNNKENLWTTKWAAIRMVTVMLAGFGVGFVYYGVQLNVENLNFNLYVSVALNALMEIPAVVIGTFLLGFTNRRLLLSVSSYIAAVSSILCTFFSHRGKTSKVHSNHGGSWAQLIIEAIGFMGASTTFDILYIYCVELFPTNVRNFAVSMLRQAIMLGASVAPLLVVLGRLSPSLSFFVFGAFSISSGVLSLWLPETRNAPLYETLKQQEEEEKHNWVSHNDCALELGQ

SEQ ID NO: 9768 - protein, 543 aa, Glycine max
MEEEQKLVKEGTNLEGSESETKLELTVDEVVEEYVGSLGFSQMVHVLLVSLAWIFDAQSTLATIFSDAQPPVWRCKTGLCQGNNNNNSTGSVCGLVPGTWEWVGGNTSSIIAEWNLVCDRRFLAAVPASVYFLGSLIGSGVYGHLSDSLLGRKKTVQLSCILTSITAFATSLSPNIWIYAFFRFANGFARSGIGISCLVLTTESVGCKWRGQVGQYGFFFFTIGFLTLPLVAYPTRTCWRNLYKLLSLLPLAYSVLLLPLVSESPRWLLIRGRSKEALQVLDKFARLNGKKKLPDNLSLVNPCGSQNGESDETSPNNNKENLWTTKWAAIRMVTVMLSGFGVGFVYYGVQLNVENLNFNLYVSVAINALMEIPAVVIGTFLLGFTNRRLLLSMSSYIAAVSSILCTFLSHKGSTSKVHNNNSGNWGQLIIEAIGFMGASTAFDILYIYCVELFPTNVRNFAVSMLRQALMLGASVAPLLVVLGRLSPSISFLVFGVLAISSGVLSICLPETRNAPLYETLKQQEEEEKHNWVSHNDCALEMGK

SEQ ID NO: 9769 - protein, 540 aa, Glycine max
MEEEQKLVKGTTNLEGSESEAKLELTVDEVVEEYVGSLGFSQMVHVFLVSLAWIFDAQSTLATIFSDAQPPAWRCKTGLCHGNNNSTGSVCGLVPGTWEWVGGNTSSIIAEWNLVCDRRFLAAVPASVYFLGSLIGSGVYGHLSDSWLGRKKTVQLSCILTSITAFATSLSPNIWTYVFFRFANGFTRSGIGICCLVLTTESVGRKWRGQVGQYGFFFFTIGFLTLPLVAYPTRTCWRNLYKLLSLLPLAYSLLLLPLVSESPRWLLIRGRDKEALQVLDRFARLNGKKKLPNNLTLVNPCGSSCDETSPNNNKENLWTTKWAAIRMVTVMLAGFGVGFVYYGVQLNVENLNFNLYVSVAINALMEIPAVVIGTFLLGFTNRRLLLSVSSYIAAVSSILCTFFSHKGGTSKVHNNNSYGGNWGQLIIEAIGFMGASTAFDILYIYCVELFPTNVRNFAVSMLRQAIMLGASVAPLLVVLGRLSPSLSFLVFGVFAISSGVLSIWLPETRNAPLYETLKQQEEEEKHSWMSQNDCALEMGK

SEQ ID NO: 9770 - protein, 824 aa, Glycine max; identical to SEQ ID NO: 9750

SEQ ID NO: 9771 - protein, 824 aa, Glycine max; identical to SEQ ID NO: 9749

SEQ ID NO: 9772 - protein, 864 aa, Glycine max; identical to SEQ ID NO: 9755

SEQ ID NO: 9773 - protein, 449 aa, Glycine max; identical to SEQ ID NO: 9758

SEQ ID NO: 9774 - protein, 452 aa, Glycine max; identical to SEQ ID NO: 9757

SEQ ID NO: 9775 - protein, 162 aa, Glycine max
GMGGLGKTTPCGAERQRSSGKRVRQGTEGLREGRTSSRDSCSEESKGGCWWESEKKVLVTTKENIIVHKTRPIFVGMEVLLILDDVAGMKCKVLLILRQVYKRWKERCIRDAKNNWRRVQRGKDNRCWMCETTKPANKTRDSSAPHSPTCSVVFATSGLPLA

SEQ ID NO: 9776 - protein, 112 aa, Glycine max
GMGGVGKTTLARAIYNLIADQFEVLCFLDNVRENSIKNGLVHLQETLLSKTIGEKGIKLGSINEAIPIIKHRLHRKKVLLVLDDVDKPDQLHAIAGGMDWFGSGSKIIITTR

SEQ ID NO: 9777 - protein, 143 aa, Arachis hypogaea
SIGMGGVGKTTLARAVYNLIADQFEGLCFLEHVRENSIKYGLAYLQEILLSKVLGKKDIKLASVGEGTSTIRQRFSRKKILLVLDDVDKLEQLRMIAGGLDWFGYGSRVIITTRNKHLLAAHGVERTYEVDDLTMEESLELLN

SEQ ID NO: 9778 - protein, 351 aa, Glycine max
MDGGCVTDETTTSSDSLSVPPPSRVGSVASAVVDPDGCCVSGEAESRKLPSSKYKGVVPQPNGRWGAQIYEKHQRVWLGTFNEEDEAARAYDIAALRFRGPDAVTNFKPPAASDDAESEFLNSHSKFEIVDMLRKHTYDDELQQSTRGGRRRLDADTASSGVFDAKAREQLFEKTVTPSDVGKLNRLVIPKQHAEKHFPLSGSGDESSPCVAGASAAKGMLLNFEDVGGKVWRFRYSYWNSSQSYVLTKGWSRFVKEKNLRAGDAVQFFKSTGPDRQLYIDCKARSGEVNNNAGGLFVPIGPVVEPVQMVRLFGVNLLKLPVPGSDGVGKRKEMELFAFECCKKLKVIGAL

SEQ ID NO: 9779 - protein, 362 aa, Glycine max
MDGGSVTDETTTTSNSLSVPANLSPPPLSLVGSGATAVVYPDGCCVSGEAESRKLPSSKYKGVVPQPNGRWGAQIYEKHQRVWLGTFNEEDEAARAYDIAAHRFRGRDAVTNFKPLAGADDAEAEFLSTHSKSEIVDMLRKHTYDNELQQSTRGGRRRRDAETASSGAFDAKAREQLFEKTVTQSDVGKLNRLVIPKQHAEKHFPLSGSGGGALPCMAAAAGAKGMLLNFEDVGGKVWRFRYSYWNSSQSYVLTKGWSRFVKEKNLRAGDAVQFFKSTGLDRQLYIDCKARSGKVNNNAAGLFIPVGPVVEPVQMVRLFGVDLLKLPVPGSDGIGVGCDGKRKEMELFAFECSKKLKVIGAL

SEQ ID NO: 9780 - protein, 384 aa, Medicago truncatula
MELGGSSTDETVTSNDSLSANLSTPPPTLNSLSRVGSAASSVVDPEIYGVSGEAESRKLPSSKYKGVVPQPNGRWGAQIYEKHQRVWLGTFNEEDEAARAYDIAALRFRGKDAVTNSKSLTGVGNDADEGETEFLNSHSKSEIVDMLRKHTYDDELKQSMRDMSGGRQRRNGELNGAVSRGACDAKAREQLFEKTVTPSDVGKLNRLVIPKQHAEKHFPLNAVAVAVACDGVSTAAAAAKGLLLNFEDVGGKVWRFRYSYWNSSQSYVLTKGWSRFVKEKNLRAGDAVRFFRSTGPDRQLYIDCKARSIGVVGGQVDNNNNNTGGLFITVRPVVEPVQMVRLFGVNLLKLPGSEGVGGSCNGKRKEMELFALECSKKPKIIGAL

SEQ ID NO: 9781 - protein, 387 aa, Galega orientalis
MEGGSCIDETTTTSNDSLSVSIFPAKLSPPPTNTLSRVGSGASAIFDPEICAGSGEAESRKLPSSKYKGVVPQPNGRWGAQIYEKHQRVWLGTFNEEDEAARAYDIAALRFRGKDAVTNSKTLAGAGNDNDEAETEFLNSHSKSEIVDMLRKHTYDDELRQSMRDTCGGRQRRNGESSAAASRGACDSNAREQLFEKTVTPSDVGKLNRLVIPKQHAEKHFPLGAVAAAVSVAVDGISPAVSAAKGLLLNFEDIGGKVWRFRYSYWNSSQSYVLTKGWSRFVKEKNLRAGDAVQFCRSTGPDRQLYIDCKARSVSVVGVGIGNTYTDNLFIPVRPVVEPVQMVRLFGVNLLKLPGSDGVGGSCNGKRKEMDLFTLECTKKPKIIGAL

SEQ ID NO: 9782 - protein, 401 aa, Glycine max
MDAISCMDESTTTESLSISLSPTSSSEKAKPSSMITSSEKVSLSPPPSNRLCRVGSGASAVVDPDGGGSGAEVESRKLPSSKYKGVVPQPNGRWGAQIYEKHQRVWLGTFNEEDEAARAYDIAAQRFRGKDAVTNFKPLAGADDDDGESEFLNSHSKPEIVDMLRKHTYNDELEQSKRSRGVVRRRGSAAAGTANSISGACFTKAREQLFEKAVTPSDVGKLNRLVIPKQHAEKHFPLQSSNGVSATTIAAVTATPTAAKGVLLNFEDVGGKVWRFRYSYWNSSQSYVLTKGWSRFVKEKNLKAGDTVCFHRSTGPDKQLYIDWKTRNVVNNEVALFGPVGPVVEPIQMVRLFGVNILKLPGSDTIVGNNNNASGCCNGKRREMELFSLECSKKPKIIGAL

SEQ ID NO: 9783 - protein, 384 aa, Glycine max
MDAISCLDESTTTESLSISQAKPSSTIMSSEKASPSPPPPNRLCRVGSGASAVVDSDGGGGGGSTEVESRKLPSSKYKGVVPQPNGRWGSQIYEKHQRVWLGTFNEEDEAARAYDVAVQRFRGKDAVTNFKPLSGTDDDDGESEFLNSHSKSEIVDMLRKHTYNDELEQSKRSRGFVRRRGSAAGAGNGNSISGACVMKAREQLFQKAVTPSDVGKLNRLVIPKQHAEKHFPLQSAANGVSATATAAKGVLLNFEDVGGKVWRFRYSYWNSSQSYVLTKGWSRFVKEKNLKAGDTVCFQRSTGPDRQLYIDWKTRNVVNEVALFGPVVEPIQMVRLFGVNILKLPGSDSIANNNNASGCCNGKRREMELFSLECSKKPKIIGAL

SEQ ID NO: 9784 - protein, 412 aa, Medicago truncatula
MDGGSCIDESTTTESFSITISPTKKPSTPPPPNSLCRVGSGASAVVDSDGSGVGEAESRKLPSSKYKGVVPQPNGRWGAQIYEKHQRVWLGTFNQEDEAAKAYDVAAQRFRGKDAVTNFKPLSDHNNDDMELEFLNSHSKSEIVDMLRKHTYNDELEQSKRSHGFVSRRSHGCSDSVNFASSAYNTDKKAREALFEKVVTPSDVGKLNRLVIPKQHAEKHFPLQKADCVQGSASAAGKGVLLNFEDIGGKVWRFRYSYWNSSQSYVLTKGWSRFVKEKNLKAGDTVCFQRSTGPEKQLFIDWKARKNVNEVGLFVPVGPVVEPVQMVRLFGVNILKQLPGSDVNSNGNVIAGFCNGKRKELNMFTFDSCKKPKIIGAFKIASKEAGSRDLEMPLWVLPSGLFAKENVKTTQS

SEQ ID NO: 9785 - protein, 900 aa, Glycine max
MDFIGPVLELIIRMWDCCACVREFEENLSCLRDIASDLRGVWIDVSVRVEVAEAQYLRRLNEVNDWLDKVEAMQREVEAIQQKVSQVQETHSRCLGSFCPGNFPTSCWMGRVIAQKIGEIRELIDKGHFDVVAQEMPHALVDEIPLEATVGLESTFDELGACFDDNHVGVIGLYGMGGVGKTTLLKKFNNEFLPTAFYDVVVWVVVSKEADVGNVQQSILEKLKVPDGKWVGKAINERAIVLYNILKRKKFVLLLDDLWERIDLLKLGIPLPDTNNGSKVIFTTRSMEVCRYMEANRCIKVECLAPKAAFELFKEKVGEETLNSHPEIFHLAQIMAKGCEGLPLALITVGRPMARKSLPEWKRAIRTLKNYPSKFSGMVKDVYCLLEFSYDSLPSAIHKSCFLYCSIFPEDYDIREDELIQLWIGEGLLAEFGDDVYEARNQGEEIIASLKFACLLEDSERENRIKMHDVIRDMALWLACDHGSNTRFLVKDGASSSSAEAYNPAKWKEVEIVSLWGPSIQTFSGKPDCSNLSTMIVRNTELTNFPNEIFLTANTLGVLDLSGNKRLKELPASIGELVNLQHLDISGTDIQELPRELQKLKKLRCLLLNYICNRIVFPRSLISSLLSLQVFSKLPWEDQCILPDLREPEETVLLQELECLEFLQDISIALFCFSSMQVLQKSPKLQRFIRLRVISHFNSMPHVILFSLLRKMQHLEVLSISISSSPSLVSDMKKESPSHDSMSECIPMSSKLTEHNYTVNLRELSLEGCGMFNLNWLTCAPSLQLLRLYNCPSLEEVIGEEFGHAVNVFSSLEIVDLDSLPKLRSICSQVLRFPCLKEICVADCPRLLKLPFDSSSARNSLKHINGQKNWWRNLKWEDEATRDLFRSKYVPFRSKIRRKN

SEQ ID NO: 9786 - protein, 1010 aa, Glycine max
MEAKFGAEAYHFYGVGASSDLRGVGKRSSEWDLNDWRWDGDLFIASRLNPVPADGVGVGQQFFPIGSGIPVAGGPSNSSSTSEEVDPRDPKANKEGDKKRRVIVLEDDGLNEEGGTLSLKLGGHASAVVDREVGSWDGTNGKKSRVSGSTSNRAVCQVEDCSADLSKAKDYHRRHKVCEMHSKASRALVGNAMQRFCQQCSRFHLLQEFDEGKRSCRRRLAGHNKRRRKTNHEAVPNGSSLNDDQTSSYLLISLLKILSNMHSDRSDQTTDQDLLTHILRSLASQNGEQGGKNIANLLREPENLLREDGSSRKSEMMSTLFSNGSQGSPSNIRQHETVSMAKMQQQVMHAHDAGASDQQITSSIKPSMSNSPPAYSEARDSTAGQIKMNNFDLNDIYIDSDDGMEDLERLPVSTNLVTSSLDYPWAQQDSHQSSPPQTSGNSDSASAQSPSSSSGEAQSRTDRIVFKLFGKEPNDFPLVLRAQILDWLSHSPTDMESYIRPGCIVLTIYLRQAEALWEELCYDLTSSLNRLLDVSDDTFWRNGWVHIRVQHQMAFIFNGQVVIDTSLPFRSNNYSKILTVSPIAVPASKRAQFSVKGVNLIRPATRLMCALEGKYLVCEDDHMSMDQCSKEPDELQCVQFSCSVPVMNGRGFIEIEDQGLSSSFFPFIVVEEDVCSEICTLEPLLELSETDPDIEGTGKIKAKNQAMDFIHEMGWLLHRSQLKLRMVSSVDLFPLKRFKWLIEFSMDHDWCAAVRKLLNLLFDGTVNTGDHPSLYLALSEMGLLHKAVRRNSKHLVELLLRYVPENISDKLGPEEKALVDGENQTFLFRPDVDGTAGLTPLHIAAGKDGSEDVLDALTNDPCMVGIEAWKNARDSTGSTPEDYARLRGHYAYIHLVQKKINKKQGAAHVVVEIPSNMTENNTNKKQNELSTIFEIGKPEVRRGQGHCKLCDNRISCRTAVGRSMVYRPAMLSMVAIAAVCVCVALLFKSSPEVICMFRPFRWENLDFGTS

SEQ ID NO: 9787 - protein, 1003 aa, Medicago truncatula
MGERLGAENYHFYGVGGSSDLSGMGKRSREWNLNDWRWDGDLFIASRVNQVQAESLRVGQQFFPLGSGIPVVGGSSNTSSSCSEEGDLEKGNKEGEKKRRVIVLEDDGLNDKAGALSLNLAGHVSPVVERDGKKSRGAGGTSNRAVCQVEDCGADLSRGKDYHRRHKVCEMHSKASRALVGNAMQRFCQQCSRFHILEEFDEGKRSCRRRLAGHNKRRRKTNQEAVPNGSPTNDDQTSSYLLISLLKILSNMHSDRSDQPTDQDLLTHLLRSLASQNDEQGSKNLSNLLREQENLLREGGSSRNSGMVSALFSNGSQGSPTVITQHQPVSMNQMQQEMVHTHDVRTSDHQLISSIKPSISNSPPAYSETRDSSGQTKMNNFDLNDIYVDSDDGTEDLERLPVSTNLATSSVDYPWTQQDSHQSSPAQTSGNSDSASAQSPSSSSGEAQSRTDRIVFKLFGKEPNEFPLVLRAQILDWLSQSPTDIESYIRPGCIVLTIYLRQAEAVWEELCCDLTSSLIKLLDVSDDTFWKTGWVHIRVQHQMAFIFNGQVVIDTSLPFRSNNYSKIWTVSPIAVPASKRAQFSVKGVNLMRPATRLMCALEGKYLVCEDAHESTDQYSEELDELQCIQFSCSVPVSNGRGFIEIEDQGLSSSFFPFIVAEEDVCTEIRVLEPLLESSETDPDIEGTGKIKAKSQAMDFIHEMGWLLHRSQLKYRMVNLNSGVDLFPLQRFTWLMEFSMDHDWCAVVKKLLNLLLDETVNKGDHPTLYQALSEMGLLHRAVRRNSKQLVELLLRYVPDNTSDELGPEDKALVGGKNHSYLFRPDAVGPAGLTPLHIAAGKDGSEDVLDALTNDPCMVGIEAWKNARDSTGSTPEDYARLRGHYTYIHLVQKKINKTQGAAHVVVEIPSNMTESNKNPKQNESFTSLEIGKAEVRRSQGNCKLCDTKISCRTAVGRSMVYRPAMLSMVAIAAVCVCVALLFKSSPEVLYMFRPFRWESLDFGTS

SEQ ID NO: 9788 - protein, 994 aa, Medicago truncatula
MEAFQLYGNGGGSSDLRAMGKNSKEWDLNNWKWDSHLFIATSKLTPVPEHRQFLPIPVGGGGGGGGSNSNSSSSCSEQLDLGICQVKEGERKRRVIVVEDELGLGLNKEGGNLSLNLGGGVATWEGNNGKKSRVAGGGSSSRAFCQVEDCRADLNNAKDYHRRHKVCEIHSKASKALVGNAMQRFCQQCSRFHLLQEFDEGKRSCRRRLAGHNKRRRKTNQDAVPNGSSPNDDQTTDRSNQTADQDLLTHLLRSLANQNGEQGGRNLSNLLREPENLLKEGSLSGKSEMVSTLVTNGSQGSPTVTVQNQTVSISEIQHQVMHSHDARVADQQTTFSAKPGVSNSPPAYSEARDSTAGQTKMNDFDLNDIYIDSDDGIEDIERLPVTTNLGASSLDYPWMQQDSHQSSPPQTSGNSDSASAQSPSSSTGETQNRTDRIVFKLFGKGPGDFPLVLKAQILDWLSHSPTDIEGYIRPGCVVLTIYLRQAEVVWEELCFDLTSSLNRLLGVSDDDFWRTGWVHIRVQHQMAFIFNGSNCTFSAAGQIVIDTPLPFRSNNYGKILSVSPIAIPSSKTAQFSVKGINLTRPATRLLCALEGNYLDCEDTDEPMDQCSKDLDELQCIQFSCSVPAMNGRGFIEIEDQGLSSSFFPFIVVEEDVCSEICVLEPLLESSDTYPDNEGAGKIQAKNQAMDFIHEMGWLLHRRQIKSSVRLNSSMDLFPLDRFKWLMEFSVDHDWCAVVKKLLNLMLDGTVSTGDHTSLYLALSELGLLHRAVRRNSRQLVELLLRFVPQNISDKLGPEDKALVNGENQNFLFRPDAVGPAGLTPLHIAAGKDGSEDVLDALTNDPCMVGIEAWNSARDSTGSTPEDYARLRGHYTYIHLVQKKINKSQGGAHVVVDIPSIPTKFDTSQKKDESCTTFQIGNAEVKKVRKDCKLCDHKLSCRTAVRKSFVYRPAMLSMVAIAAVCVCVALLFKSSPEVLYIFRPFRWESLDYGTS

SEQ ID NO: 9789 - protein, 1012 aa, Ricinus communis
MEARFGGEAQAHHFYGMSAADLRAVEKRSLEWDLNDWKWDGDLFIASPLNPVPSSNMSRQFFPIATGTPTNGNSSNSSSSCSDEVNLGIEKGKRELEKRRRVIVIEDDNLNDEGVGSLSLKLGGHGFPVSEREIGNWEGNSGKKTKLVGGSMSRAVCQVEDCGADLSSAKDYHRRHKVCEMHSKASKALVGNVMQRFCQQCSRFHVLQEFDEGKRSCRRRLAGHNKRRRKTNPDTVGNASTLNDEQTSSYLLISLLKILSNMHSNRSDQVTDQDLLSHLLRSLASQSMEHGGKKLSGLLQEPRALLNGGTSFRNSEVFLTFILNALGLLRSLKLHLIVPFSGMSQRVLCSHGANGPNVQTSSSMKPSIPNNYPAYSEVRDSTAVQVKMNNFDLNDIYIDSDDGAEDIERSPVPTNMGTSSLDCPSWIQQDSHQSSPPQTSGNSDSASAQSPSSSSGDAQSRTDRIIFKLFGKEPNDFPLVLRAQILDWLSHSPTDIESYIRPGCVILTIYLRQAEAAWEELCCNLSSSLSRLLDVSDNAFWRTGWAYIRVQHQIAFIYNGQVVVDTSLPLRSNNHSKIASVKPIAIPAAERAQFVIKGINLSRPATRLLCAVEGKYMLQENTEEMMDDIDNINAHDELQCIKFCCSIPMVSGRGFIEIEDHGFSSSFFPFIVAEEDVCLEIRMLEGTLEFVGTDADLGGSGKIEAKNQAMDFINEIGWLLHRSQLHSRLGHLNPCTDLFPLSRFKWLMEFSMDHEWCAVVTKLLNILHNGIVGTGEHSSLNLALSEMGLLHRAVRKNSRSLVELLLRYVPEKSGPGNKLPVDGSHVNFLFRPDVTGPAGLTPLHIAAGKDGSEDVLDALTDDPGMVGVEAWKKAHDSTGFTPEGYARLRGHYSYIHLVQKKINKRPAAGHVVLDIPGTLSECNVNQKQNEGVTASFEVGQPAVRSIQRSCKLCHQKLDYGTAGRSLLYRPAMLSMVAIAAVCVCVALLFKSCPEVVYVFRPFRWELLDFGTS

SEQ ID NO: 9790 - protein, 112 aa, Glycine max; identical to SEQ ID NO: 9776

SEQ ID NO: 9791 - protein, 658 aa, Medicago truncatula
MGRKERRRRKSDDSASESTSSQSNDSDRSRRSGHRSDRQSRRRRSRHESDSDNSTSDDNSSDRDGRKRKSSRKITEEEIAQYLAKKAQRKALKVAKKLKAHTVSGYSNDSNPFGDSNLNEKFVWRKKIERDVVQGVPIDEFSVKAEKKRQRERMAEIEKVKKRREERALEKARHEEEMALLARERARAEFQDWEKREVEFHFDQSKFRSEIRLREGRAKPIDILTKHLDGSDDLDIEINEPYMVFKGLTVNEMEELRDDIKMHLDFDRATPTHVEYWEALLLVSDWELAEARKKDAIDRARVRGEEPPAEVLAEQRGLHNSVEPDVKKLLQGKTHAELEALQAHIESEMRTGAAKLVEYWETVLKYLRIYKAKACLKEIHAKMLRKHLLRLKKPLEGEDKLEDAHVMKSEEDIEDYVKFQYANRSLSPEPIKAEGQEGEEVEDEAGSLSPELFHGDENEEAIDPEEDRALLEQKRLAVKEEQQRRIQEAMASKPAPSEDNFEMKAMNAMGAIEEGDVMFGSGAEVNLDSQVYWWHDKYRPRKPKYFNRVHTGYEWNKYNQTHYDHDNPPPKVVQGYKFNIFYPDLVDKTKAPTYTIEKDGSNGETCIIRFHAGPPYEDIAFRIVNKEWEYSHKKGFKCTFERGILHVYFNFKRHRYRR

SEQ ID NO: 9792 - protein, 673 aa, Glycine max
MGKSSGRDRRRRRSDDSESESPSDSDSDRRRGSSSRRSRRDSDGDRKKKSTKSESESHSDSDSDSDRRHRSSSRRPRRDSDGDRKKKSSRSITEEEITQYMTKKAQSKAMKVAKKLKTSTVSGYSNDSNPFGDSNLNEKFVWRKKIERDVSQGVSIEAFSKKAEKKKQRERMAEIEKVKKRREERALEKARHEEEMALLARERARAEFQDWEKKEEEFHFDQSKVRSEIRLREGRARPIDVLTKHLNGSDDLDIEINEPYMVFKGLTVNEMSELRDDIKMHLDLDRATPTHVEYWEALLLVCDWELAEAQRKDALDRARVRGEEPPAELLAEERGLHSSVEPDVKKLLQGKTHAELEALRVHIESEMRTGTAKVVEYWEAILKHLHIYKAKACLKEIHAKLLRKHLQSLERPLEDEDKLENAHVMVPEEEDTEDDIKVRSADESFSPEPIREDQEADDEAGSFSPQLLHSDENEEAIDPEEDRAMLERNRKAVLEEQQRRVQEAMASKPAPSEDNFEMKALKAMGDMEDGDSVFGSGAEVNLDSQVYWWHDKYRPRKPKYFNRVHTGYEWNKYNQTHYDHDNPPPKIVQGYKFNIFYPDLVDKTKAPTYTIEKDGSNGETCIIRFHAGPPYEDIAFRIVNKEWEYSHKKGFKCTFERGILHVYFNFKRHRYRR

SEQ ID NO: 9793 - protein, 670 aa, Glycine max
MGKSSGRDRRRRRSHDSESDSPSDSDSDRRHRSNSRRSRRDSDGDRKKKSSKSESESPSDSDSDIRHRSSSRRSWRDSDGDRKKSSRSITEEEITKYMARKAQSKAMKVAKKLKTSTVSGYSNDSNPFGDSNLNEKFVWRKKIERDVSQGVSIDAFSMKAEKKKQRERMAEIEKVKKRREERALEKARHEEEMALLARERARAEFQDWEKKEEEFHFDQSKVRSEIRLREGRARPIDVLTKHLNGSDDLDIEINEPYMVFKGLTVNEMSELRDDIKMHLDLDRATPTHVEYWEALLLVCDWELAEAQRKDALDRARVRGEEPPAELLAEERGLHSSVEPDVKRLLQGKTLAELEALRVHIESEMRTGTAKVVEYWEAILKHLHIYKAKACLKEIHAKLLRKHLQSLERPLEDEDKLENAHVMIPEEEDTEDDIKVQSADESFSPEPIREDQEADDEAGSFSPQLLHGDENAEAIDPEEDRAMLERNRKAVLEEQQRRVQEAMASKPTPSEDHFEMKALKAMGDMEDGDSVFGSGAEVNLDSQVYWWHDKYRPRKPKYFNRVHTGYEWNKYNQTHYDHDNPPPKIVQGYKFNIFYPDLVDKTKAPTYTIEKDGSNGETCIIRFHAGPPYEDIAFRIVNKEWEYSHKKGFKCAFERGILHVYFNFKRHRYRR

SEQ ID NO: 9794 - protein, 648 aa, Medicago truncatula
MASGSSSRKSRRRRRSDDDSASDSDSDHRRKTSRRSRRDSDDDSSDDNVNRTGRKKKSSRTITEEEISQYMAKKAQRKATKVAKKLKTNTVSGYSNDSNPFGDTNLNEKFVWRKKIERDVTQGVSIDSFSVKAEKKRQVERMAEIEKVKKRREERALEKAQHEEEMALLARERARAEFQDWEKKEEEFHFDQSKVRSEIRLREGRARPIDVLTKHLNGSDDLDIEINEPYMVFKGLTVKEMSELRDDIKMHLDLDRATPTHVEYWEALLVVCDWELAESRKKDAIDRARVRGEEPPAELLAEQRGLHSSVEPDVKDLLHGKTRTELEALQAHIESEMRTGTAKVVEYWEAILKHLHIYKAKACLKEIHAKMLRKHLQRLEQPLEDEDKPERALDMIPEEAYTEDEEDEDAKVVRSADESFSPEPVRENQEAEDEAGSFSPQLLHDDENEEAIDPEEDKAILERKRMAVMEEQQRRIQEAMASKPAPSEDNLELKAFKAMGAMEDGDAVFGSGAEVSLDSQVYWWHDKYRPRKPKYFNRVHTGYEWNKYNQTHYDHDNPPPKIVQGYKFNIFYPDLVDKIKAPNYTIEKDGSNGETCIIRFHAGPPYEDIAFRIVNKEWEYSHKKGFKCTFERGILHVYFNFKRHRYRR

SEQ ID NO: 9795 - protein, 654 aa, Vitis vinifera
MGTHGSSSRRKKSRRRSDDSDDSDTPDSSPDRSSTKRRERSRSSRRRSSSRHLDDSDSSGKSDGGGKKRSSRNITEEEIADYLAKKAQKKALRVAKKLKSQTVSGYSNDSNPFGDANLNEKFVWRKKIERDVSQGVPLDTFSVKAEKKRQRERMAEIEKVKKRREERAIEKAQHEEEMALLARERARAEFQDWEKKEEEFHFDQSKVRSDIRLREGRLKPIDILSNLLNGSDDFDMDISEPYMVFKGLTVKEMEELRDDLKMHLDMDRATPTHIEYWEALLVVCDWELAEARKKDALDRARVRGEEPPAELLAEERGLHSSIEADVKNLLQGKTYSELEVLQSHIESQMRSGTAKVVEYWEAVLKRLHIYKAKACLKEIHAKMLHKHLQYLEPHSESEDELEAEPGPEPKVEDSIQDLEDAQTFSPEPILHEEAHEAEEEAGSFSPELLHGDENEEAIDPEEDRAILERKRIAVLEEQQKRIQEAMASKPTPSEDNLELKVMKAMGAMEEGDAVFGSGAEVNLDSQVYWWHDKYRPRKPKYFNRVHTGYEWNKYNQTHYDHDNPPPKIVQGYKFNIFYPDLVDKTKAPVYTIEKDGSSGETCLIRFHAGPPYEDIAFRIVNKEWEYSHKKGFKCTFERGILHVYFNFKRYRYRR

SEQ ID NO: 9796 - protein, 631 aa, Glycine max
MSCFQSPDVDWHRRLHFAAIFCATGTSERRRRDGHLGHRRLWRGRSRQDSDSSSDESSDRGGKRKRSSRHVTEEEIAQYLAKKAQRKALKDAKKLKTRTVSGYSNDSNPFGDSNLNEKFVWRKKIELDVVQGVPIDAFSVKAEKKRQKERMAEIEKVKKRREERALEKARHEEEMALLARERARAEFHDWQKREEEFHFDQSKVRSEIRLREGRARPIDILTKHLNGSDDLDIEINEPYMVFKGLTVKEMEELHDDIKMHLDLDRDTPTHVEYWEALLLVCDWELAEARKKDAIDRARVRGEEPPADLLAEERGLHYSVEPDVKNLLQGKTHAELEAYQVHTESEMRTGTAKVVEYWEAVLKHLHIYKAKACLKEIHAKMLCKHLQRPEQPLEDEDELEDAQVRNSEDDTEHYAKGIIQYADESFSPEPIKGEVQEAKDQAGSFSPELFHGDENEEAIDPEEDRALLEQKRMAVKEEQQRQIQEAMASKPAPSEDNFEMKAMKAMGAMEDGDAVFGSGAEVNLDSEVYWWHDKYRARKPKYFNRVHTGYEWNKYNQTHYDHDNPPPKVVQGYKFNIFYPDLVDKTKAPTYTIEKDGSNGETCIIRFHAGPPYEDITLAYILVFSPTGWLPF

SEQ ID NO: 9797 - protein, 682 aa, Vitis vinifera
  misc_feature (168)..(168): Xaa can be any naturally occurring amino acid
  misc_feature (372)..(372): Xaa can be any naturally occurring amino acid
MLKANPHLAREMMNGMQVSPFYFHLHVALAENTCEKTLGLFQVPTAFVSFSLLVVLGWERTVAAVGERRVEEDPTIPTILIPLTPRRIGPPPNEENAAAAVAAGALRDIWMIPIAVEKALRVAKKLKSQTVSGYSNDSNPFGDANLNEKFVWRKKIERDVSQGVPLDXFSVKAEKKRQRERMAEIEKVKKRREERAIEKAQHEEEMALLARERARAEFQDWEKKEEEFHFDQSKVRSDIRLREGRLKPIDILSNLLNGSDDFDMDISEPYMVFKGLTVKEMEELRDDLKMHLDMDRATPTHIEYWEALLVVCDWELAEARKKDALDRARVRGEEPPAELLAEERGLHSSIEADVKNLLQGKTYSELEVLQSXIESQMRSGTAKVVEYWEAVLKRLHIYKAKACLKEIHAKMLHKHLQYLEPRSESEDELEAEPGPEPKVEDSIQDLEDAQTFSPEPILHEEAHEAEEEAGSFSPELLHGDENEEAIDPEEDRAILERKRIAVLEEQQKRIQEAMASKPTPSEDNLELKVMKAMGAMEEGDAVFGSGAEVNLDSQVYWWHDKYRPRKPKYFNRVHTGYEWNKYNQTHYDHDNPPPKIVQGYKFNIFYPDLVDKTKAPVYTIEKDGSSGETCLIRFHAGPPYEDIAFRIVNKEWEYSHKKGFKCTFERGILHVYFNFKRYRYRR

SEQ ID NO: 9798 - protein, 632 aa, Ricinus communis
MKRDKGKRKSESESKSESESYSDDLSSRHRRRRERERSRSSSKGSRRVITQEEIDEYLAKKAQKKALKVAKKLKSQSSTTVYSNDSNPFGDSNLNEKFVWRKKIERDVSQGVPLESFSIKAEKQRQKERMAEIEKVKKRREERALEKARHEEEMALLARERARAEFQDWEKKEEEFHFDQSKIRSHIRLHEGRTKPIDILSKHLNASDDMDIEIEEPFIIFKGLTVKEIEDLRDDIKMHLDMDRQTQTHVDYWEALLVVCNWELAEAQKKDALDRARVRGEEPPAELLAEERGLHSSIETDVRNLLENKTFTELEELQSHIESQMSSGTAKVVEYWEAVLKRLQIYKAKARLKEIHTKILQKHLQRLEPSLDSEDNLEHDHNLMQSEEDREHDKKDAETFSPKPVMKDETYEAEEAGSFSPELLHGDDNEDAIDPEEDRAILERKRVAVKAVIEERQRQMQEAMASKPPPSEDNFEMKAMKAMGVMEEGDALFGSGAEVNLDSQVYWWHDKYRPRKPKYFNRVHTGYEWNKYNQTHYDHDNPPPKIVQGYKFNIFYPDLVDKTKAPTYTIEKDGNSDETCIIRFHAGPPYEDIAFRIVNKEWEYSHKKGFKCTFERGILHVYFNFKRYRYRR

SEQ ID NO: 9799 - protein, 298 aa, Glycine max
MVYVKAQKSKAYFKRYQVKFKRRREGKTDYRARIRLINQDKNKYNTPKYRFVVRFSNKDIVAQIISASIAGDIVLAAAYAHELPRYGLEVGLTNYAAAYCTGLLLARRVLKTLEMDEEYEGNVEATGEDYSVEPAESRRPFRALLDVGLIRTTTGNRVFGALKGALDGGLDIPHSDKRFAGFDKEKKELDAEVHRKYVFGGHVAAYMKILAEDEPEKYQSHFSEYIKRGIEADGIEALYKNVHAAIRADPTLKKSDKQTPKEHKRYNLKKLTYEERKAKLISRVAALNSAADNDEDDE

SEQ ID NO: 9800 - protein, 298 aa, Glycine max
MVYVKAQKSKAYFKRYQVKFKRRREGKTDYRARIRLINQDKNKYNTPKYRFVVRFSNKDIVAQIISASIAGDIVLAAAYAHELPQYGLEVGLTNYAAAYCTGLLLARRVLNTLEMDEEYEGNVEATGEDYSVEPAESRRPFRALLDVGLIRTTTGNRVFGALKGALDGGLDIPHSDKRFAGFDKEKKELDAEVHRKYVFGGHVAAYMKILAEDEPEKYQSHFSEYIKRGIEADGIEALYKKVHAAIRADPTLKKSDKQPPKEHKRYNLKKLTYEERKAKLIARVASLNSAADNDEDDE

SEQ ID NO: 9801 - protein, 298 aa, Glycine max
MVYVKSQKSKAYFKRYQVKFKRRREGKTDYRARIRLINQDKNKYNTPKYRFVVRFSNKDIVAQIISASIAGDIVLAAAYAHELPRYGLEVGLTNYAAAYCTGLLLARRVLKTLEMDEEYEGNVEATGEDYSVEPAESRRPFRALLDVGLIRTTTGNRVFGALKGALDGGLDIPHSDKRFAGFDKEKKELDAEVHRKYVFGGHVAAYMKILAEDEPEKYQSHFSEYIKRGIEADGIEALYKKVHAAIRADPSLKKSEKQPPKEHKRYNLKKLTYEERKAKLIARVAAINSAADNDEDDE

SEQ ID NO: 9802 - protein, 298 aa, Glycine max
MVYVKAQKSKAYFKRYQVKFKRRREGKTDYRARIRLINQDKNKYNTPKYRFVVRFSNKDIVAQIISASIAGDLVLATAYSHELPRYGLEVGLTNYAAAYCTGLLLARRVLKTLEMDEEYEGNVEATGEDYSVEPAESRRPFRALLDVGLVRTTTGNRVFGALKGALDGGLDIPHSDKRFAGFDKEKKELDAEVHRKYVFGGHVAAYMKILAEDEPEKYQSHFSEYIKRGIEADGIEALYKKVHAAIRADPTLRKSDKQPPKEHKRYNMKKLTYEERKAKLVARVAAINSAADNDEDDE

SEQ ID NO: 9803 - protein, 298 aa, Glycine max
MVYVKAQKSKAYFKRYQVKFKRRREGKTDYRARIRLINQDKNKYNTPKYRFVVRFSNKDIVAQIISASIAGDLVLATAYSHELPRYGLEVGLTNYAAAYCTGLLLARRVLKTLEMDEEYEGNVEATGEDYSVEPAESRRPFRALLDVGLVRTTTGNRVFGALKGALDGGLDIPHSDKRFAGFDKEKKELDAEVHRKYVFGGHVAAYMKILAEDEPEKYQSHFSEYIKRGIEADGIEALYKKVHAAIRADPTLRKSDKEPPKEHKRYNMKKLTYEERKAKLIARVAAINSAADSDEDDE

SEQ ID NO: 9804 - protein, 298 aa, Glycine max
MVYVKSRKSKAYFKRYRVKFKRRREGKTDYRARIRLINQDKNKYNTPKYRFVVRFSNKDIVAQIISASIAGDIVLAAAYAHELPRYGLEVGLTNYAAAYCTGLLLARRVLKTLEMDEEYEGNVEATGEDYSVEPVESRRPFRALLDVGLIRTTTGNRVFGALKGALDGGLDIPHSDKRFAGFDKEKKELDAEVHRKYVFGGHVAAYMKILAEDEPEKYQSHFSEYIKRGIEADGIEALYKKVHAAIRADPSLKKSEKQPPKEHKRYNLKKLTYEERKAKLIARVAAINSAADNDEDDE

SEQ ID NO: 9805 - protein, 302 aa, Medicago truncatula
MVYVKAQKSKAYFKRYQVKFKRRREGKTDYRARIRLINQDKNKYNTPKYRFVVRFTNKDIVAQIVSASIAGDIVLAAAYSHELPHFGLKVGLTNYAAAYCTGLLLARRVLKTLEMDEEYEGNVEATGEDYSVEPAESRRPFRALLDVGLVKTTTGNRVFGALKGALDGGLDIPHSDKRFAGFDKEKKELDAEVHRKYIFGGHVSAYMKTLIEDEPEKYQTHFSEYIKKGIEADGLEELYKKVHAAIRADPTIKKSEKQPPKQHKRYNLKKLTYEERKAKLVSRLAALNAAVDDEDEDEDDDE

SEQ ID NO: 9806 - protein, 297 aa, Populus trichocarpa
MAFAKAQKSRAYFKRYQVKFKRRRAGKTDYRARIRLINQDKNKYNTPKYRFVVRFTNKDIIAQIASASIAGDIVLASAYAHELPRYGLEAGLTNYAAAYCTGLLLARRVLKMLEMDDEYEGNVEATGEDFSVEPADSRRPFRALLDVGLLRTTTGNRVFGALKGALDGGLDIPHSDKRFAGFAKDNKQLDAEVHRKYIYGGHVAAYMRTLMEDEPEKYQSHFSEYLKRGIDADGMEALYKKVHAAIRADPTAKKSEKQPPKEHKRYNLKKLTYEERKAKLVERLNALNSAADDEDDE

SEQ ID NO: 9807 - protein, 331 aa, Medicago truncatula
MIIVILPIFQRNEAQVSIQSTDSRGRRCPFGMAFVKAQKSNAYFKRFQVKFKRRREGKTDYRARVSLITQDANKYGTPKYRYVVRLTNKDIVCQIVSATIAGDIVLAAAYAHELPQFGLHVGLTNYAAAYCTGLLLARRVLKTLEMDDEYEGNVVATGEDYSVEPADSRRPFRALLDVGLVKTTTGNRVFGALKGALDGGLDIPHSDKRFAGFDKEKKELDAEVHRKYIFGGHVAAYMKTLMEDEPEKYQTHFSEYIKRGIEADGIEELYKKVHAAIRADPSIKKPEKQPPKEHKRYNLKKLTYEERKTKLVSRLQALNSAAGDDDEDDEE

SEQ ID NO: 9808 - protein, 298 aa, Ricinus communis
MAFVKAQKTRAYFKRFQVKYKRRREGKTDYRARIRLINQDKNKYNTPKYRLVVRFTNKDVIAQVIHSRIVGDIVLAAAYSHELPCYGLDVGLTNYAAAYCTGLLLARRVLKMLEMDEEYEGNTEATGEDYSVEPGESRRPFRALLDVGLLRTTTGNRVFGALKGALDGGLDIPHSEKRFAGFNKESKQLDSEVHRKYIYGGHVAAYMRMLLEDEPEKYQSHFSEYIKKGVDPDNMEEMYKKVHAAIRADPSAKKTEKQPPKEHKRYNLKKLTYEERKAKLIERLTALNSAADDEEDDE

SEQ ID NO: 9809 - protein, 298 aa, Glycine max; identical to SEQ ID NO: 9802

SEQ ID NO: 9810 - protein, 298 aa, Glycine max; identical to SEQ ID NO: 9799

SEQ ID NO: 9811 - protein, 297 aa, Populus trichocarpa
MAYAKAQKSKAYSKRFQVKFKRRREGKTDYRARIRLINQDKNKYNTPKYRFVVRFSNKDIVAQITSASITGDTVLASAYAHELPRYGLEVGLTNYAAAYCTGLLLARRLLKMLEMDEEYEGNVEATGEDFSVEPADTRRPFRALLDVGLVRTTTGNRVFGALKGALDGGLDIPHSEKRFAGFGKDNKQLDAEVHRKYIYGGHVAAYMRTLMEDEPEKYQSHFSEYLKREIDADCMEALYKKVHAAIRADPTTKKSEKEPLKEHKRYNLKKLTYEERKEKLVERLNTFNSAADDEDDE

SEQ ID NO: 9812 - protein, 218 aa, Populus trichocarpa
KPEQDADGVPIPVVLIDQDSDSESTIVQLSFGDRLGALIDTMNALKDLGLDVAKGTVLTEGPVKQTKFFITRLDSGRKVEDPDMLERIRLTIINNLLKYHPESSERLAMGEAFGIKAPEKKLDVDITTHVHVKEDGPKRSLLCVETADRPGLLVEIIKIIADVNIDVESAEIDTEGLVAKDKFHVSYGGAALNSSLSQVLVNCLRYYLRRPETDTESY

SEQ ID NO: 9813 - protein, 217 aa, Populus trichocarpa
SEQDADLVPMPVVLIDQDSDSDATIVQLSFGDRLGALIDTMNALKHLGLDVAKGTVLTDGPVKQTKFFITRLDTGRKVEDPDMLERIRLTIINNLLKYHPESSERLAMGEAFGIKAPEKKLDVDITTHVHVKEDGPKRSLLCIETADRPGLLVEIIKIIADVNIDVESAEIDTEGLVAKDKFHVSYRGAALTSSLSQVLVNCLRYYLRRPETDIDSY

SEQ ID NO: 9814 - protein, 214 aa, Ricinus communis
MDADVPMPVLLIDQDSDSDATSVQVSFGDRLGALIDTMKALKDLGLDVAKGSVLTEGSVKQIKFFITRLDSGRKVEDPDMLERIRLTIINNLLKYHPESSEQLAMGEAFGIKAPERKLDVDIATHIHVKDDGPKRSLLYIETADRPGLLVEMIKIMADINVDVESAEIDTEGLVAKDKFHVSYRGAALNSSMSQVLVNCLRYYLRRPETDVDSY

SEQ ID NO: 9815 - protein, 283 aa, Glycine max
MALTNAFLAPSFAVHGVGRVSDPRSIPLFSLPSDAFFRSPTSLSRDKNFLKASAYDLNAVGSASLQSGDNPDSVPMPIVLIDQESDSEATIVQLSFGDRLGALLDTMKALKDLGLDVSKGTVSTEGLVKQTKFFITQSDTGRKVEDPDMLERIRLTIINNLLKYHPESSELLAMGEVFGIKAPKKKLDDDIKTRIQVKEDGPKRSLLYIETADRPGLLVEIIKVIADVNIDVESAEIDTEGLVAKDTFHVSYGGAALNSSMAQVLVNCLRYYLRTPETDIDSY

SEQ ID NO: 9816 - protein, 282 aa, Glycine max
MTLTNAFLAPSFAVHGGRVSDPRSIPLFSLPSDAFFRSPTSLSRDKNILYASAYDLNAVGSASLQSGDNPDSLPMPIVLIDQESDSEATIVQLSFGNRLGALLDTMKALKDLGLDVSKGTVSTEGLVKQTKFFITQSDTGRKVEDPDMLERIRLTIINNLLKYHPESSELLAMGEVFGIKAPKKKLDDDIKTRIQVKEDGPKRSLLYIETADRPGLLVEIIKVIADVNIDVESAEIDTEGLVAKDTFHVSYGGAALNSSMSQVLVNCLRYYLRTPETDIDSY

SEQ ID NO: 9817 - protein, 280 aa, Vitis vinifera
MAATVHAVLSSPSSILRFRASAFHFNIPPIRFAFAQPRFTLSASTSALHASNDGIDSVPSISLSFDPDSDYVPTPMVLIDQDSDSVATIVQLSFGDRLGALVDTMKALKGLDLDVQKGTVTTEGSVTQTKFFITRIDGRKVEDPDMLERIRLTIINNLLKYHPESSEQLAMGEAFGIKAPEKKLDVDVATHIHVKDDGAKRSLLYIETADRPGLLLEIVEIITDVNVDVESAEIDTEGLVAKDKFHVSYRGAALSSSLSQVMINSLRYYLRRPETEVDSY

SEQ ID NO: 9818 - protein, 298 aa, Glycine max; identical to SEQ ID NO: 9801

SEQ ID NO: 9819 - protein, 298 aa, Glycine max; identical to SEQ ID NO: 9799

SEQ ID NO: 9820 - protein, 168 aa, Glycine max
MLVYQDLLTGDELLSDSFRYKEIENGMLWEVEGKWVVKGAVDVDIGANPSAEGGGEDEGVDDAAVKVVDIVDTFRLQEQPAFDKKQFVTFMKRFIKNLTPKLDAEQQELFKKHIEGATKYLLSKIKDFQFFVGESMGDDACLVFAYYKDGAADPTFLYFAYALKEVKC

SEQ ID NO: 9821 - protein, 167 aa, Glycine max
MLVYQDLLTGDELLSDSFRYNEIENGMLWEVEGKWVVKGAVDVGIGANPSAEGGEDEGVDDAAVKVVDIVDTSRLQEQPAFDKKQFVTFMKRFIKNLTPKLDAEKQELFKKHIEGATKYLLSKIKDFQFFVGESMNDDACLVFAYYKDGAADPTFLYFAYALKEVKC

SEQ ID NO: 9822 - protein, 168 aa, Elaeis guineensis
MLVYQDLLTGDELLSDSFPYKEIHNGMLWEVEGKWVIQGAVNVDIGANPSAEGGEEDEGVDDQAVKVVDIVDTFRLQEQPAFDKKQFVTFMKRYIKNLTPKLDAEKQELFKKHIEGATKFLLSKLSDLQFFVGESMHDDGCLVFAYYKDGATDPTFLYFAYGLKEVKC

SEQ ID NO: 9823 - protein, 168 aa, Elaeis guineensis
MLVYQDLLTGDELLSDSFPYKEIHNGMLWEVEGKWVIQGAVNVDIGANPSAEGGEEDEGVDDQAVKVVDIVDTFRLQEQPAFDKKQFVTFMKRYIKNLTPKLDAEKQELFKKHIEGATKFLLSKLSDLQFFVGESMHDDGCLVFAYYKDGATDPTFLYFAYGLKEIKC

SEQ ID NO: 9824 - protein, 167 aa, Elaeis guineensis
MLVYQDLLTGDELLSDSFPYKEIENGMLWEVEGKWVIQGAIDVDIGANPSAEGGEDEGVDDQAVKVVDIVDTFRLQEQPAFDKKQFVTFMKRYIKNLTPKLDAEKQELFKKHIEGATKFLLSKLKDLQFFVGESMHDDGGLVFAYYKDGATDPTFLYFAYGLKEVKC

SEQ ID NO: 9825 - protein, 168 aa, Elaeis guineensis
MLVYQDLLTGDELLSDSFPYKEIENGMLWEVEGKWVVQGAVNVDIGANPSAEGGEEDEGVDDQTQKVVDIVDTFRLQEQPAFDKKQFVTFMKRYIKQLTPKLDAEKQELFKKHIEGATKYLLSKLSDLQFFVGESMHDDGSMVFAYYKEGATDPTFLYLAYGLKEVKC

SEQ ID NO: 9826 - protein, 168 aa, Brachypodium distachyon
MLVYQDKLTGDELLSDSFPYKELENGVLWEVDGHWVVQGAVDVDIGANPSAEGGGEDEGVDDQAVKVVDIVDTFRLQEQPAFDKKQFVAYIKRYIKNLTPKLEADEQEVFKKNVEGATKFLLSKIKDLQFFVGESMGDDASVVFAYYKEGATDPTFLYFAHGLKEVKC

SEQ ID NO: 9827 - protein, 168 aa, Ricinus communis
MLVYQDLLTGDELLSDSFPYKEIENGILWEVEGKWVVQGAIDVDIGANPSAEGGGEDEGVDDQAVKVVDIVDTFRLQEQPPFDKKQFVTFIKRYIKLVTPKLDQETQEHFKKNIEGATKFLLSKLSDLQFFVGESMHDDGSLVFAYYKDGAADPTFLYFAHGLKEIKC

SEQ ID NO: 9828 - protein, 168 aa, Hevea brasiliensis
MLVYQDLLTGDELLSDSFPYKEIHNGILWEVEGKWVVQGAVDVDIGANPSAEGADEDEGVDDQAVKVVDIVDTFRLQEQPAFDKKQFVTYMKRFIKLLTPKLDEEKQESFKKNIEGATKFLLSKLSDLQFFVGESMHDDGSLVFAYYREGATDPTFLYFAYALKEVKC

SEQ ID NO: 9829 - protein, 168 aa, Glycine max
MLVYQDLLTGDELLSDSFPYKETENGMLWEVEGKWVVQGAVNVDIGANPSAEGGDEDEGVDDQAVKVVDIVDTFRLQEQPPFDKKQFITYMKRYIKLLTAKLEGEQQELFKKHIEGATKSLLSKLKDLQFFVGESMHDDGSLVFAYYKEGATDPTFIYFAYGLKEIKC

SEQ ID NO: 9830 - protein, 340 aa, Glycine max
MRRGAKRKTKQDQEAKHVAAEDNKTEAQPRAKRAKTSKPQSEPEYFEDKRNLEDLWKETFPVGTEWDQLDTVYQYKWDFSNLENAFEEDGVLYGKKVYLFGCTEPQLVMFKGESKVVLIPAVVAVVSPFPPSDKIGINSVQREAEEIVPMKQMKMDWVPYIPLEGRDSQVDRLKSQIFILSCTQRRSALKHLKLDRLKKYEYCLPYFYQPFKEDELEQSTEVQIIYPAEPKPVFCEFDWELDELEEFTDKLTEEEELSEDQKDAFKEFVKGKVREAKKANREAREARKKAIEEMSEETKAAFESMRFYKFYPVQSPDAPDVSNVKSPFINRYYGKAHEVL

SEQ ID NO: 9831 - protein, 340 aa, Glycine max
MRRGAKRKTKQDQEAKHHAPEDNMPKAQPRAKRAKTSKPQSEPEYFEDKRNLEDLWKETFPVGTEWDQLDSVYQYKWDFSNLENAFEENGVLYGKKVYLFGCTEPQLVMFKGESKVVCIPVVVAVVSPFPPSDKIGINSVQREAEEIIPMKQMKMDWVPYIPLEDRDSQVDRLKSQIFILSCTQRRSALKHLKLDRLKKYEYCLPYFYQPFKEDELEQSTEVQIIYPAEPKPVFCEFDWELDELEEFTDKLIEEEELSEDQKDAFKEFVKEKVREAKKANREAREARKKAIEEMSEETKAAFESMRFYKFYPVQSPEAPDVSNVKSPFINRYYGKAHEVL

SEQ ID NO: 9832 - protein, 344 aa, Populus trichocarpa
MRKGAKRKRSQKEEAAAPAPDNHKTTESTKPPTRAKRVKASKPEPEPEYFEDQRNLEDLWKQIFPVGTEWDQLDKVYGFNWNFSNLENAFEEGGVLHGKIVYLFGCTEPQLVPFKDENILIYIPAVVAVVSPFPPSNKIGIKSVQREVEEIIPMKQMKMDWVPYIPLEDRESRVDRLRHQIFILSCTQRRAALKHLKIDRIKKYEYCLPYFYNPLQEDELEQSTEVQIIFPSEPKPIFCEFDWELDELQEFIDKLIQEEELSEDQKDAFKEFVKEKVREAKKANREAREARRKALEEMSEETRRAIENLRFYKFYPVQTPDTPDISKVKASFINRYYGKAHEVL

SEQ ID NO: 9833 - protein, 347 aa, Populus trichocarpa
MRKGAKRKRIQKDNNEDEAAAVPAQDNHKTTESTKPPTRAKPVKASKPEPEYFEDKRNLEDLWKEIFPVGTEWDQLDKLYGFNWNFSNLENAFEEGGVLHGRKVYLFGCTEPQLVPFKDDSLLIYIPAVVAVASPFPPSDKIGIKSVQREVEEIIPMKQMKMDWVPYIPLENRESQVDRLRHQIFILSCTQRRTALKHLKIDRIKKYEYCLPYFYNPFKEDELEQSTEVQIIFPSELKPIFCEFDWELDELEEFTDKLIQEDELSEDQKDAFKEFVKEKVREAKKANREAREARRKALEEMSEESRRAFEKLRFYKFYPVQTPDTPDISNVKASFINRYYGKAHEVL

SEQ ID NO: 9834 - protein, 333 aa, Vitis vinifera
MKRKVRRQPTQKEESNSSKAPTRAKRVKASKPESEPEFFEEKRNMEDLWKETFPVGTEWDQFDLLYQFKWNFSNLEKAFEEGGKLYGKKVYLFGCSEPQLVSYKGENKVICIPAVVAVVSPFPPSDKIGINSVQREAEEIVPMKQMKMDWVPYIPLENRESQVDRLKTQIFILSCTQRRAALKHLKIDRVKKYEYCLPYFYQPFKEDELEQSTEVQIIFPAESKPVFCEFDWELDELEEFTDKLIEEEELDVDQKDAFKDFVKEKVREAKKANRQAREARKKALEEMSEEAKAAFENMKFYKFYPVQTEDTPDISNVKAPFINRYYGKAHEVL

SEQ ID NO: 9835 - protein, 329 aa, Glycine max
MSKRANKRKAKQDEQPKQRKKRSTTIKPAEHEEYFEDQRNLEDLWRETFPVGTEWDQLDSVYQYKWNFSNLENAFEEGGVLHGKRVYLFGCTEPQLVWFKDESKVVCIPVVVAVVSPFPPSDKIGINSVQREFEEIIPMKQMKMDWIPYIPLEDRESRVDRLKSQIFILSCTQRRAALKHLKLDRVKKYEYCLPYFYHPFKEDELEQSTEVQIIFPAEPKPVFCEFDWELDELEEFTDKLIEEEELLEDQKDTFKEFVKEKVREAKKANREAREARRKAIQEMSEEARAAFENMRFYKFYPVQSPDAPDVSNVKSPFINRYYGKAHEVL

SEQ ID NO: 9836 - protein, 424 aa, Brassica rapa
MKKGAKRKGPSKAARKGPAADESQNDEVVAESLEASTQEESQQPNAEAEAKPEITDSSNQVDEVKDASPSQQQEDVKAEEVDEDKKKPGRPRGGKRKRATKKEVDVKDEKKPPPRAKKARVAKPQEEPEYFEDERNLEGLWKAAFPVGTEWDQLDALYEYNWDFKHLEEALEEGGFLFGKKVFLFGCTEPQLVPFKGANKILHVPAVVAVESPFPPSDKIGITSVQREVEEIIPMKTMKMDWLPYIPLENRARQVDRMNFQIFVLGCTRRRAALRHMKEDLVKKYEYCLPYFYQPFKEDELEQSTEVQIMFPSEPPVVCEFDWEFDELEEFVDKLIEEEALPADQKDEFKEYVKVQVRAAKKANREAKDARRKAIEEMSEDTKQAFQSMKFYKFYPLPSSETPDVSGVKSPFINRYYGKADQVL

SEQ ID NO: 9837 - protein, 433 aa, Arabidopsis arenosa
MRKGAKRKGVSKAGRKGAVAETQTDEVIEETTTQEESQQPKEEVVDEKKENGEEEEEAKGDQEEEEEAKPDSLEKEEENQEDEVKADEVKEEDEKKPVARRGGKRKRATKKETEIKDEKKPVPSVKKPRVAKVKEEPVYFEDKRNLEDLWKVAFPVGTEWDQLDALYEFNWDFQNLEEALEEGGKLYGKKVYVFGCTEPQLVPYKGANKIVHVPAVVVIESPFPPSDKIGITSVQREVEEIIPMKKMKMDWLPYIPVEKRDRQVDKMNSQIFTLVCTQRRSALRHMKEDQLKKFEYCLPYFYQPFKEDELEQSTEVQIMFPSEPPVVCEFDWEFDELQEFVDKLVEEETLPAEQKDEFKEYVKEQVRAAKKANREAKDARKKAIEEMSEDTKQAFQKMKFYKFYPQPSPDTPDVSGVKSPFINRYYGKAHEVL

SEQ ID NO: 9838 - protein, 433 aa, Arabidopsis lyrata subsp. lyrata
MRKGAKRKGVSKAGRKAAVAETQNDEVIEETTTQEESQQPKEEVVDEKKENGEEEEAKGDQEDEEEAKPDSLEKEEEENQEDEVKSDEVKEVDEKKPVARRGGKRKRATKKETEIKDEKKPVPSVKKPRVAKVKEEPVYFEEKRNLEDLWKVAFPVGTEWDQLDALYEFNWDFQNLEEALEEGGKLYGKKVYVFGCTEPQLVPYKGANKIVHVPAVVVIESPFPPSDKIGITSVQREVEEIIPMKKMKMDWLPYIPIEKRDRQVDKMNSQIFTLVCTQRRSALRHMKEDQLKKFEYCLPYFYQPFKEDELEQSTEVQIMFPSEPPVVCEFDWEFDEIQEFVDKLVEEEALPAEQTDEFKEYVKEQVRAAKKANREAKDARKKAIEEMSEDTKQAFQKMKFYKFYPQPSPDTPDVSGVKSPFINRYYGKAHEVL

SEQ ID NO: 9839 - protein, 434 aa, Arabidopsis thaliana
MKKGAKRKGVSKAGRKAAVAETQNDEVIEETTKTTQEESQQHEEEVVDEVKENGEEEEAKGDQEEEEDAKPDSLEEDEENQEDEVKAEEVKEEVEKKPVARRGGKRKRATKKDTEIKDEKKPVPKAKKPRAAKVKEEPVYFEEKRSLEDLWKVAFPVGTEWDQLDALYEFNWDFQNLEEALEEGGKLYGKKVYVFGCTEPQLVPYKGANKIVHVPAVVVIESPFPPSDKIGITSVQREVEEIIPMKKMKMDWLPYIPIEKRDRQVDKMNSQIFTLGCTQRRSALRHMKEDQLKKFEYCLPYFYQPFKEDELEQSTEVQIMFPSEPPVVCEFDWEFDELQEFVDKLVEEEALPAEQADEFKEYVKEQVRAAKKANREAKDARKKAIEEMSEDTKQAFQKMKFYKFYPQPSPDTPDVSGVQSPFINRYYGKAHEVL

SEQ ID NO: 9840 - protein, 607 aa, Glycine max
MKEATMEKEMELCTSEVEMASQHSPQPQKKKGGIVTMPFIMANEALASVANIGLQPNMILYLMGSYRFHLAKATQVFLLSSATSNLTPLIGAFIADSCLGRFLAVGLGSAISFLGMALLCLTAMIPQSRPPPCNPATERCKPATAGQMAMLISSFALMSIGNGGLSCSIAFGADQVNKKDNPNNQRALETFFSWYYASTAFSVIIALTVIVYIQDHFGWKVGFGVPAALMFMSTFFFFLASPLYVKNKIQGSLITGLAQVIVVAYKNRKLPLPPRNSAEMYHHRKDSDLVVPTDKLRFLNKACIIKDIASDGSASNPWSLCTIDQVEELKAIIKVIPLWSTGIMMSVNIGGSFGILQAKSLNRHITSHFEIPAGSFSVVIVFMVFIWVALYDRVIIPIASKLRGKPVRISAKRRMGIGLVFSFLHLATAAIVENTRRRRAIREGHIDDTNAVLNMSAMWLVPQLCLSGMAEAFNAIGQNEFYYTEFPRTMSSIAACLFGLGMAAGNVLSSLIFSIVENVTSRGGKQGWVLDNINKGSYDRYYCVLASLAAVNILYYLVCSWAYVPTVDQLSNVSDENNSNEKVLIQLGNMSQVDLSEGFGSNEKRVN

SEQ ID NO: 9841 - protein, 606 aa, Glycine max
MEKEVEFCSSELEMASQHIPQPQRKKGGIVTMPFIIANEALASVAKIGLLPNMILYLMGSYKFHLAKATQVLLLSSATSNLTPLIGAFIADSCLGRFLSVGFGSSISFLGMALLCLTAIIPQARPPPCNPATERCKPATAGQMTMLISSFALMSIGNGGLSCSIAFGADQVNKKDNPNNQRALETFFSWYYASTAFSVIIALTVIVYIQDHFGWKVGFGVPAALMFMSTFFFFLASPLYVKNKVQGSLITGLAQVIVVAYKNRKLPLPPRNSAAMYHRRKDSDLVVPTDKLRFLNKACITKDPEKDIASDGSASNPWSLCTIDRVEELKAIIKVIPLWSTGIMVSVNIGGSFGLLQAKSLNRHITSHFEIPAGSFAVVIVFIIFIWVALYDRVIIPIASKLRGKPVRISAKRRMGIGLVFSFLHLATAAIVENERRRRAIREGHINDTHAVLNMSAMWLVPQLCLSGMAEAFNAIGQNEFYYTEFPRTMSSIAACLFGLGMAAGNVLSSLIFSIVENATSRGGNEGWVLDNINKGRYDRYYWVLASLSAVNILYYLVCSWAYGPTVDQLFKVSDENSSNEKEFTQLGNMGQVDVSEGIGSNEKRVN

SEQ ID NO: 9842 - protein, 611 aa, Glycine max
MEKELELSSAQSRMDSQRISQPQRCGKGGLVTMPFIIANEALARVATLGLLPNMILYLMGNYNLHLGKATKILLLSVATTNFMPLPGAFIADSYLGRFLAVGLGSFITFLGMTLLWLTAMIPQARPPPCNSETERCESATPGQMAMLISSLALMSIGNGGLSCSLAFGADQVNRKDNPNNQRALEMFFSWYYASSAISVIIAFTGIVYIQDHLGWKLGFGVPAALMFLSTFFFFLASPLYVKNKTHNNLLTGFACVIVVAYKNRKLRLPHKISDGMYHRNKDSDLVVPSDKLRFLNKACFIKDSEKDIASDGSAYNRWSLCTVDQVEELKAIIKVIPLWSTGIMMYLNIGGSFGLLQAKSLNRHITPNFEVPAGSMSVIMIFTIFIWIALYDRVIIPLASKLRGKPVRISAKRRMGLGLLFSFLHLVTAAIVETTRRRRAISEGHINDTHAVLNMSAMWLFPQLCLGGIAEAFNAIGQNEFYYTEFPKTMSSIASSLFGLGMAVGYVLSSLVFSIVEKVTSRGGKDGWVSDNINKGRFDKYYWLLATMSAVNVLYYLVCSWAYGPTSDQESKVTEENGSNEEELPLIQSRTKGQFDKVSQVSEEILRTSHK

SEQ ID NO: 9843 - protein, 616 aa, Glycine max
MDKEVELGSLEGEMATQHISQPQKRKGGLVTMPFIIANEALARVASLGLLPNMILYLMGTYRLHLAQATQILLWSHATSNFTPVVGAFIADSYLGRFLAVGLGSAITFLGMTLLWLTAMIPQARPPTCSSNKAGGCKSATGGQMAILISALALMSVGNGGLSCSLAFGADQVNRKDNPNNRRVLEIFFSWYYASAAISVIIALTGIVYIQDHLGWKVGYGVPAALMLLSTVSFLLASPLYVKNKVESSLFTGFVQVIVVAYKNRKLPLPPNNSPEHYHHKKESDLVVPTDKLSFLNRACVIKDREQEIASDGSASNPWKLCTVDQVEELKAIIKVIPLWSTGIMMSVNIGGSFGLLQAKSLDRHITSHFQVPPGSFSVVMVLTIFLWIALYDRAILPLASKIRGKPVRISAKRRMGLGLFFSFIHLVTSAIVESVRRRRAIKEGYLNNANGVLHMSAMWLFPQLCLGGIAEAFNAIGQNEFYYTEFPRTMSSVAASLSGLGMAAGNLVSSFVFSVVQNATSRGGKEGWVLDNINKGRYDKYYWVISGLSALNIVYYLICSWAYGPTVEQVQVRKLGEENGSRELEPSTEFRNGSQVDKEFQISKENGSKEEEELTR

SEQ ID NO: 9844 - protein, 587 aa, Glycine max
MEMEVELSSAQPKMGSQLISQPQRCGKGGLVTMPFIIANEALARVATLGLLPNMILYLMGNYNLHLGKATKILLLSVATTNFMPLPGAFISDSYLGRFLAVGLGSFITFLGMALLWLTAMIPQARPPACNSQSERCESATPGQMAMLISSLALMSIGNGGLSCSLAFGADQVNRKGNPNNQRALEMFFSWYYASSAISVIIAFTGIVYIQDHLGWKLGFGVPAALMFLSTFFFFLASPLYVKNKTHSNLLTGFARVIVVAYKNRKLRLPHKISDGMYHRNKDSDLVVPSDKLRFLNKACFIKDSEKDITSDGSASNPWSLCTVDQVEELKAIIKVIPMWSTGILMYLNIGGSFGLLQAKSLNRHITPNFEVPAGSMSVIMIFTIFIWIALYDRLIIPLASKIRGKPVRISAKRRMGLGLLFSFLHLVTAAMVETIRRRRAISEGHVNDTHAVLNMSAMWLFPQLCLGGIAEAFNAIGQNEFYYTEFPKTMSSIASSLFGLGMAVGYVLSSLVFSVVEKVTSRGGKDGWVSDNINKGRFDKYYWLLATLSAVNVLYYLVCSWIYGPTADQESKVTEENGSNEEELPLI

SEQ ID NO: 9845 - protein, 606 aa, Glycine max; identical to SEQ ID NO: 9841

SEQ ID NO: 9846 - protein, 607 aa, Glycine max; identical to SEQ ID NO: 9840

SEQ ID NO: 9847 - protein, 632 aa, Medicago truncatula
MDKELQLCSVDDDEMVSQQPQRRKGGLITMPFIIANEALARMASLGLLPNMILYFMGSYRLHLAKATQILLLSSAASNFTPVVGAFIADSYLGRFLGVGLGSFVSFLGMGMLWLTAMIPAARPPPCNNPTKGCKSATTGQMAMLLSAFGLMSIGNGGLSCSIAFGADQVNRKDNPNNHRVLEIFFSWYYAFTTISIILALTVIVYIQEHLGWKIGFGVPAALMLLSTICFFLASPLYVKITKRTSLITGFAQVTTAAYKNRKLQLPPKNSPQFYHHKKDSDLDLVIPTDKLRFLNKACVIKDHEKDIASDGSAINPWRLCTVDQVEELKALVRVIPLWSTGIMMSLNIGGSFGLLQAKSLDRHITSNFEVPAGSFSVIMVGSIFIWIVLYDRVLIPLASKLRGKPVRISPKIRMGIGLFLNFLHLVTAAAFESIRRKKAIQAGFLNDTHGVLKMSALWLAPQLCLGGISEAFNAIGQNEFYYKEFPRTMSSISASLCGLGMAAGNLVSSFVFNTIENVTSRGGKEGWISDNINKGRYDKYYMVIAGVSALNLLYFLVCSWAYGPTVDQVSKVSDENDSKEKDSTEFKKVNPLFDETSSNGKELTEIKNGGQAEKVFKISEENGSKEEELTKD

SEQ ID NO: 9848 - protein, 611 aa, Glycine max; identical to SEQ ID NO: 9842

SEQ ID NO: 9849 - protein, 638 aa, Medicago truncatula
MDKELQLCSVDAADEEEMVSQQKPQRSKGGLVTMPFIIGNEALAKMASVGLLPNMILYLMGSYRLHLGISTQILLLSSAASNFTPVIGAFIADSYLGRFLGVGIGSSISFLGMSLLWLTAMIPAARPSACNHPSEGCESATPGQLAMLFSALILIAIGNGGITCSLAFGADQVNRKDNPNNYRVLEIFFSWYYAFITIAVIIALTGIVYIQDHLGWRIGFGVPAALMLISTVLFFLASPLYVKITQRTSLLTGFAQVSVAAYKNRKLSLPPKTSPEFYHHKKDSDLVIPTDKLRFLNKACVIKDHEQDIASDGSAINRWSLCTVDQVEELKAIIKVIPLWSTAITMSINIGGSFGLLQAKSLDRHIISSSNFEVPAGSFSVILIVAILIWIIIYDRVLIPLASKIRGKPVIISPKKRMGIGLFFNFLHLITAAIFETVRRKEAIKEGYLNDTHGVLKMSAMWLAPQLCLAGIAEMFNVIGQNEFYYKEFPKSMSSVAASLSGLAMGVGNLVSSLVLSIIESTTPSGGNEGWVSDNINKGHFDKYYWVIVGINALNLLYYLVCSWAYGPTVDEVSNVSKENGSKVEESTEFKHMNPHFDDKVSGETSSKEKELTEFKNGAQVEKVFKNSEQRDLKEEDL

SEQ ID NO: 9850 - protein, 303 aa, Zea mays
MAAAAAWTGAASPNSLLLSRSPPHAAALAPSPGSSMRRRLLLGVGTPAVAALAAAAPPAVLQDGAVTVLITAGAYSLVRVFDELTERRLIEKSLSRKVVHVLSGVLFMSSWPLFSNSTEARYFAAVVPFLNSMRLLIYGLRLYTDEALVKSVTREGKPEELLRGPLYYVLVLLFSVLVFWRESPIGIVSLSMMSGGDGFADIVGRRYGSAKLPFNRKKSWAGSISMFISGFLLSAMMMLYFSSLGYIDVIWEEALGKLALVALAATVVECVPVTEVVDDNISVPLATMLVAFLLFSSNRTIVN

SEQ ID NO: 9851 - protein, 268 aa, Zea mays
MRRRLLLGVGTPAVAALAAAAPPAVLQDGAVTVLITAGAYSLVRVFDELTERRLIEKSLSRKVVHVLSGVLFMSSWPLVSNSTEARYFAAVVPFLNSMRLLIYGLRLYTDEALVKSVTREGKPEELLRGPLYYVLVLLFSVLVFWRESPIGIVSLSMMSGGDGFADIVGRRYGSAKLPFNRKKSWAGSISMFISGFLLSAMMMLYFSSLGYIDVIWEEALGKLALVALAATVVECVPVTEVVDDNISVPLATMLVAFLLFSSNRTIVN

SEQ ID NO: 9852 - protein, 292 aa, Glycine max
MAAAAAWTGAASPNSLLLSRSPPHAAALAPSPGSSMRRRLLLGVGTPAVAALAAAAPPAVLQDGAVTVLITAGAYSLVRVFDELTERRLIEKSLSRKVVHVLSGVLFMSSWPLFSNSTEARYFAAVVPFLNSMRLLIYGLRLYTDEALELLRGPLYYVLVLLFSVLVFWRESPIGIVSLSMMSGGDGFADIVGRRYGSAKLPFNRKKSWAGSISMFISGFLLSAMMMLYFSSLGYIDVIWEEALGKLALVALAATVVECVPVTEVVDDNISVPLATMLVAFLLFSSNRTIVN

SEQ ID NO: 9853 - protein, 304 aa, Sorghum bicolor
MAAATAWPGAAASNSLLLSRSPPHAAAAALALAPSPGSSMRRRLILGVGTPAVAALAAAAPPAVLQDGAVTVLITAGAYSLVRVFDELTERRLIEKSLSRKVVHVLSGVLFMSSWPLFSNSTEARYFAAVVPLLNSIRLLIYGLRLYTDEALVKSVTREGKPEELLRGPLYYVLVLLFSVLVFWRESPVGIVSLSMMSGGDGFADIVGRRYGSVKLPFNKKKSWAGSISMFISGFLLSAMMMFYFSSLGYIDVIWQEALGKLALVALAATVVECIPVTEVVDDNISVPLATMLVAFLLFSSNAQ

SEQ ID NO: 9854 - protein, 259 aa, Zea mays
MAAAAAWTGAASPNSLLLSRSPPHAAVLAPSPGSSMRRRLLLGVGTPAVAALAAAAPPAVLQDGAVTVLITAGAYSLVRVFDELTERRLIEKSLSRKVVHVLSGVLFMSSWPLFRELLRGPLYYVLVLLFSVLVFWRESPIGIVSLSMMSGGDGFADIVGRRYGSAKLPFNRKKSWAGSISMFISGFLLSAMMMLYFSSLGYIDVIWEEALGKLALVALAATVVECVPVTEVVDDNISVPLATMLVAFLLFSSNRTIVN

SEQ ID NO: 9855 - protein, 303 aa, Zea mays; identical to SEQ ID NO: 9850

SEQ ID NO: 9856 - protein, 287 aa, Phaseolus vulgaris
MAKDVEVTERGSFSGKDYHDPPPAPLIDTEELTKWSFYRALIAEFIATLLFLYITVLTVIGYKHQSDLKDHGDACGGVGILGIAWAFGGMIFILVYWTAGISGGHINPAVTFGLFLARKVSLIRAIMYMVAQCLGAICGVGLVKAFQKSYYNRYGGGANSLADGYSTGTGLGAEIIGTFVLVYTVFSATDPKRNARDSHVPVLAPLPIGFAVFMVHLATIPVTGTGINPARSLGAAVIYNKDKPWDDHWIFWVGPFIGAAIAAFYHQFILRAGAVKALGSFRSNPHV

SEQ ID NO: 9857 - protein, 287 aa, Glycine max
MAKDVEVAERGSFSGKDYQDPPPAPLIDAEELTKWSFYRALIAEFIATLLFLYITVLTVIGYNHQTDLKENGEICGGVGILGIAWAFGGMIFILVYCTAGISGGHINPAVTFGLFLARKVSLIRAIMYMVAQCLGAICGVGLVKAFQKSYFNKYGGGANSLAAGYSTGTGLGAEIIGTFVLVYTVFSATDPKRNARDSHVPVLAPLPIGFAVFMVHLATIPVTGTGINPARSLGAAVIYNQDKPWDDHWIFWVGPFIGAAIAAFYHQFILRAGAAKALGSFRSNPHN

SEQ ID NO: 9858 - protein, 284 aa, Glycine max
MAKDVEVAERGSFSGKDYQDPPPAPLIDAEELTKWSFYRALIAEFIATLLFLYITVLTVIGYKHQTDHADACGGVGILGIAWAFGGMIFILVYCTAGISGGHINPAVTFGLFLARKVSLIRAIMYMVAQCLGAICGVGLVKAFQKSYFNKYGGGANSLADGYSTGTGLGAEIIGTFVLVYTVFSATDPKRNARDSHVPVLAPLPIGFAVFMVHLATIPVTGTGINPARSLGAAVIYNQDKPWDDHWIFWVGPFIGAAIAAFYHQFILRAGAAKALGSFRSNPHN

SEQ ID NO: 9859 - protein, 284 aa, Glycine max
MAKDVEVAERGSFSGKDYQDPPPAPLIDAEELTKWSFYRALIAEFIATLLFLYITVLTVIGYKHQTDHADACGGVGILGIAWAFGGMIFILVYCTAGISGGHINPAVTFGLFLARKVSLIRAIMYMVAQCLSAICGVGLVKAFQKSYFNKYGGGANSLADGYSTGTGLGAEIIGTFVLVYTVFSATDPKRNARDSHVPVLAPLPIGFAVFMVHLATIPVTGTGINPARSLGAAVIYNQDKPWDDHWIFWVGPFIGAAIAAFYHQFILRAGAAKALGSFRSNPHN

SEQ ID NO: 9860 - protein, 287 aa, Samanea saman
MAKDVEVAERGSYSAKDYHDPPPAPLIDAEELGKWSFYRALIAEFIATLLFLYITVLTVIGYKSQSDTKAGGDVCGGVGILGIAWAFGGMIFILVYCTAGISGGHINPAVTFGLFLARKVSLIRAILYMVAQCLGAICGVGLVKAFQKAYYSRYGGGANTLSDGYSTGTGLGAEIIGTFVLVYTVFSATDPKRSARDSHVPVLAPLPIGFAVFMVHLATIPVTGTGINPARSLGAAVIFNQQKAWDDHWIFWVGPFIGAAIAAFYHQFILRAGAAKALGSFRSNPSV

SEQ ID NO: 9861 - protein, 287 aa, Medicago truncatula
MAKDVEVAERGSFSNKDYHDPPPAPLIDAEELTKWSFYRALIAEFIATLLFLYVTVLTVIGYSIQTDVKAGGDACGGVGILGIAWAFGGMIFVLVYCIAGISGGHINPAVTFGLFLARKVSLIRAIMYMVAQCLGAIAGVGLVKAFQSAYFDRYGGGANFLHDGYSTGVGLGAEIVGTFVLVYTAFSATDPKRSARDSHVPVLAPLPIGFAVFMVHLATIPVTGTGINPARSLGSAVIYNKDKPWDDHWFFWVGPFIGAAIAAFYHQFILRAGAVKALGSFRSNPTV

SEQ ID NO: 9862 - protein, 285 aa, Glycine max
MAKHDVEGGSFSAKDYHDPPPAPLIDAEELTQWSFYRALIAEFIATMLFLYITVLTVIGYKSQSDVKAGGDVCGGVGILGIAWAFGGMIFILVYCTAGISGGHINPAVTFGLFLARKVSLIRAIMYMVAQCLGAICGVGLVKAFQKAYYNRYGGGANELSEGYSTGVGLGAEIIGTFVLVYTVFSATDPKRNARDSHVPVLAPLPIGFAVFMVHLATIPVTGTGINPARSLGAAVMYNQQKAWDDHWIFWVGPFIGAAIAAFYHQFILRAGAAKALGSFRSNPAI

SEQ ID NO: 9863 - protein, 287 aa, Pyrus communis
MAKDMEVAERGSFSAKDYHDPPPAPLIDAAELTKWSFYRALIAEFVATLLFLYVTVLTVIGYKSQTDPAVNADACGGVGILGIAWAFGGMIFVLVYCTAGISGGHINPAVTFGLFLARKVSLVRAVLYMVAQSLGAIAGVALVKAFQKSYYIKYGGGANSLSDGYSTGVGLAAEIIGTFVLVYTVFSATDPKRSARDSHVPVLAPLPIGFAVFIVHLATIPITGTGINPARSLGAAVIYNKDKAWDDQWIFWVGPFIGAAIAAFYHQFILRAGAVKALGSFRSNPHV

SEQ ID NO: 9864 - protein, 285 aa, Glycine max
MAKHDVEGGSFSAKDYHDPPPAPLIDAEELTQWSLYRALIAEFIATLLFLYITVLTVIGYKSQSDVKAGGDVCGGVGILGIAWAFGGMIFILVYCTAGISGGHINPAVTFGLFLARKVSLIRAIMYMVAQCLGAICGVGLVKAFQKAYYNRYGGGANELSEGYSTGVGLGAEIIGTFVLVYTVFSATDPKRNARDSHVPVLAPLPIGFAVFMVHLATIPVTGTGINPARSLGAAVVYNQQKAWDDHWIFWVGPFIGAAIAAFYHQFILRAGAAKALGSFRSNPTI

SEQ ID NO: 9865 - protein, 288 aa, Mimosa pudica
MAKDVEVAERGSYSAKDYHDPPPAPLIDAEELGKWSFYRALIAEFIATLLFLYITVLTVIGYKSQTDTTVATGDVCGGVGILGIAWAFGGMIFILVYCTAGISGGHINPAVTFGLFLARKVSLIRAILYIVAQCLGAICGVGLVKAFQKAYYTKYGGGANTLGDGYSVGTGLGAEIIGTFVLVYTVFSATDPKRNARDSHVPVLAPLPIGFAVFMVHLATIPVTGTGINPARSFGAAVIFNQQKAWDKHWIFWVGPFIGAAIAAFYHQFILRAGAAKALGSFRSNPSV

SEQ ID NO: 9866 - protein, 742 aa, Glycine max
MKAVPLPYQEFRGNGVLDFASGAAAAVSDSLLLPQQEQFLQRWNPQRENFCYVGIEPSSGLDRKRKTSSPPTSSSTLSSSRASSGSTDSTTGTATATAAEKENNPPQAGLEVGQARCGLGMEDWESVLSESPGQDHSILKLIMGDIEDPSVGLTKLLQGGSGSQDVEFNGVGVGFGLVDQSSVLFPIPSVNFVSSSSSIDPSGTGNCSDFPFNSQTNVSPNVPRVGSGVNPNTTGFPASASNLSPVSLPQGVFLPQQQQQHHPPIEPLDEKLQVLNPQFILNQNQSQFMPNAGLVLPLTYGQLQENHQLLPQPPAKRLNCGPNYQVPKTPFLDSGQELLLRRQQQQLQLLPHHLLQRPSMVVAPKQKMVNSGGQDLATHQLQQAITEQLFKAAELIDAGNLELAHGILARLNHQLSPIGKPFQRAAFYFKEALQLLLHSNANNSSFTFSPTGLLLKIGAYKSFSEISPVLQFANFTCNQALLEAVKGFDRIHIIDFDIGLGGQWSSFMQELALRNGGAPELKITAFVSPSHHDEIELSFTQESLKQYAGELRMPFELEILSLESLNSASWPQPLRDCKAVVVNMPIGSFSNYPSYLPLVLRFVKQLMPKIVVTLDRSCDRTDAPFPQHLIFALQSYSGLLESLDAVNVHPDVLQMIEKYYLQPSMEKLVLGRHGLQERALPWKNLLLSSGFSPLTFSNFTESQAECLVQRTPSKGFHVEKRQSSLVLCWQRKDLISVSTWRC

SEQ ID NO: 9867 - protein, 684 aa, Glycine max
MKAVPLPFQEFRGNGVLDFASVAAVSDSLLLPQQEQFLQRWNPQRENFCYVGIEPAVSGLDLKRKTSSPPTSSSTLSSSRASSGGCGGWGSADSTTGAATATVAEKENNPPQGGLEVVGQARCGLGMEDWESVLSESPGEDHSILKLIMGDIEDPSVGLTKLLQGGSASQDVELNGLGVGFGLVNQSSVLDPIPSVNFVSSSIDPSGPGNCADFPFNSHSNVSPNVPSVGSGLNPNPTGFPTSASNLSQVSLPQGVFQPQQQQHQPIEPLDEKLQVLNPQFILYQNQSQFMPNPGLVLPLTYAQLQEHHQLLPQPPAKRLNCGPKAITEQLFKAAELIDAGNLELAHGILARLNHQLSPIGKPFQRAAFYFKEALQLLLHPNANNSSFTFSPTGLLLKIGAYKSFSEISPVLQFANFTCNQALLEAVEGFDRIHIIDFDIGLGGQWSSFMQELALRNGSAPELKITAFVSPSHHDEIELSFSQESLKQYAGELHMSFELEILSLESLNSASWPQPLRDCEAVVVNMPIGSFSNYPSYLPLVLRFVKQLMPKIVVTLDRSCDRTDAPFPQHLIFALQSYSGLLESLDAVNVHPDVLQMIEKYYLQPSMEKLVLGRHGLQERALPWKNLLLSSGFSPLTFSNFTESQAECLVQRTPSKGFHVEKRQSSLVLCWQRKDLISVSTWRC

SEQ ID NO: 9868 - protein, 832 aa, Medicago truncatula
MACKDGNKHLMDNGKYVRYTPEQVEALERLYHECPKPSSIRRQQLIRECPILSNIEPRQIKVWFQNRRCREKQRKESFRLQGVNRKLTAMNKLLMEENDRLQKQVSHLVYENGYFRQNTQNATKDTSCDSVVTSGQHNMTSQHPPRDASPAGLLSIAEETLAEFLSKATGTAVEWVQMPGMKPGPDSIGIVAISHGCTGVAARACGLVGLEPTRVAEILKDRPLWFRDCRAVDIVNVLPTANGGTIELLYMQLYAPTTLAPARDFWLLRYTSVVEDGSLVICERSLKNTQNGPSMPPVPHFVRADMLPSGYLIRPCEGGGSIIHIVDHMDLEPWSVPEVLRPLYESPMVLAQKTTMAALRHLRQISHEVSQPNVTGWGRRPAALRALSQRLSRGFNEALNGFTDEGWTMMGNDGVDDVTILVNSSPDKLMGLNLSFGNGFPSVSNAVLCAKASMLLQNVPPAILLRFLREHRSEWADHNMDAYTAAAIKVGPCSLTGSRVGNYGGQVILPLAHTIEHEEFLEVIKLDGVAHSPEEMMARELFLLQLCSGMDENAIGTCAELIFAPIDASFADDAPLLPSGFRIIPLESGKESSSPNRTLDLASALDIGPTGNRASSDNAGNSGCVRSVMTIAFEFAYESHMQENVACMARQYVRSIISSVQRVALALSPSNLSSHAGLRSPLGTPEAQTLAHWICNSYRCYLGVELLKSNTEGKESVLKSLWHHSDAVLCCTLKAMPVFTFSNQAGLDMLETTLVALQDISLEKIFDDNGRKTLFSEFPQIIQQGFACLQGGICLSSMGRPVSYERAVAWKVLNDEQNAHCICFMFVNWSFV

SEQ ID NO: 9869 - protein, 838 aa, Glycine max
MSCKDGSRNGIGMDNGKYVRYTPEQVEALERLYHDCPKPSSIRRQQLIRECPILSNIEPKQIKVWFQNRRCREKQRKESSRLQAVNRKLTAMNKLLMEENDRLQKQVSQLVYENGYFRQHTQITTQATKDTNCESVVTSGQHNLTTQHPPRDASPAGLLSIAEETLAEFLSKATGTAVEWVQMPGMKPGPDSIGIVAISHGCTGVAARACGLVGLEPTRVAEILKDRPLWFRDCRAVDVLNVLPTANGGTIELLYMQLYAPTTLAPARDFWLLRYTSVLEDGSLVICERSLKNTQNGPSMPPVQHFVRAEMLPSGYLIRPCEGGGSIIHIVDHMDLEPWSVPEVLRPLYESSTVLAQKTTMAALRHLRQISHEVSQSNVTGWGRRPAALRALSQRLSRGFNEALNGFTDEGWTTISNDGVDDVTILVNSSPDKLMGLNLSFANGFPSVSNAVLCAKASMLLQNVPPAILLRFLREHRSEWADNNMDAYTAAAIKVGPCSLSGSCVGNFGGQVILPLAHTIEHEEFLEVIKLEGIAHSPEDTIMPREMFLLQLCSGMDENAVGTCAELISAPIDASFADDAPLLPSGFRIIPLESGKEASSPNRTLDLASSLDVGPSGNRASNGSAGNSSCMRSVMTIAFEFAFESHMQEHVTSMARQYVRSIISSVQRVALALSPSHLSSHAGLRSPLGTPEAQTLAHWICNSYRCYLGVELLKSNNEGNESLLKSLWHHSDAILCCTLKALPVFTFSNQAGLDMLETTLVALQDITLEKIFDDHGRKILFSEFPQIIQQGFACLQGGICLSSMGRPVSYERVVAWKVLNEEENAHCICFMFVNWSFV

SEQ ID NO: 9870 - protein, 838 aa, Glycine max
MSCKDGSRNGIGMDNGKYVRYTPEQVEALERLYHDCPKPSSIRRQQLIRECPILSNIEPKQIKVWFQNRRCREKQRKESSRLQAVNRKLTAMNKLLMEENDRLQKQVSQLVYENGYFRQHTQITTQATKDTNCESVVTSGQQHNLITQHPPRDASPAGLLSIAEETLAEFLSKATGTAVEWVQMPGMKPGPDSIGIVAISHGCTGVAARACGLVGLEPTRVAEILKDQPLWFRDCRAVDVLNVLPTANGGTIELLYMQLYAPTTLAPARDFWLLRYTSVLEDGSLVICERSLKNTQNGPSMPPVQHFVRAEMLPSGYLIRPCEGGGSIIHIVDHMDLEPWSVPEVLRPLYESSTVLAQKTTMAALRHLRQISHEVSQSNVTGWGRRPAALRALSQRLSRGFNEALNGFTDEGWTTIGNDGVDDVTILVNSSPDKLMGLNLSFANGFPSVSNAVLCAKASMLLQNVPPAILLRFLREHRSEWADNNMDAYTAAAIKVGPCSLSGSRVGNYGGQVILPLAHTIEHEEFLEVIKLEGIAHSPEDTIMPREMFLLQLCSGMDENAVGTCAELISAPIDASFADDAPLLPSGFRIIPLESGKEASSPNRTLDLASALDVGPSGNRASNGCANSSCMRSVMTIAFEFAFESHMQEHVASMARQYVRSIISSVQRVALALSPSHLSSHAGLRSPLGTPEAQTLAHWICNSYRCYLGVELLKSNNEGNESLLKSLWHHSDAILCCTLKALPVFTFSNQAGLDMLETTLVALQDITLEKIFDDHGRKILFSEFPQIIQQGFACLQGGICLSSMGRPVSYERVVAWKVLNEEENAHCICFMFVNWSFV

SEQ ID NO: 9871 - protein, 841 aa, Glycine max
MSCKDGSRNGIGMDNGKYVRYTPEQVEALERLYHDCPKPSSIRRQQLIRECPILSNIEPKQIKVWFQNRRCREKQRKESSRLQAVNRKLTAMNKLLMEENDRLQKQVSQLVYENGYFRQHTTQNTKQQPTKDTSCESAVTSGQQHNLTTQHPPRDASPAGLLSIAEETLAEFLSKATGTAVEWVQMPGMKPGPDSIGIVAISHSCTGVAARACGLVGLEPTRVAEILKDRPLWFQDCRAVDVLNVLPTANGGTIELLYMQLYAPTTLAPARDFWLLRYTSVLEDGSLVICERSLKNTQNGPSMPPVQHFVRAEMLPSGYLIRPCEGGGSIIHIVDHMNLEPWSVPEVLRPLYESSTVLAQKTSIVALRHLRQISHEVSQSNVTGWGRRPAALRALSQRLSRGFNEALNGFTDEGWTTIGNDGVDDVTILVNSSPDKLMGLNLSFANGFPSVSNAVLCAKASMLLQNVPPAILLRFLREHRSEWADNNMDAYTAAAIKVGPCSLSGSRVGNYGGQVILPLAHTIEHEEFLEVIKLEGIAHSPEDTIMPREMFLLQLCSGMDENAVGTCAELISAPIDASFADDAPLLPSGFRIIPLESGKEASSPNRTLDLASALDIGSSGNRASNECAGNSSYMRSVMTIAFEFAFESHMQEHVASMARQYVRSIISSVQRVALALSPSHLSSHAGLRSPLGTPEAQTLAHWICNSYRCYLGVELLKSNNEGNESLLKSLWHHSDAILCCTLKALPVFTFSNQAGLDMLETTLVALQDTPLEKIFDDHGRKILFSEFPQIIQQGFVCLQGGICLSSMGRPVSYERVVAWKVLNEEENAHCMCFMFMNWSFV

SEQ ID NO: 9872 - protein, 838 aa, Malus x domestica
MAMSCKDGNKHALDNGKYVRYTPEQVEALERLYHDCPKPSSIRRQQLIRECPILSNIEPKQIKVWFQNRRCREKQRKEASRLQAVNRKLSAMNKLLMEENDRLQKQVSHLVYENGYFRQHTQGTTLATKDTSCESVVTSGQHHLTPQHPPRDASPAGLLSIAEETLAEFLSKATGTAVEWVQMPGMKPGPDSIGIVAISHGCTGVAARACGLVGLEPTRVAEILKDLPSWLRDCRAVDVLNVLPTANGGTIELLYMQLYAPTTLAPACDFWLLRYTSVLEDGSLVVCARSLKNTQNGPTMPPVQHFVRAEMLPSGYLIRPCEGGGSIIHIVDHMDLEPCSVPEVLRPLYESSAVLAQKMTMAALRQLRQIAHEVSQSNVTGWGRRPAALRALSQRLSRGFNDALNGFTDEGWSMMGNDGMDDVTILINSSPDKLMGLNLSFGNGFPAVSNSVLCAKASMLLQNVPPAILLRFLREHRSEWADNNIDAYSAAAVKVGPCSLAGSRVGSFGGQVILPLAHTLEHEEFLEVIKLEGVGHSPEDAMMPREMFLLQLCSGMDENAVGSCAELIFAPIDASFADDAPLLPSGFRIIPLDYGKEASSPNRTLDLASALEIGPTGNKGSSEYSASAGCVRSVMTIAFEFACETHMQEHVASMARQYVRSIISSVQRVALALSPSNLSSQAGLRSPLGTPEAQTLARWICNSYRCYLGVELLKSGNEGSESILKSLWHHSDAIMCCSLKALPVFTFANQAGLDMLETTLVALQDITLEKIFDDHGRKTLCSEFPQIMQQGFTCLQGGICLSSMGRPVSYERAVAWKVLNEEETAHCMCFLFVNWSFV

SEQ ID NO: 9873 - protein, 836 aa, Medicago truncatula
MSCKDGKGVMDNGKYVRYTPEQVEALERLYHDCPKPSSIRRQQLIRECPILSHIEPKQIKVWFQNRRCREKQRKEASRLQAVNRKLSAMNKLLMEENDRLQKQVSHLVYENGYFRQHTQNTNLATKDTSCDSAVTSGQRSLTAQHPPRDASPAGLLSIAEETLAEFLSKATGTAVEWVQMPGMKPGPESIGIIAISHGCHGVAARACGLVGLEPTRVAEILKDRPSWYRDCRAVDILNVLPTANGGTIELLYMQLYAPTTLAPARDLWLLRYTSVLEDGSLVICERSLKNTQNGPSMPPVQHFVRAEMLPSGYLIRPCEGGGSIIHIVDHMDLEPWSVPEVLRPLYESSTMLAQKTTMVALRHLRQISHEVSQSNVTGWGRRPAALRALGQRLSRGFNEALNGFTDEGWSMIGNDGVDDVTILVNSSPDKLMGLNLSFANGFPSVSNAVLCAKASMLLQNVPPAILLRFLREHRSEWADNNMDAYSAAAIKAGPCSFSGSRVGNYGGQVILPLAHTIEHEEFLEVIKLEGIAHSPEDAIMPREVFLLQLCSGMDENAVGTCAELIFAPIDASFADDAPLLPSGFRIIPLDSGKEVANNPNRTLDLTSALDIGPAGNKASNDYSGNSGCMRSVMTIAFEFAFESHMQDHVASMARQYVRSIISSVQRVALALSPSNLNSQGGLRTPLGTPEAQTLARWISNSYRCFLGAELLKSNNEGSESLLKSLWHHTDAILCCTLKALPVFTFANQAGLDMLETTLVALQDIALEKIFDDHGRKILCSEFPLIIQQGFACLQGGLCLSSMGRPISYERVVAWKVLNEEENAHCICFMFVNWSFV

SEQ ID NO: 9874 - protein, 839 aa, Ricinus communis
MAMSCKDGKQPANLDNGKYVRYTPEQVEALERLYHECPKPSSIRRQQFIRECPILSNIEPKQIKVWFQNRRCREKQRKEASRLQAVNRKLTAMNKLLMEENDRLQKQVSQLVYENGYFRQHTQNTTLATKDTSCDSVVTSGQHHLTPQHQPRDASPAGLLSIAEETLTEFLSKATGTAVEWVQMPGMKPGPDSIGIIAISHGCTGVAARACGLVGLEPTRVAEILKDRPSWFRDCRAVDVLNVLPTANGGTIELLYMQLYAPTTLAPARDFWLLRYTSVLEDGSLVICERSLKNTQNGPSMPPVQHFVRAEMLPSGYLIRPCEGGGSIIHIVDHMDLEPWSVPEVLRPLYESSTVLAQKTTMAALRQLRQIAQEASQSNVTNWGRRPAALRALSQRLSRGFNEALNGFTDEGWSMMGNDGMDDVTILVNSSPEKLMGLNLSFSNGFPAVSNAVLCAKASMLLQNVPPAILLRFLREHRSEWADNNIDAYSAAAIKVGPCTLPGTRIGSFGGQVILPLAHTIEHEEFLEVIKLEGAGHSPEDPIMPRDMFLLQLCSGMDENAVGTCAELIFAPIDASFADDAPLLPSGFRIIPLDSAKEASSPNRTLDLASALEIGPAGNKSSTDYSSNSGCMRSVMTIAFEFAFESHMQEHVASMARQYVRSIISSVQRVALALSPSHSGSHAGLRTPLGTPEAQTLARWICQSYRCYLGVELLKSSSEGGESILKTLWHHSDAIMCCSLKALPVFTFANQAGLDMLETTLVALQDITLEKIFDDHGRKTLCSEFPQIMQQGFACLQGGICLSSMGRPVSYERAVAWKVLNEEENAHCICFMFINWSFV

SEQ ID NO: 9875 - protein, 837 aa, Vitis vinifera
MAMSCKDGKGIMDNGKYVRYTPEQVEALERLYHECPKPSSIRRQQLIRECPILSNIEPKQIKVWFQNRRCREKQRKEASRLQAVNRKLTAMNKLLMEENDRLQKQVSQLVYENGYFRQHTQNTTLATKDTSCESVVTSGQHHLTPQHPPRDASPAGLLSIAEETLTEFLSKATGTAVEWVQMPGMKPGPDSIGIVAISHGCTGVAARACGLVGLEPTRVAEILKDRPSWFRDCRAVDVLNVLPTANGGTIELLYMQLYAPTTLAPARDFWLLRYTSVMEDGSLVVCERSLKNTQNGPSMPPVQHFVRAEMLPSGYLIRPCEGGGSIIHIVDHMDLEPWSVPEVLRPLYESSTVLAQKTTMAALRQLRQIAQEVSQSNVTGWGRRPAALRALSQRLSRGFNEALNGFTDEGWSMMGNDGIDDVTILVNSSPEKLTGLNLSFANGFPAVSNAVLCAKASMLLQNVPPAILLRFLREHRSEWADNNIDAYSAAAVKVGPCSLPGSRVGSFGSQVILPLAHTIEHEEFLEVIKLEGVGHCPEDAMMPRDMFLLQLCSGMDENAVGTCAELIFAPIDASFADDAPLLPSGFRIIPLDSGKEASSPNRTLDLASALEIGPAGNRSSNDYSVNGGNTRSVMTIAFEFAFESHLQENVASMARQYVRSIISSVQRVALALSPSHLSSHAGLRPPLGTPEAHTLARWISHSYRCYLGVELLKSSGEGSETILKTLWHLSDAIMCCSLKALPVFTFANQAGLDMLETTLVALQDITLEKIFDDHGRKTLCSEFPQIMQQGFACLQGGICLSSMGRPVSYERAVAWKVLNEEENAHCVCFMFMNWSFV

SEQ ID NO: 9876 - protein, 835 aa, Vitis vinifera
MSCKDGKGIMDNGKYVRYTPEQVEALERLYHECPKPSSIRRQQLIRECPILSNIEPKQIKVWFQNRRCREKQRKEASRLQAVNRKLTAMNKLLMEENDRLQKQVSQLVYENGYFRQHTQNTTLATKDTSCESVVTSGQHHLTPQHPPRDASPAGLLSIAEETLTEFLSKATGTAVEWVQMPGMKPGPDSIGIVAISHGCTGVAARACGLVGLEPTRVAEILKDRPSWFRDCRAVDVLNVLPTANGGTIELLYMQLYAPTTLAPARDFWLLRYTSVMEDGSLVVCERSLKNTQNGPSMPPVQHFVRAEMLPSGYLIRPCEGGGSIIHIVDHMDLEPWSVPEVLRPLYESSTVLAQKTTMAALRQLRQIAQEVSQSNVTGWGRRPAALRALSQRLSRGFNEALNGFTDEGWSMMGNDGIDDVTILVNSSPEKLTGLNLSFANGFPAVSNAVLCAKASMLLQNVPPAILLRFLREHRSEWADNNIDAYSAAAVKVGPCSLPGSRVGSFGSQVILPLAHTIEHEEFLEVIKLEGVGHCPEDAMMPRDMFLLQLCSGMDENAVGTCAELIFAPIDASFADDAPLLPSGFRIIPLDSGKEASSPNRTLDLASALEIGPAGNRSSNDYSVNGGNTRSVMTIAFEFAFESHLQENVASMARQYVRSIISSVQRVALALSPSHLSSHAGLRPPLGTPEAHTLARWISHSYRCYLGVELLKSSGEGSETILKTLWHLSDAIMCCSLKALPVFTFANQAGLDMLETTLVALQDITLEKIFDDHGRKTLCSEFPQIMQQGFACLQGGICLSSMGRPVSYERAVAWKVLNEEENAHCVCFMFMNWSFV

SEQ ID NO: 9877 - protein, 843 aa, Glycine max
MSCKDGSRNGIGIGMDNGKYVRYTPEQVEALERLYHDCPKPSSIRRLQLIRECPTLSHIDPKQIKVWFQNRRCREKQRKESSRLQAVNRKLTAMNKLLMEEIDRLQKQVSQLVYENGYFRQHTTQNTKQQAIKDTSCESAVRSGQQHNLITQHPPRDASPAGLLSIAEETLEEFLSKATGTAVEWVQMPGMKPGPDSIGIVAISHGCNGVAARACGLVGLEPTRVAEILKDRPLWFRDCRAVDVLNVLPTANGGTIELLYMQLYAPTTLAPARDFWLLRYTSVLEDSSLVICERSLKNTQNGPSMPPVQHFVRAEMLPSGYLIRPCEGGGSIIHIVDHMNLEPWSVPEVLRPLYESSKVLSQKTTMAALRHLRQISHEVSPSNVSGWGRRPSALRALSQRLSRGFNEALNGFTDEGWTTIGNDGVDDVTILVNSSPDKLMGLNLSFANGFPSVSNAVLCAKASMLLQNVHPAILLRFLREHRSEWADNNMDAYTAAAIKVGPCSFSGSRVGNYGGQVILPLAHTIEHEEFLEVIKLEGVAHSPDDTIMPREMFLLQLCSGMDENAVGTCAELISAPIDASFADDAPLLPSGFRIIPLESGKEASSPNRTLDLASSLDVGPSGNRASDECAGNSSYMRSVMTIAFEFAFESHMQEHVAAMARQYVRSIISSVQRVGLALSPSHLSSHAGLRSPLGTPEAQTLAHWICNSYRCYLGVELLKSNNEGNESLLKSLWHHSDAILCCTLKALPVFTFSNQAGLDMLETTLVALQDIPLEKIFDDHERKILFSEFPQIIQQGFACLQGGICLSSMGRPVSYERVVAWKVLNEEENAHCICFMFMNWSFV

SEQ ID NO: 9878 - protein, 845 aa, Vitis vinifera
MALSMHKESKQQMDSSKYVRYTPEQVEALERVYSECPKPSSMRRQQLIRECPILSNIEPKQIKVWFQNRRCREKQRKEASRLQTVNRKLTAMNKLLMEENDRLQKQVSQLVYENGYMRQQLQSASTATTDTSCESVVMSGQHQQQQNPTPQHPQRDASNPAGLLAIAEETLAEFLSKATGTAVDWVQMIGMKPGPDSIGIVAVSRNCSGVAARACGLVSLEPTKVAEILKDRPSWFRDCRCLDVLSVIPTGNGGTIELIYMQTYAPTTLASARDFWTLRYTTSLEDGSLVICERSLTSSTGGPTGPPASSYIRAEMLPSGYLIRPCEGGGSIIHIVDHVDLDAWSVPEVLRPLYESSKILAQKTTVAALRHIRQIAQETSGEIQYGGGRQPAVLRTFSQRLCRGFNDAVNGFADDGWSLMGSDGVEDVTIVINSSPSKFLGPQYNSTMFPTFGGGVLCAKASMLLQNVPPALLVRFLREHRSEWADYGVDAYSAACLKASPYEVPCARPGGFPSSQVILPLAHTVEHEEFLEVVRLEGHAFSPEDVALTRDMYLLQLCSGVDENAAGACAQLVFAPIDESFADDAPLLPSGFRVIPLDPKTDGPAATRTLDLASTLEVGAGGARPANESDLNNYNLRSVLTIAFQFTFENHVRDNVAAMARQYVRSVMASVQRVAMAIAPSRLSSHMGLKPLPGSPEALTLARWICRSYRIHTGGELLRVDSQGGDAVLKLLWNHSDAIMCCSLKTNASPVFTFANQAGLDMLETTLVALQDIMLDKILDEAGRKILCSEFSKIMQQGFAYLPAGICTSSMGRPVSYEQAIAWKVLNDEDSNHCLAFMFINWSFV

SEQ ID NO: 9879 - protein, 849 aa, Vitis vinifera
MALSMHKESKQQMDSSKYVRYTPEQVEALERVYSECPKPSSMRRQQLIRECPILSNIEPKQIKVWFQNRRCREKQRKEASRLQTVNRKLTAMNKLLMEENDRLQKQVSQLVYENGYMRQQLQSASTATTDTSCESVVMSGQHQQQQNPTPQHPQRDASNPAGLLAIAEETLAEFLSKATGTAVDWVQMIGMKPGPDSIGIVAVSRNCSGVAARACGLVSLEPTKVAEILKDRPSWFRDCRCLDVLSVIPTGNGGTIELIYMQTYAPTTLASARDFWTLRYTTSLEDGSLVICERSLTSSTGGPTGPPASSYIRAEMLPSGYLIRPCEGGGSIIHIVDHVDLDAWSVPEVLRPLYESSKILAQKTTVAALRHIRQIAQETSGEIQYGGGRQPAVLRTFSQRLCRGFNDAVNGFADDGWSLMGSDGVEDVTIVINSSPSKFLGPQYNSTMFPTFGGGVLCAKASMLLQNVPPALLVRFLREHRSEWADYGVDAYSAACLKASPYEVPCARPGGFPSSQVILPLAHTVEHEEVTTQFLEVVRLEGHAFSPEDVALTRDMYLLQLCSGVDENAAGACAQLVFAPIDESFADDAPLLPSGFRVIPLDPKTDGPAATRTLDLASTLEVGAGGARPANESDLNNYNLRSVLTIAFQFTFENHVRDNVAAMARQYVRSVMASVQRVAMAIAPSRLSSHMGLKPLPGSPEALTLARWICRSYRIHTGGELLRVDSQGGDAVLKLLWNHSDAIMCCSLKTNASPVFTFANQAGLDMLETTLVALQDIMLDKILDEAGRKILCSEFSKIMQQGFAYLPAGICTSSMGRPVSYEQAIAWKVLNDEDSNHCLAFMFINWSFV

SEQ ID NO: 9880 - protein, 844 aa, Populus trichocarpa
MALSIHSKDKHMDSSKYVRYTPEQVEALERVYTECPKPSSLRRQQLIRECPILSNIEPKQIKVWFQNRRCREKQRKEASRLQTVNRKLTAMNKLLMEENDRLQKQVSHLVYENGFMRQQIQTASATTTDNSCESVVMSGQHQQQQNPTPQQPQRDANNPAGLLAIAEETLAEFLSKATGTAVDWVQMIGMKPGPDSIGIVAVSRNCSGVAARACGLVSLEPTKVAEILKDRPSWFRDCRCLDILSVIPTGSGGTIELIYMQTYAPTTLAAARDFWTLRYTTTLEDGSLVICERSLTSSTGGPTGPPPSSFIRAEMLPSGYLIRPCEGSGSIIHIVDHVDLDVWSVPEVLRPLYESSKILAQKMTMAALRHIRQIAQETSGEIQYGGGRQPAVLRTFSQRLCRGFNDAVNGFTDDGWSLLGSDGGDDVTIVINSSPNKFLGSQYNASMFPTFGGGVLCAKASMLLQNVPPALLVRFLREHRSEWADYGVDAYSAACLKASPYAVPCARPGGFPSSQVILPLAHTMEHEEFLEVVRLEGHAFSPEDVALARDMYLLQLCSGVDENAVGACAQLVFAPIDESFADDAPLLSSGFRVIPLDPKTDAPATTRTLDLASTLEVGPGGTRPASEADTNSYNLRSVLTIAFQFSFENHMRDNVAAMARQYVRGVVGSVQRVAMAIAPSRLSSNVGPKTLPGSPEALTLAQWICRSYRIHTGGELFRVESQAGDALLKQLWHHSDAIMCCSLKTNASPVFTFANQAGLDMLETTLVALQDIMLDKILDEAGRKILCSEFSKITQQGFAYLPAGICVSSMGRPVSYEQAVAWKVLNDDDSNHCLAFMFMNWSFV

SEQ ID NO: 9881 - protein, 843 aa, Populus trichocarpa
MALSMHSKDKQMDSSKYVRYTPEQVEALERVYTECPKPSSLRRQQLIRECPILCNIEPKQIKVWFQNRRCREKQRKESSRLQTVNRKLTAMNKLLMEENDRLQKQVSHLVYENGYMRQQIQTASATATDNSCESVVMSGQHQQQQNPTPQQPQRDANNPAGLLTIAEETLAEFLSKATGTAVDWVQMIGMKPGPDSIGIVAVSRNCSGVAARACGLVSLEPIKVAEILKDRPSWFRDCRCLDIMSVIPTGSGGTIELIYMQTYAPTTLAAARDFWTLRYTTTLEDGSLVICERSLTSSTGGPTGPPSSSFVRADMLPSGYLIRPCEGGGSIIHIVDHVDLDVWSVPEVLRPLYESSKILAQKMTMAALQYIRQIAQETSGEIQYGGGRQPAVLRTFSQRLCRGFNDAVNGFTDSGWSLLDGDGGDDVTIVINSSPTKFLGSQYNASISPTFGGVLCAKASMLLQNVPPALLVRFLREHRSEWADYGVDVYSAACLKASPYAVPCTRPGGFPSSQVILPLAHTVEHEEFLEVVRLEGHAFSPEDVALAQDMYLLQLCSGVDENALGACAQLVFAPIDESFADDAPLLPSGFRVIPLDPKTDAPAATRTLDLASTLEVGPGGARPASEADTNSYNLRSVLTIAFQFTFENHFRDNVAAMARQYVRGVVASVQRVAMAISPSRLSSNMGPKSLPVSPEALTLARWIYRSYRIHTGGELFRVDSQAGDALLKRLWHHSDAIMCCSLKTNASPVFTFANQAGLDMLETTLVALQDIMLDKILDEAGRKILCSEFSKIMQQGYAYLPAGICVSSMGRPVSYEQAIAWKVLNDDNSNHCLAFMFINWSFV

SEQ ID NO: 9882 - protein, 846 aa, Glycine max
MALSMHKDSANNQMDSSKYVRYTPEQVEALERVYAECPKPSSLRRQQLIRECPILSNIEPKQIKVWFQNRRCREKQRKEASRLQTVNRKLTAMNKLLMEENDRLQKQVSHLVYENGYMKQQIHTASAGTTTDNSCESVVMSGQNQQQNPTPQHPNRDANNPAGLLAIAEETLAEFLSKATGTAVDWVQMIGMKPGPDSIGIVAVSRNCSGVAARACGLVSLEPTKVAEILKDRQSWYRDCRCVDVLSIVPTGNGGTIELLYMQTYAPTTLAAARDFWTLRYTTSLEDGSLVICERSLTSSTGGPTGPPSTTFVRAEMLPSGFLVRPCEGGGSIIHIVDHIDLDVWSVPEVLRPLYESSKFLAQKLTIAALQHIRQIAQESSGEIQYSGGRQPAVLRTFSQRLCRGFNDAVNGFVDDGWSLMGTDGVEDVTIAINSSPNKFLGSNYNASMFPAFGGGVLCAKASMLLQNVPPALLVRFLREHRSEWADYGVDAYSAACLKASPYAVPCARPGGFPSTQVILPLAHTIEHEEFLEVVRIEGHAFSPEDVALARDMYLLQLCSGVDENAIGACAQLVFAPIDESFADDALLLPSGFRVIPLDPKSDGPAATRTLDLASTMEVGSGNARPAGEADLNGYNLRSVLTIAFQFTFENHTRDNVAAMARQYVRSVVGSVQRVAMAIAPSRFNTQLGPKSLSGSPEALTLARWICRSYRVHTGTELFKAESTAGDAILKQLWHHPDAIICCSVKTNASPVFTFSNQAGLDMLETTLVSLQDIMLDKVLDESGRKILCSEFSKIMQQGFASLPAGICVSSMNRPVSYEQVVAWKVLNDDDSNHCLAFMFINWSFV

SEQ ID NO: 9883 - protein, 846 aa, Glycine max
MALSMHKDSANNQMDSSKYVRYTPEQVEALERVYAECPKPSSLRRQQLIRECPILSNIEPKQIKVWFQNRRCREKQRKEASRLQTVNRKLTAMNKLLMEENDRLQKQVSHLVYENGYMKQQIHTASAGTTTDNSCESVVMSGQNQQQNPTPQHPNRDANNPAGLLAIAEETLAEFLSKATGTAVDWVQMIGMKPGPDSIGIVAVSRNCSGVAARACGLVSLEPTKVAEILKDRQSWYRDCRCVDVLSIVPTGNGGTIELMYMQTYAPTTLAAARDFWTLRYTTSLEDGSLVICERSLTSSTGGPAGPPSTTFVRAEMLPSGFLIRPCEGGGSIIHIVDHIDLDVWSVPEVLRPLYESSKILAQKLTIAALQHIRQIALESSGEIQYGGGRQPAVLRTFSQRLCRGFNDAVNGFVDDGWSLMGTDGVEDVTIAINSSPNKFLGSNYNASMFPAFGGGVLCAKASMLLQNVPPALLVRFLREHRSEWADYGVDAYSAACLKASPYAVPCARPGGFPSTQVILPLAHTIEHEEFLEVVRIEGHAFSPEDVAMARDMYLLQLCSGVDESAVGACAQLVFAPIDESFADDALLLPSGFRVIPLDPKSDGPAPTRTLDLASTMEVGSGNARPAGEADLNGYNLRSVLTIAFQFTFENHTRDNVAAMARQYVRSVVGSVQRVAMAIAPSRLNTQLAPKSLPGSPEALTLARWIFRSYRMHTGTELFKAESTAGDAILKQLWHHPDAIMCCSVKTNASPVFTFANQAGLDMLETTLVALQDIMLDKVLDESSRKILCCEFSKIMQQGFAYLPAGICASSMNRPVSYEQAVAWKVLNDDDSNHCLAFMFMNWSFV

SEQ ID NO: 9884 - protein, 843 aa, Nicotiana sylvestris
MALCLNNKNQIMDNSKYVRYTPEQVEALERVYAECPKPTSLRRQQLIRECPILSNIEPKQIKVWFQNRRCREKQRKEASRLTTVNRKLSAMNKLLMEENDRLQKQVSQLVYENGYMKQQINTVSSTTTDTSCESVVVNGQQQRKNPTPQHPERDANNPAGLLAIAEETLAEFLGKATGTAVDWVQMIGMKPGPDSIGIVAVSRNCSGVAARACGLVSLEPTKVAEILKDRPSWYRDCRCLNILSVIPTGNGGTIELIYLQTYAPTTLASARDFWTLRYTTSLEDGSLVICERSLTTATGGPTGPPATSFVRAEMLPSGYLIRPCEGGGSMIHIVDHIDLDAWSVPEVLRPLYESSKILAQKTTVAALRHIRQIAQETSGEIQYTGGRQPAVLRALSQRLCRGFNDAVNGFVDDGWTVMDSDGVEDVTVAINSSSTKFLGSQYNTLSILPTFGGVLCARASMLLQNVPPALLVRFLREHRSEWADYGVDAYSAASLKASPYAVPCARPGGFPSSQVILPLAQTVEHEEFLEVVRLEGPAFSPEDIALSRDMYLLQLCSGVDENASGACAQLVFAPIDESFGDDAPLLPSGFRVIPLEPKSDGPAATRTLDLASTLEAGTGGTRPAGEIEASNYNHRSVLTIAFQFTFESHYRDNVAAMARQYVRSIVGSVQRVAMAIAPSRLSSQLTPKPFPGSPEAVTLARWISRSYRVHTGGDLLQVDSQDGDAVLKQLWHHSDAIMCCSVKMNASAVFTFANQAGLDMLETTLLALQDIMLDKILDEAGRKVLLSEFSKIMQQGFAYLPAGICVSSMGRPVSYEQAVAWKVLNDEDSNHCLAFMFINWSFV

SEQ ID NO: 9885 - protein, 849 aa, Glycine max
MALCMQRDSASNKQQLMDCGKYVRYTPEQVEALERVYIECPKPSSSRRQQIIRECPLLANIETKQIKVWFQNRRCREKQRKEASRLQTVNRKLSAMNKLLMEENDRLQKQVSQLVYDNGFMKQQIHTASATTTTDNSCESVVVSGQRQHQNPKIQHPQWDANNPAGLLAIAQETLAAFLSKATGTAVNWVQMIGMKPGPDSIGIVAVSRNCSGVAARACGLVSLEPTKVAEILKDRPSWYRDCRCLNVLSVIPTGNGGTIELMYMQTYAPTTLAAARDFWTLRYTTSLEDGSLVICERSLTSSTGGPTGPAASNFVRAEMLPSGYLIRSCEGGGSIVHIVDHVDLDVWSVPEVLRPLYESPKFLAQKLTTAALRNVRQIAQESSGEVQYGGGRQPAVLRTFSQRLCKGFNDAVNGFVDDGWSLMGNDGVEDVTIGINSSPNKFFSSHYNTSMLPAFGGGVLCAKASMLLQNVPPALLVRFLREHRSEWANYGVDAYSSACLKASPYAVPCARPSGFPSSHVIIPLAHTIEHEEFLEVVRIEGNAFPPDDVALACDMYLMQLCSGIDENAIGACAQLVFAPIDESFADDALLLPSGFRIIPLDPKTDGPASTRTLDLASTLETGSGNARSAGESDLNNYNLRSVLTIAFQFTFENHLRDNVAVMARQYVRNVVRSVQRVAMAIAPSRISTQLGPKSLPGPPEALTLARWICKSYSLHTCTELFSVESTSGDAILKQLWHHPDAILCCSVKTNASPVFTFANQAGLDMLETTLVALQDIMLDKVLDEAGRKFLCIEFSKIMQQGFAYLPAGICVSSMNRPVSYEQAIAWKVLDDDDSNHCLAFVFMNWSFV

SEQ ID NO: 9886 - protein, 853 aa, Glycine max
MALCMQSQQRDSASNKLLMDCGKYVRYTPEQVEALERVYVECPKPSSSRRQQIIRECPLLANIETKQIKVWFQNRRCREKQRKEASRLQTVNRKLSSMNKLLMEENDRLQKQVSQLVYDNGFMKQQIHTASATTTTTTDNSCESVVVSGQHQPQNPKTQHPQWDANNPAGLLAIAQETLVEFLSKATGTAVNWVQMIGMKPGPDSIGIVAVSRNCSGVAARACGLVSLEPTKVAEILKDRPSWYRDCRCLNVLSVVSAGNGGTIELMYMQTYAPTTLAAARDFWTLRYSTSLEDGSLVICERSLTSSTGGPTGPAASNFIRAEMLPSGYLIRSCEGGGSIIHIVDHVDLDVWSVPEVLRPLYESPKFLAQKLTTAALRHARQIAQESSGDVHYGGGRQPAVLRTFSQRLCKGFNDAVNGFVDDGWSLMGNDGVEDVTIAINSSPNKFFGSHYNTSMLPAFGGGVMCAKASMLLQNVPPALLVRFLREHRSEWANYEVDAYSSACLKASPYAVPCARPSGFPSSHVIIPLAHTIEHEEFLEVVRIEGNAFPPDDVAWACDMYLMQLCSGIDENAIGACAQLVFAPIDESFADDALLLPSGFRIIPLDPKTDGLASTRTLDLASTLETGSGNARSAGESDSNNYNLRSVLTIAFQFTFENHLRDNVAVMARQYVRNVVRSVQRVAMAIAPSRLSTQLGPKSFPGPPEALTLARWICRSYRLHTCTELFSVESTSGDAILKQLWHHPDAILCCSVKTDASPVFTFANQAGLDMLETTLVALQDIMLDKVLDEAGRKVLCIEFSKIMQQGFAYLPAGICVSSMNRPVSYEQAIAWKVLDDDDSNHCLAFVFMNWSFV

SEQ ID NO: 9887 - protein, 783 aa, Malus x domestica
IKVWFQNRRCREKQRKESSRLQTVNRKLTAMNKLLMEENDRLQKQVSHLVYENGFMKQQLHTASGTTTDNSCESVVMSGQHQQQQNPTPQHPQRDANNPAGLLAIAEETLAEFLSKATGTAVDWVQMIGMKPGPDSIGIVAVSRNCSGVAARACGLVSLEPTKVAEILKDRKSWFRDCRCLEVLSLIPAGNGGTIELVYMQTYAPTTLAAARDFWTLRYTTSLEDGSLVVCERSLTSSTGGPPGPTSASFVRAEMLPSGYLIRPCEGGGSIINIVDHVDLDAWSVPEVLRSLYESSKILAQKTTISALRHIRQIAQESSGEIQHGGGRQPAVLRTFCQRLCSGFNDAVNGFADDGWTLMGSDGVEDVTIAINSSPKVLGSQYNTSIFPPFGGGVLCAKASMLLQSVPPALLVRFLREHRAEWADYGVDAYSAACLKASPYAVPLARGGGFPSTQNILPLAQTVEHEEFLEVVRLEGPAFSPEDVALTRDMYLLQLCSGVDENAVGACAQLVFAPIDESFADDAPLLPSGFHVIPLDPKADGPTATRTLDLASTLEVGTSGARAINDADGNSYNRRSVLTIAFQFTFENHLRDNVAAMARQYVRSVVSSVQRVAMAIAPSPLSSQIGPKPLPGCPEAHTLARWIFRSFRIHTGGELFRVDISSSDAILKQLWRHSDAIMCCSVKTNTSPVFTFANQAGLDMLETTLVALQDIMLDKILDEAGRKFLCSEFSKIMQQGFAYLPAGICASSMGRPVSYEQAVAWKVVNDDDSNHCLALMFMNWSFM

SEQ ID NO: 9888 - protein, 231 aa, Antirrhinum majus
TAVDWVQMIGMKPGPDSIGIVAISRNCSGIAARACGLVSLEPTKVAEILKDRLSWYRDCRCLDIASAIPTGNGGTIELMYMQTYAPTTLASARDFWTMRYTTSLEDGSLVICERSLTSSTGGPAGPLATCFVRAEMLPSGFLIRPCDGGGSIIHIVDHLDLDAWSVPEVLRPLYESSKILAQKITVAALRHIRQIAQESNGEIQCSGGRQPAVLRTLSQRLCRGFNDALNG

SEQ ID NO: 9889 - protein, 844 aa, Vitis vinifera
MAMAIAQQHRESSSSGSINKHLDSGKYVRYTAEQVEALERVYLECPKPSSLRRQQLIRECPILSNIEPKQIKVWFQNRRCREKQRKEASRLQTVNRKLTAMNKLLMEENDRLQKQVSQLVCENGYMRQQLQTASAATTDASCESVVTTPQHSLRDANNPAGLLSIAEETLAEFLSKATGTAVDWVQMPGMKPGPDSVGIFAISHSCSGVAARACGLVSLEPSKIAEILKDRPSWFRDCRSLEVFTMFPAGNGGTVELLYTQIYAPTTLAPARDFWTLRYTTSLDNGSLVVCERSLSGSGAGPNTAAAAQFVRAEMLPSGYLIRPCEGGGSIIHIVDHLNLEAWSVPEVLRPLYESSRVVAQKMTIAALRYIRQIAQETSGEVVYGLGRQPAVLRTFSQRLSRGFNDAINGFNDDGWSLMSCDGAEDVIIAVNSTKNLNTTSNPANSLSLPGGVLCAKASMLLQNVPPAVLVRFLREHRSEWADFSVDAYSAASLKASPYSYPGMRPTRFTGSQIIMPLGHTIEHEELLEVIRLEGHSLAHEDAFMSRDIHLLQICSGVDENAVGACSELVFAPIDEMFPDDAPLLPSGFRIIPLDSKSGDTQETLTTHRTLDLTSSLEVGPATNQAAGDSSSCYNTRSVLTIAFQFPFESNLQDNVATMARQYVRSVISSVQRVAMAISPSGLGPAVGPKLSAGSPEALTLAHWICQSYSYHVGAELLRSDSVGGDSVLKNLWHHQDAILCCSLKSLPVLIFANQAGLDMLETTLVALQDISLDKIFDESGRKGLCADFAKIMQQGFAYLPAGICMSTMGRHVSYEQAIAWKVLAAEENTVHCLAFSFINWSFV

SEQ ID NO: 9890 - protein, 842 aa, Vitis vinifera
MAMAIAQQHRESSSSGSINKHLDSGKYVRYTAEQVEALERVYLECPKPSSLRRQQLIRECPILSNIEPKQIKVWFQNRRCREKQRKEASRLQTVNRKLTAMNKLLMEENDRLQKQVSQLVCENGYMRQQLQTASAATTDASCESVVTTPQHSLRDANNPAGLLSIAEETLAEFLSKATGTAVDWVQMPGMKPGPDSVGIFAISHSCSGSGSSSMRSCKFRTLKEILKDRPSWFRDCRSLEVFTMFPAGNGGTVELLYTQIYAPTTLAPARDFWTLRYTTSLDNGSLVVCERSLSGSGAGPNTAAAAQFVRAEMLPSGYLIRPCEGGGSIIHIVDHLNLEAWSVPEVLRPLYESSRVVAQKMTIAALRYIRQIAQETSGEVVYGLGRQPAVLRTFSQRLSRGFNDAINGFNDDGWSLMSCDGAEDVIIAVNSTKNLNTTSNPANSLSLPGGVLCAKASMLLQNVPPAVLVRFLREHRSEWADFSVDAYSAASLKASPYSYPGMRPTRFTGSQIIMPLGHTIEHEELLEVIRLEGHSLAHEDAFMSRDIHLLQICSGVDENAVGACSELVFAPIDEMFPDDAPLLPSGFRIIPLDSKSGDTQETLTTHRTLDLTSSLEVGPATNQAAGDSSSCYNTRSVLTIAFQFPFESNLQDNVATMARQYVRSVISSVQRVAMAISPSGLGPAVGPKLSAGSPEALTLAHWICQSYSYHVGAELLRSDSVGGDSVLKNLWHHQDAILCCSLKSLPVLIFANQAGLDMLETTLVALQDISLDKIFDESGRKGLCADFAKIMQQGFAYLPAGICMSTMGRHVSYEQAIAWKVLAAEENTVHCLAFSFINWSFV

SEQ ID NO: 9891 - protein, 842 aa, Ricinus communis
MAMAMVQHRETSSGSINKHLTDSGKYVRYTAEQVEALERVYSECPKPSSLRRQQLIRECPILSNIEPKQIKVWFQNRRCREKQRKESSRLQTVNRKLTAMNKLLMEENDRLQKQVSQLVCENGYMRQQLQTASAATDASCDSVVTTPQHSLRDANNPAGLLSIAEETLAEFLSKATGTAVDWVQMPGMKPGPDSVGIFAISQSCSGVAARACGLVSLEPTKIAEILKDRPSWFRDCRSLEVFTMFPAGNGGTIELVYSQVYAPTTLAPARDFWTLRYTSSLDNGSLVVCERSLSGSGAGPNAAAAAQFVRAEMLPSGYLIRPCDGGGSIIHIVDHLNLEAWSVPEVLRPLYESSKVVAQKMTIAALRFIRQIAQETSGEVVYGLGRQPAVLRTFSQRLSRGFNDAINGFNDDGWSLMSCDGAEDVIVTINSTKNLSSTSNAANSFAFLGGILCAKASMLLQNVPPAVLVRFLREHRSEWADFNVDAYSAASLKAGSYAFPGMRPTRFTGSQIIMPLGHTIEHEELLEVIRLEGHSLVQEDAFVSRDIHLLQICSGIDENAVGACSELVFAPIDEMFPDDAPLLPSGFRIIPLDSKTKDTQDALTTSRTLDLTSSLEVGPAANNTAGDASSSQSTRSVLTIAFQFPFESNLQENVATMARQYVRSVISSVQRVAMAISPSGLGPAVGPKLSPGSPEALTLAHWICQSYSYYLGAELLRSDSLAGDSVLKQLWHHQDAILCCSLKSLPVFIFANQAGLDMLETTLVALQDITLDKIFDESGRKALCADFAKLMQQGFAGLPGGICMSTMGRHVSYEQAVAWKVLAADESTVHCLAFSFVNWSFV

SEQ ID NO: 9892 - protein, 842 aa, Glycine max
MAMVVAQHRESSSSGSIDKHLDSGKYVRYTAEQVEALERVYAECPKPSSLRRQQLIRECPILSNIEPKQIKVWFQNRRCREKQRKEASRLQTVNRKLTAMNKLLMEENDRLQKQVSQLVCENGFMRQQLHTPSATTTDASCDSVVTTPQHTLRDASNPAGLLSIAEETLTEFLSKATGTAVDWVQMPGMKPGPDSVGIFAISQSCSGVAARACGLVSLEPTKIAEILKDRPSWFRDCRSLEVFTMFPAGNGGTIELVYTQTYAPTTLAPARDFWTLRYTTSLENGSLVVCERSLSGSGTGPNPAAAAQFVRAETLPSGYLIRPCEGGGSIIHIVDHLNLEAWSVPEVLRPLYESSKVVAQKMTIAALRYIRQIAQETSGEVVYGLGRQPAVLRTFSQRLSRGFNDAVNGFNDDGWTVLNCDGAEDVIIAVNSTKNLSGTSNPASSLTFLGGILCAKASMLLQNVPPAVLVRFLREHRSEWADFNVDAYSAASLKAGTYAYPGMRPTRFTGSQIIMPLGHTIEHEEMLEVIRLEGHSLAQEDAFVSRDIHLLQICSGIDENAVGACSELVFAPIDEMFPDDAPLVPSGFRIIPLDSKPGDKKDAVATNRTLDLTSGFEVGPATTAGADASSSQNTRSVLTIAFQFPFDSSLQDNVAVMARQYVRSVISSVQRVAMAISPSGINPSIGAKLSPGSPEAVTLAHWICQSYSYYLGSDLLRSDSLVGDMMLKQLWHHQDAILCCSLKSLPVFIFANQAGLDMLETTLVALQDITLDKIFDEAGRKALCTDFAKLMEQGFAYLPAGICMSTMGRHVSYDQAIAWKVLTGEDNTVHCLAFSFINWSFV

SEQ ID NO: 9893 - protein, 845 aa, Glycine max
MAMAVAQHRESSSSGSIDKHLDSGKYVRYTAEQVEALERVYAECPKPSSLRRQQLIRECPILSNIEPKQIKVWFQNRRCREKQRKEASRLQTVNRKLTAMNKLLMEENDRLQKQVSQLVCENGFMRQQLHTPSAATTDASCDSVVTTPQHTMRDANNPAGLLSIAEETLTEFLSKATGTAVDWVQMPGMKPGPDSVGIFAISQSCSGVAARACGLVSLEPTKIAEILKDRPSWFRDCRSLEVFTMFPAGNGGTIELVYTQTYAPTTLAPARDFWTLRYTTSLENGSLVVCERSLSGSGTGPNPAAAAQFVRAETLPSGYLIRPCEGGGSIIHIVDHLNLEAWSVPEVLRPLYESSKVVAQKMTIAALRYIRQIAQETSGEVVYGLGRQPAVLRTFSQRLSRGFNDAVNGFNDDGWTVLNCDGAEDVFIAVNSTKNLSGTSNPASSLTFLGGILCAKASMLLQNVPPAVLVRFLREHRSEWADFSVDAYSAASLKAGTYAYPGMRPTRFTGSQIIMPLGHTIEHEEMLEVIRLEGHSLAQEDAFVSRDIHLLQICSGIDENAVGACSELVFAPIDEMFPDDAPLIPSGFRIIPLDSKPGDKKEVATNRTLDLTSGFEVGPATTAGTDASSSQNTRSVLTIAFQFPFDSSLQDNVAVMARQYVRSVISSVQRVAMAISPSGISPSVGAKLSPGSPEAVTLAHWICQSYSYYIGSDLLRSDSLVGDMMLKQLWHHQDAILCCSLKASKLPLPVFIFANQAGLDMLETTLVALQDITLDKIFDEAGRKALCTDFAKLMEQGFAYLPAGICMSTMGRHVSYDQAIAWKVLTGEDNTVHCLAFSFINWSFV

SEQ ID NO: 9894 - protein, 845 aa, Malus x domestica
MAMAVAHHRESSSGSSINKHLDAGKYVRYTSEQVEALERVYAECPKPSSLRRQQLIRECSILSNIEPRQIKVWFQNRRCREKQRKESSRLQTVNRKLSAMNKLLMEENDRLQKQVSQLVCENGYMRQQLHSASAATTDASGDSVVTTPQHSLRDANNPAGLLSVAEETLAEFLSKATGTAVDWVQMPGMKPGPDSVGIFAISQSCSGVAARACGLVSLEPTKIAEILKDRPSWFRDCRSLEVFTMFPAGNGGTIELIYTQTYAPTTLAPARDFWTLRYTATLDNGSFVVCERSLSGSGAGPNPASASQFVRGAMLPSGYLIRPCEGGGSIVHIVDHLNLEAWSVPEVLRPLYESSKVVAQRMTIAALRYIRQIAEETSGEVVYSLGRQPAVLRTFSQRLIRGFNDAVNGFNDDGWSLVNCDGDGADDVIIAVNSTKNLTSTSNHANSLALLGGVLCAKASMLLQNVPPAVLVRFLREHRSEWADFNVDAYSATSMKAGAYAYPGMRPTRFTGGQIIMPLGHTIEQEELLEVVRLEGHSLTQEDAFASRDIHLLQICSGVDENAVGACSELVFAPIDEMFPDDAPLLPSGFRIIPLDSKTGDSKDTLNTHRTLDLTSSLEVGSTTSNAAGELTTFHNTRSVLTIAFQFPFDNSLQENVANMARQYVRSVISSVQRVAMAISPSGLSPSVGPKLSPGSPEAQTLAHWICQSYSYHVGGELLRPDSLGGDSLLKHLWHHQDAILCCSLKSMPVFIFANQAGLDMLETTLVALQDISLDKIFDESGRKTLCADFAKLMNQGFAYLPAGICMSTMGRHVSYEQAIAWKVVAAEENSVHCLAFSFVNWSFV

SEQ ID NO: 9895 - protein, 844 aa, Glycine max
MAMAVAQHRESSSSGSIDKHLDSGKYVRYTAEQVEALERVYAECPKPSSLRRQQLIRECPILSNIEPKQIKVWFQNRRCREKQRKEASRLQTVNRKLTAMNKLLMEENDRLQKQVSQLVCENGFMRQQLHTPSAATTDASCDSVVTTPQHTMRDANNPAGLLSIAEETLTEFLSKATGTAVDWVQMPGMKPGPDSVGIFAISQSCSGVAARACGLVSLEPTKIAEILKDRPSWFRDCRSLEVFTMFPAGNGGTIELVYTQTYAPTTLAPARDFWTLRYTTSLENGSLVVCERSLSGSGTGPNPAAAAQFVRAETLPSGYLIRPCEGGGSIIHIVDHLNLEAWSVPEVLRPLYESSKVVAQKMTIAALRYIRQIAQETSGEVVYGLGRQPAVLRTFSQRLSRGFNDAVNGFNDDGWTVLNCDGAEDVFIAVNSTKNLSGTSNPASSLTFLGGILCAKASMLLQNVPPAVLVRFLREHRSEWADFSVDAYSAASLKAGTYAYPGMRPTRFTGSQIIMPLGHTIEHEEMLEVIRLEGHSLAQEDAFVSRDIHLLQICSGIDENAVGACSELVFAPIDEMFPDDAPLIPSGFRIIPLDSKPVKFCSSVNRTLDLTSGFEVGPATTAGTDASSSQNTRSVLTIAFQFPFDSSLQDNVAVMARQYVRSVISSVQRVAMAISPSGISPSVGAKLSPGSPEAVTLAHWICQSYSYYIGSDLLRSDSLVGDMMLKQLWHHQDAILCCSLKASKLPLPVFIFANQAGLDMLETTLVALQDITLDKIFDEAGRKALCTDFAKLMEQGFAYLPAGICMSTMGRHVSYDQAIAWKVLTGEDNTVHCLAFSFINWSFV

SEQ ID NO: 9896 - protein, 855 aa, Populus trichocarpa
MAMAVAPQHRESSGSGSLNKHLTDNGKYVRYTSEQVEALERVYAECPKPSSLRRQQLIRECPILANIEPKQIKVWFQNRRCREKQRKESSRLQTVNRKLTAMNKLLMEENDRLQKQVSQLVCENGFMQQQLQTAPAAADASCDSAVTTPQHSLRDANNPAGLLSLAEETLAEFLSKATGTAVDWVQMPGMKPGPDSVGIFAISQRCSGVAARACGLVSLEPTKLAEILKDRQSWFRDCRNLEVFTVFPAGNGGTIELLYSQIYAPTTLAPARDFWTLRYTINLENGSLVVCERSLSGSGAGPNAAAAAQFVRAEMLPSGYLIRPCEGGGSIIHIVDHLNLQAWSVPEVLRPLYESSKAVAQKVTITALRHVRQIAHETSGEVVYGLGRQPAVLRTFSQRLSRGFNDAINGFNDDGWSLMNSDGAEDVIIAVNTTKNLISANNPAHSLSFLGGILCAKASMLLQNVPPAVLVRFLREHRSEWADFSVDAYSAASLKAGSYAYPGMRSMRFTGSQIIMPLGHTIEQEELLEVIRLEGHSFAQEDAFVSRDIHLLQICSGIDENAVGACSELVFAPIDEMFPDDAPLLPSGFRVIPLESKTKDAQEALTTNRTLDLTSSLEVGPVTNHASVDGSSCHLRSVLTIAFQFPFESNLQDNVATMARQYVRSVISSVQRVATAISPSGLNPALGPKLSAGSPEALTLAHWICQSYWQVLPQVSSCYHLGAELLRSDSVGGDSVLKHLWHHPDAILCCSLEALPVFIFANQAGLDMLETTLVALQDITLDKIFDESGRKALFTDFAKLMQQANNGFACLPAGICMSTMGRNVSYEQAVSWKVLAAEENTVHCIAFSFVNWSFL

SEQ ID NO: 9897 - protein, 841 aa, Lotus japonicus
MAMAFVQDRESSIDRHLDSSGKYVRYTAGQVEALERVYTECPKPSSLRRQQLIRECPVLANVEPKQIKVWFQNRRCREKQRKEASRLQAVNRKLNAMNKLLMEENDRLQKQVSQLVCENGFMRQQLQAPSAAGTTDGNGDSVATTSRNSMRDANSPAGFLSIAEETLAEFLSKATGTAVDWVQLPGMKPGPDSVGIFTISQSCSGVAARACGLVSLEPNKVAEILKDRLSWFRDCRSLEVFTMFPAGNGGTIELVYTQTYAPMTLSPARDFWTLRYTTTLENGSLVVCERSLSGSGAGPNAAAAHQFVRAEMLPSGYLIRPCEGGGSIIHIVDHLNLQAWSVPEVLRPLYESSKVVAQRMTIAALRYVRQIAQETSGEVVYGLGRQPAVLRTFSQRLSRGFNDAVNGFNDDGWSVLNCDGAEDVIISVNSTKNLSGTSNPASSLTFAGGVLCAKASMLLQNIPPAVLVRFLREHRSEWADFNVDAYSAASLKAGSYAYPGMRPMRFTGNQIIMPLGHTIEHEEMLEVIRLEGHSLAQEDAFASRDVHLLQLCSGIDEDAVGACCELIFAPIDEMFPDDAPLVPSGFRIIPLDSKPGDKKDTMTTNKTLNLTSGLEVGASTNHTAGDASSCHNNRSVLTIAFQFPFESSLQDNVAVMARQYVRSVISSVQTVSMAISPSGTNPAAGAKLSVGSPEALTLARWVCQSYSYYLGTGLLRSDSLVGDLVLKHLWHHQDAILCCSLKSVPMFIFANQAGLDMLETTLVALQDITLDKIFDESGRKALFADFAKLMQQGFAYLPAGICMSTMGRHVSYEQVIAWKVLAEEDNSVHCLAFSFINWSFV

SEQ ID NO: 9898 - protein, 836 aa, Gossypium barbadense
  misc_feature (666)..(666): Xaa can be any naturally occurring amino acid
MAMAMTHHHNRESSIDKHLDTGKYVRYTAEQVEALERVYAECPKPSSLRRQQLIRECPILSNIEPKQFKALFQNRRCREKQRKEASRLQTVNRKLTAMNKLLMEENDRLQKQVSQLVCENGYMRQQLHTVNASATDASCDSAVTTPQHSLRNANNPAGLLSIAEETLAEFLSKATGTAVNWVQMPGMKPGPDSVGIFATSQSCSGMAARACGLVSLEPTKIAEILKDRPSWFRDCRKLEVFTMFPAGNGGTIELVYTQMFAPTTLAPARDFWTLRYTTTLENGSLVVCERSLSGSGAGPSVASAAQFVRAEVLPSGYLIRPCEGGGSIIHIVDHLNLEAWSVPEVLRPLYESSRVIAQKMTIPALRYVRQIAQETSGEVVYSLGRQPAVLRTFSQRLSRGFNEAINGFNEDGWSIMNCDGTEDVIIAINSGKSLSNSSNLTTGLSFLGGVLCAKASMLLQNVPPAVLVRFLREHRLEWADFNVDAYSAASLKAGTYTYPGMRPTSFTGSQIIMPLGQTVEHEELLEVIRLEGQSLTQEDALLSRDIHLLQICSGIDDNAVGACSELVFAPIDEMFPDDAALLPSGFRIIPLESKPDSLATNRTLDLTSSLEVGPATSQAAGDSPSQNARSVLTIAFQFPFDTNLRDNVATMARQYVRSVISSVQRXAMAISPCGSSPTIGPKPSPGSPEALTLAHWICQSYSFHLGEELLKSESLGGDSVLKNLWQHQDAILCCSLKSVPVFIFANQAGLDMLETTLVDLPDITLDKIFDESGRKALCSDFTKLMQQGFTHLLAGVCMSTMGRHVSYEQAVAWKVLAADANTVHCLAFSFINWSFV

SEQ ID NO: 9899 - protein, 844 aa, Populus trichocarpa; identical to SEQ ID NO: 9880

SEQ ID NO: 9900 - protein, 845 aa, Vitis vinifera; identical to SEQ ID NO: 9878

SEQ ID NO: 9901 - protein, 836 aa, Medicago truncatula; identical to SEQ ID NO: 9873

SEQ ID NO: 9902 - protein, 854 aa, Vitis vinifera
MAMSCKDGKGIMDNGKYVRYTPEQVEALERLYHECPKPSSIRRQQLIRECPILSNIEPKQIKVWFQNRRCREKQRKEASRLQAVNRKLTAMNKLLMEENDRLQKQVSQLVYENGYFRQHTQNTTLATKDTSCESVVTSGQHHLTPQHPPRDASPAGLLSIAEETLTEFLSKATGTAVEWVQMPGMKPGPDSIGIVAISHGCTGVAARACGLVGLEPTRVAEILKDRPSWFRDCRAVDVLNVLPTANGGTIELLYMQLYAPTTLAPARDFWLLRYTSVMEDGSLVVCERSLKNTQNGPSMPPVQHFVRAEMLPSGYLIRPCEGGGSIIHIVDHMDLEPWSVPEVLRPLYESSTVLAQKTTMAALRQLRQIAQEVSQSNVTGWGRRPAALRALSQRLSRGFNEALNGFTDEGWSMMGNDGIDDVTILVNSSPEKLTGLNLSFANGFPAVSNAVLCAKASMLLQVSFISCSDVLFTIYHFQNVPPAILLRFLREHRSEWADNNIDAYSAAAVKVGPCSLPGSRVGSFGSQVILPLAHTIEHEEFLEVIKLEGVGHCPEDAMMPRDMFLLQLCSGMDENAVGTCAELIFAPIDASFADDAPLLPSGFRIIPLDSGKEASSPNRTLDLASALEIGPAGNRSSNDYSVNGGNTRSVMTIAFEFAFESHLQENVASMARQYVRSIISSVQRVALALSPSHLSSHAGLRPPLGTPEAHTLARWISHSYRCYLGVELLKSSGEGSETILKTLWHLSDAIMCCSLKALPVFTFANQAGLDMLETTLVALQDITLEKIFDDHGRKTLCSEFPQIMQQGFACLQGGICLSSMGRPVSYERAVAWKVLNEEENAHCVCFMFMNWSFV

SEQ ID NO: 9903 - protein, 837 aa, Populus trichocarpa
MEMSCKDGKQPIMDNGKYVRYTPEQVEALERLYHDCPKPSSIRRQQLIRECPILSNIEPKQIKVWFQNRRCREKQRKEASRLQAVNRKLSAMNKLLMEENDRLQKQVSQLVYENGYFRQHTHNTPLATKDTSCESVVTSGQHHLTPQHPPRDASPAGLLSIAEETLTEFLSKATGTAVEWVQMPGMKPGPDSSGIVAISHGCAGVGARACGLVGLEPTRVAEILKDRPSWFRDCRAVDVLNVLPTANGGTIELLYMQLYAPTTLAPGRDFWLLRYTSVLEDGSLVVCERSLKNTQNGPSMPPVQHFVRAEMLPSGYLVRPCEGGGSIIHIVDHMDLEPWSVPEVLRPLYESSTVLAQKTTMVALRQLRQIAQEASQSNVTNWGRRPAALRALSQRLSRGFNEALNGFSDEGWSMIGNDGMDDVTILVNSSPDKLMGSNLSFTNGFPAVSSAVLCAKASMLLQNVPPAILLRFLREHRSEWADNNIDAYAAAAVKVGPFSLQGSRVGSFGGQVILPLAHTIEHEEFLEVIKLEGVGHSPEDPIMPRDVFLLQLCCGMDENAVGTCAELIFAPIDATFADDAPLLPSGFRIIPLDSGKEASSPNRTLDLAAALEVGPAGNRASSDHSANSGCTRSVMTIAFEFAFESHMQEHVASMTRQYIRSIISSVQRVALALSPHLGSQAGLRSPLGTPEAQTLARWICQSYRSYLGVELLKSNGEGSESILKTLWHHSDAIMCCSLKALPIFTFANQAGLDMLETTLVALQDITLEKIFDDHGRKTLCSEFSQIMQQGFTCLQGGICLSSMGRPVSYERAVAWKVLNEEENAHCICFMFINWSFV

SEQ ID NO: 9904 - protein, 844 aa, Vitis vinifera; identical to SEQ ID NO: 9889

SEQ ID NO: 9905 - protein, 834 aa, Medicago truncatula
MAVSSGCKDGSKIAMDNGKYVRYTPEQVEALERLYHECPKPTSLRRQQLIRECPILSHIEPKQIKVWFQNRRCREKQRKEAGRLQAVNRKLTAMNKLLMEENDRLQKQVSHLVYENTFFRQHTQNTTLATTDTSCESVVTSGQQHPQPRDASPAGLLSIAEETLAEFLSKATGTAVEWVQMPGMKPGPDSIGIVAISHGSPGVAARACGLVGLEPARVAEILKDRLSWYRDCRTVDVLNVMSTGNGGTIELLYMQLYAPTTLAPGRDFWLLRYTSLLEDGSLVVCERSLNNTQNGPSMPPVPHFVRAEVLPSGYLIRPCEGGGSIIHIVDHMLLEPWSVPEVLRPLYESSMLLAQRTTMAALRHLRQISQEVSQPSVTGWGRRPAALRALSQRLSKGFNEAVNGFTDDGWSMLDSDGIDDVTLLVNSSPSKMMGLNLGYNNGFPSVTSSVLCAKASMLLQNVPPAILLRFLREHRSEWADTSIDAYSAAAIKAGPCSLPGARTGAFGGQVILPLAHTIEHEEFMEVIKLENMGYYRDDMTMPGDIFLLQLCSGVDEHAVGTSAELIFAPIDASFSDDAPILPSGFRIIPLESGTDAASPNRTLDLASALEVGTTGNKAGGDNSGHSGITKSVMTIAFQFAFEAHLQDNIAAMARQYVRSIVASVQRVSLALSPSRFGSQNAFPLPPGTPEAQTLTRWICNSYRFYLGAELLKCEGSESILKSLWHHSDAVLCCSLKALPVFTFANQAGLDMLETTLVALQDITLEKIFDDNGKKTLCSEFPQIMQQGFMCIQGGICLSSMGRPITYERAVAWKVLNEEESAHCICFMFINWSFV

SEQ ID NO: 9906 - protein, 844 aa, Glycine max
MMTVSSACKDGSKVALDNGKYVRYTPEQVEALERLYHECPKPSSLRRQQLIRECPILSNIEPKQIKVWFQNRRCREKQRKEASRLQAVNRKLTAMNKLLMEENDRLQKQVSHLVYENSFFRQQTHNNATLATTDTNTSCESVVTSGQRNLTPQQHPPRDASPAGLLSIAEETLAEFLSKATGTAVEWVQMPGMKPGPDSIGIVAISHGCPGVAARACGLVGLEPARVAEILKDRLSWFRDCRTVDVLNVMSTGNGGTIELLYMQLYAPTTLAPGRDFWLLRYTSLLEDGSLVVCERSLNNTQNGPAMPPVQHFVRADMLASGYLIRPCEGGGSIIHIVDHMVLEPWSVPEVLRPLYESSMLLAQRTTMAALRHLRQISQEVSQPSVTGWGRRPAALRALSQRLSKGFNEAVNGFADDGWSMLESDGIDDVTLLVNSSPSKMMGVNLGYNNNGFPSVSSSLLCAKASMLLQNVPPAILLRFLREHRSEWADSSIDAYSAAAIKAGPCSLPGARPGGFGGQVILPLAHTIEHEEFMEVIKLENMGYYRDDMNIPGDVFLLQLCSGVDEHAVGTSAELVFAPIDASFSDDAPILPSGFRIIPLDSGTDAASPNRTLDLASALEVGTTANKAAGDNSGHSGSTKSVMTIAFQFAFEVHLQENIATMARQYVRSIIASVQRVSLALSPSRFGSHNAFHLPPGTPEAQTLARWICNSYRFYLGVELLKCEGSESILKSLWHHSDAVLCCSLKALPVFTFANQAGLDMLETTLVALQDITLEKIFDDNGKKTLCTEFPQIMQQGFMCIQGGICLSSMGRPVSYERAVAWKVLNEEESAHCICFMFINWSFV

SEQ ID NO: 9907 - protein, 845 aa, Glycine max
MMAVSSACKDGSKVALDNGKYVRYTPEQVEALERLYHECPKPSSLRRQQLIRECPILSNIEPKQIKVWFQNRRCREKQRKEASRLQAVNRKLTAMNKLLMEENDRLQKQVSHLVYENSFFRQQTHNNNATLATTDTNTSCESVVTSGQRNLTPQQHPPRDASPAGLLSIAEETLAEFLSKATGTAVEWVQMPGMKPGPDSIGIVAISHGCPGVAARACGLVGLEPTRVAEILKDRLSWFRDCRTVDVLNVMSTGNGGTIELLYMQLYAPTTLAPGRDFWLLRYTSLLEDGSFVVCERSLNNTQNGPAMPPVQHFVRADMLPSGYLIRPCEGGGSIIHIVDHMVLEPWSVPEVLRPLYESSMLLAQRTTMAALRHLRQISQEVSQPSVTGWGRRPAALRALSQRLSKGFNEAVNGFADDGWSMLESDGIDDVTLLVNSSPSKMMGVSLVYNNNGFPSVSSSVLCAKASMLLQNVPPAILLRFLREHRSEWADSSIDAYSAAAIKAGPCSLPGARSGGFGGQVILPLAHTIEHEEFMEVIKLENMGYYRDDMSIPGDVFLLQLCSGVDEHAVGTSAELVFAPIDASFSDDAPILPSGFRIIPLDSGTDAASPNRTLDLASALEVGTTANKAASDNSAHSGSTKSVMTIAFQFAFEVHLQENIATMARQYVRSIIASVQRVSLALSPSRFGSHNAFHLPPGTPEAQTLARWICNSYRFYLGVELLKCEGSESILKSLWHHSDAVLCCSLKALPVFTFANQAGLDMLETTLVALQDITLEKIFDDNGKKTLCTEFPQIMQQGFMCIQGGICLSSMGRPVSYERAVAWKVLNEEESAHCICFMFINWSFV

SEQ ID NO: 9908 - protein, 844 aa, Malus x domestica
MMAVTSSCKDGGMKMQMDNGKYVRYTPEQVEALERLYHECPKPSSMRRQQLIRECPILSNIEPKQIKVWFQNRRCREKQRKEASRLQTVNRKLTAMNKLLMEENDRLQKQVSQLVYENSYFRQQTQNATLATTDTSCDSVVTSGQHHLTPQQHPPPPPRDASPAGLLSIAEETLAEFLSKATGTAVEWVQLPGMKPGPDSIGIVAISHGCTGVAARACGLVGLDPTRVAEILKDRPSWFRNCRSVDVLNVLSTGNGGTIELLYMQLYAPTTLAPARDFWLLRYTSVLEDGSLVVCERSLNNTQNGPSMPPVQNFVRAEMLPSGYLIRPCEGGGSILHIVDHMDLEPWSVPEVLRPLYESSTLLAQKTTMAALRNLRQISQEVSQPNSAGWGRRPAALRALSQRLSKGFNEAVNGFTDEGWSVLESDGVDDVTLLVNSSPGKMMSANLYTNGVPSMSTAVLCAKASMLLQNVPPAILLRFLREHRSEWADRSIDAYSAAAIKAGPCNMLGPRAGSFGDQVILPLAHTIEHEEFMEVIKIENMGHYREDMMMPAADIFLLQLCSGVDENAVGTCAELVFAPIDASFSDDAPILPSGFRIIPLDSRMDTPSPNRTLDLASALEVGPAGSRASGDNAGHSGNTKSVMTIAFQFAFEIHLQENIAAMARQYVRSIIASVQRVALALSPSHFGSHAGFRPPPGTPEAQTLAGWICQSYRCYLGGELLKTEGSESILKSLWHHSDAILCCSLKAMPVFTFANQAGLDMLETTLVALQDITLEKIFDDNGRKTLCSEFPQIMQQGFMCLQGGICMSSMGRPISYERAVAWKVLNEEETAHCICFMFINWSFV

SEQ ID NO: 9909 - protein, 841 aa, Malus x domestica
MAVTSSCKDGGMKMQMDNGKYVRYTPEQVEALERLYHECPKPSSMRRQQLIRECPILSNIEPKQIKVWFQNRRCREKQRKEASRLQTVNRKLTAMNKLLMEENDRLQKQVSQLVYENTYFRQHTQNATLATTDTSCESVVTSGQHHLTAQQHPPPRDASPAGLLSIAQETLAEFLSKATGTAVEWVQLPGMKPGPDSIGIVAISHGCTGVAARACGLVGLDPTRVAEILKDRPSWFRNCRSVDVANVMSTGNGGTIELLYMQLYAPTTLAPARDFWLLRYTSVLEDGSLVVCERSLNNTQNGPSMPPVQNFVRAEMLPSGYLIRPCEGGGSILHIVDHMDLEPWSVPEVLRPLYESSTILAQKTTMAALRNLRQISQEVSQPNSAGWGRRPAALRALSQRLSKGFNEAVNGFTDEGWSVLESDGVDDVTLLVNSSPGKMMSANLYTDGVPSMSTAVLCAKASMLLQNVPPAILLRFLREHRSEWADRSIDAYSAAAVKAGPCNMLGPRVGSFGDNVILPLAHTIEHEEFMEVIKIENLGHYREDMIMPAADIFLLQLCSGVDENAVGTCSELVFAPIDASFSDDAPILPSGFRIIPLDSRMDTPSPNRTLDLASALEVGPAGSRASGDNAGHSGNTKSVMTIAFQFAFEIHLQENVASMARQYVRSIIASVQRVALALSPSRFGSHAGFRPPPGTPQAQTLAGWICQSYRCYLGGELLKTEGSESILKSLWHHPDAILCCSLKAMPIFTFGNQAGLDMLETTLVALQDITLEKIFDDNGRKTLCSEFPQIMQQGFMCHQGGICMSSMGRPISYERAVAWKVLNEEETAHCICFMFINWSFV

SEQ ID NO: 9910 - protein, 839 aa, Vitis vinifera
MAVSSSCKDAKMALDNGKYVRYTPEQVEALERLYHDCPKPSSLRRQQLIRECPILSNIEPKQIKVWFQNRRCREKQRKEASRLQAVNRKLTAMNKLLMEENDRLQKQVSQLVYENSFFRQQTQNATLATTDTSCESVVTSGQHHLTPQHPPRDASPAGLLSIAEETLTEFLSKATGTAVEWVQMPGMKPGPDSIGIVAISHGCTGVAARACGLVSLEPTRVAEILKDWPSWYRECRNVDVLNVLSTGNGGTIELLYMQLYAPTTLAPARDFWLLRYTSVLEDGSLVVCERSLNNTQNGPSMPPVQYFVRAEKLPSGYLIRPCEGGGSIIHIVDHMDLEPWSVPEVLRPLYESSTLLAQKTTMAALRQLRQISQEVSQPTNTGWGRRPAALRALGQRLTKGFNEAVNGFTDEGWSMMESDGIDDVTLLVNSSPAKMMGVNLSYASGFPSMSNAVLCAKASMLLQNVPPAILLRFLREHRSEWADSSIDAYSAAAVKAGPCTLPVSRAGGYGGQVILPLAHTIEHEEFMEVIKLENVDHYREDLMMSGDVFLLQLCSGVDDNAVGTCSELIFAPIDASFSDDAPLLPSGFRIIPLDSGVDGSSPNRTLDLASSLEVGPAGNKASSDNSGHTGSAKSVMTISFQFAFEMHLQENVASMARQYVRSIISSVQRVALALSPSRFGPQMGFRPLPGTPEAHTLARWICQSYRCYLGVELLKPSNEGNESILKTLWHHSDAVMCCSLKALPVFTFANQAGLDMLETTLVALQDITLEKTFDDNGRKTLCSEFPQIMQQGFVCLQGGVCLSSMGRPVSYERAVAWKVLTEEDNAHCICFMFINWSFV

SEQ ID NO: 9911 - protein, 841 aa, Vitis vinifera
MAVSSSCKDAKMALDNGKYVRYTPEQVEALERLYHDCPKPSSLRRQQLIRECPILSNIEPKQIKVWFQNRRCREKQRKEASRLQAVNRKLTAMNKLLMEENDRLQKQVSQLVYENSFFRQQTQNATLATTDTSCESVVTSGQHHLTPQHPPRDASPAGLLSIAEETLTEFLSKATGTAVEWVQMPGMKPGPDSIGIVAISHGCTGVAARACGLVSLEPTRVAEILKDWPSWYRECRNVDVLNVLSTGNGGTIELLYMQLYAPTTLAPARDFWLLRYTSVLEDGSLVVCERSLNNTQNGPSMPPVQYFVRAEKLPSGYLIRPCEGGGSIIHIVDHMDLEPWSVPEVLRPLYESSTLLAQKTTMAALRQLRQISQEVSQPTNTGWGRRPAALRALGQRLTKGFNEAVNGFTDEGWSMMESDGIDDVTLLVNSSPAKMMGVNLSYASGFPSMSNAVLCAKASMLLQNVPPAILLRFLREHRSEWADSSIDAYSAAAVKAGPCTLPVSRAGGYGGQVILPLAHTIEHEEFMEVIKLENVDHYREDLMMSGDVFLLQLCSGVDDNAVGTCSELIFAPIDASFSDDAPLLPSGFRIIPLDSGVDGSSPNRTLDLASSLEVGPAGNKASSDNSGHTGSAKSVMTISFQFAFEMHLQENVASMARQYVRSIISSVQRVALALSPSRFGPQMGFRPLPGTPEAHTLARWICQSYRCYLGVELLKPSNEGNESILKTLWHHSDAVMCCSLKVIALPVFTFANQAGLDMLETTLVALQDITLEKTFDDNGRKTLCSEFPQIMQQGFVCLQGGVCLSSMGRPVSYERAVAWKVLTEEDNAHCICFMFINWSFV

SEQ ID NO: 9912 - protein, 829 aa, Citrus trifoliata
MDNGKYVRYTPEQVEALERLYHECPKPSSMRRQQLIRECPILSNIEPKQIKVWFQDRRCREKQRKEASRLQAVNRKLTAMNKLLMEENDRLQKQVSQLVYENTFFRQQTQNAATLATTDTSCESVATSGQHHLTPQQQHQHPPRDASPAGLLSIAEETLTEFLSKATGTAVEWVQMPGMKPGPDSIGIVAISHGCTGVAARACGLVGLDPTRVAEILKDRPSWYRDCRSVEVVNVLPTGSSGTIELLYMQLYAPTTLAPARDFWLLRYTSVLEDGSLVVCERSLNNTQNGPSMPQAPHFVRAEMLPSGYLIRPCEGGGSIIHIVDHMDLEPWSVPEVLRPLYESSTLIAQKTTMAALRHLRQISQEVSQPSVTGWGRRPAALRALSQRLSRGFNEALNGFTDEGWSMLESDGIDDVTVHVNSSPSKMMGVQLSYVNGFPSMSNAVLCAKASMLLQDVPPAILLRFLREHRSEWADSSIDAYSAAAVKAGPCSLPVPRAGNFGGQVILPLAHTIEHEEFLEVIKLENMAHYREDMIMPSDIFLLQLCSGVDENAVGNCAELVFAPIDASFSDDAPIIPSGFRIIPLDSGKDTPSPNRTLDLASALEVGPTGNKASGDSSTQCGSKKSVITIAFQFAFEMHLQENVASMARQYVRGIIASVQRVALALSPSRFGSNAGLRPPPGSPEAHTLARWICQSYRCYLGAELLKCEGNESILKTLWHHSDAVLCCSLKALPVFTFANQAGLDMLETTLVALQDITLEKIFDESGRKTLCSEFPQIMQQGFMCLQSGICLSSMGRPISYERAVAWKVLNEEENAHCICFMFINWSFV

SEQ ID NO: 9913 - protein, 828 aa, Populus trichocarpa
MDNGKYVRYTPEQVEALERLYHECPKPSSMRRQQLIRECPILSHIEPKQIKVWFQNRRCREKQRKEASRLQAVNRKLTAMNKLLMEENDRLQKQVSQLVYENSYFRQQTQNATNLATTDTSCESVVTSGQHHLTPQHPPRDASPAGLLSIAEETLAQFLSKATGTAVEWVQMPGMKPGPDSIGIVAISHGCTGVAARACGLVGLEPTRVAEILKDRPSWFRDCRAVDVVNALSTGSGGTIELLYMQLYAPTTLAPARDFWLLRYTSVLEDGSLVVCERSLNNTQNGPSMPPTQHFVRAEMLPSGYLIRPCEGGGSIIHVVDHMDLEPWSVPEVLRPLYESSTLLAQKTTMAALRHLRQVSQEVSQPNVTGWGRRPAALRALSQRLSKGFNEAVNGFADEGWSMLESDGIDDVTVLVNSSPAKMMGVNFSYANGFPSMSNAVLCAKASMLLQNVPPAILLRFLREHRSEWADSGIDAYAAAAVKAGPCSLPMSRAGNFGGQVILPLAHTIEHEEASTSFMEVIKLENMGYREDMLMPGDVFLLQLCSGVDENAVGTCAELIFAPIDASFSDDAPIIPSGFRIIPLDSGMDASSPNRTLDLASALEVGPAGNRASGDLSGRSGCTKSVMTIAFQFAFEMHLQENVASMARQYVRSIIASVQRVALALSPSHFGSHAGFRPPPGTPEAHTLARWICESYRCYLGVELLKNEGSESILKTLWHHSDALMCCSLKTLPVFTFANQAGLDMLETTLVALQDITLEKIFDDNGRKTLYSEFPQIMQQGFMCLQGGICLSSMGRPVSYERAVAWKVLNEEESAHCICFMFINWSFV

SEQ ID NO: 9914 - protein, 823 aa, Populus trichocarpa
MDNGKYVRYTPEQVEALERLYHECPKPTSTRRQQLIRECPILSHIEPKQIKVWFQNRRCREKQRKEASRLQAVNRKLTAMNKLLMEENDRLQKQVSQLVYENSYFRQQTQNATTLATTDTSCESVVTSGQHRLTPQHPPRDASPAGLLSIAEENLAQFLSKATGTAVEWVQMPGMKPGPDSIGIVAISHGCTGVAARACGLVGLEPTRVAEILKDRPSWFRDCRAVDVINAMSTANGGTIELLYMQLYAPTTLAPARDFLLLRYTSVLEDGSLVVCERSLNNTQNGPSMPPTQHFVRAEMLPSGYLIRPCEGGGSIIHIVDHMDLEPWSVPEVLRPLYESSTLLAQKTTMAALRHLRQISQEISQPNVTGWGRRPAALRALSQRLSKGFNEAVNGFADEGWSLLESDGIDDVTVLVNSSPTKTMGVNFSYDNGFPSMNNAVLCAKASMLLQNVPPAILLRFLREHRSEWADNGIDAYAASAIKAGPCSLPVSRAGNFGGQVILPLAHTIENEEAKVIKLENMGYREDMLMPGDVFLLQLCSGVDENAVGTCAELIFAPIDASFSDDAPIIPSGFRIIPLDSGMDASSPNRTLDLASALEVGPAGNRASGDLSGRSGCTKSVMTIAFQFAFEMHLQENVASMARQYVRSIIASVQRVALALSPSHFGSHAGFWPPHGTPEAHTLARWICESYRIYLGVKLLKNEGSDSILKTLWHHSDALVCCSLKTLPVFTFSNQAGLDMLETTLVALQDITLEKIFDDNGRKTLCSEFPQIMQQGFMCLPGGICLSSMGRPVSYERAVAWKVLNEEESAHCICFMFMNWSFV

SEQ ID NO: 9915 - protein, 231 aa, Antirrhinum majus; identical to SEQ ID NO: 9888

SEQ ID NO: 9916 - protein, 838 aa, Glycine max; identical to SEQ ID NO: 9870

SEQ ID NO: 9917 - protein, 853 aa, Glycine max; identical to SEQ ID NO: 9886

SEQ ID NO: 9918 - protein, 823 aa, Medicago truncatula
MALSMHKEMDAGKYVRYTPEQVEALERVYSECPKPSSLRRQQLIRECPILSNIEPKQIKVWFQNRSFLHLLVIVVTKQVSHLVYENGYMKQQIHTVSASAATTTDNSCDSVVMSGQNQQQNPTQRPQRDANNPAGLLAVAEETLAEFLSKATGTAVDWVQMIGMKPGPESIGIVAVSRNSSGIAARACGLVSLEPTKVAEILKDRLSWYRDCRCVDVLSIVPTGGGGTIELMYMQVLFYSTKELTMPFLFLLTSRDFWTLRYTTSLEDGSLVICERSLNASTGGPTGPSPSNFVRAEMLPSGFLIRPCEGGGSIIHIVDHVDLDVWSVPEVLRPLYESSKILAQKLTIAALQHIKQIAQESSGEIQYGGGRQPAVLRTFSQRLCRGFNDAVNGFVDDGWSLLGNDGVEDVTIAVNSSPNKFLGSNYSSMFPTFGGGVLCAKASMLLQNVPPALLVRFLREHRSEWADYGVDAYSATCLKSSPYAVPCPRPGGFPSSQVILPLAPTIEHEEFLEVVRIEGHAFSPEDVALARDMYLLQLCSGIDENSVGACAQLVFAPIDESFADDALLLPSGFRVIPLDPKSDGPTTSRTLDLLEGSRNARPSGEGAGSNGYNLRSVLTIAFQFTFENHLRDNVASMARQYVRSVVASVQRVAMAIAPSRPGTQLGPKSLPGSPEAHALARWISRSYRMHTGAELFRVESAASDAILKQLWHHSDAIMCCSVKTNASPIFTFSNQAGLDMLETTLVALQDIMLDKVLDEAGRKILCSEFSKIMQQGYASLPGGICVSSMNRPVSYEQAIAWKVLNDDDANHCLAFMFINWSFV

SEQ ID NO: 9919 - protein, 844 aa, Glycine max; identical to SEQ ID NO: 9906

SEQ ID NO: 9920 - protein, 834 aa, Medicago truncatula; identical to SEQ ID NO: 9905

SEQ ID NO: 9921 - protein, 841 aa, Glycine max; identical to SEQ ID NO: 9871

SEQ ID NO: 9922 - protein, 849 aa, Glycine max; identical to SEQ ID NO: 9885

SEQ ID NO: 9923 - protein, 845 aa, Vitis vinifera; identical to SEQ ID NO: 9878

SEQ ID NO: 9924 - protein, 843 aa, Glycine max; identical to SEQ ID NO: 9877

SEQ ID NO: 9925 - protein, 845 aa, Glycine max; identical to SEQ ID NO: 9893

SEQ ID NO: 9926 - protein, 844 aa, Vitis vinifera; identical to SEQ ID NO: 9889

SEQ ID NO: 9927 - protein, 835 aa, Zinnia violacea
MNDNNSITKHQLDNGKYVRYTTEQVEALERVYAECPKPSSLRRQQLIRECPILSNIEPKQIKVWFQNRRCREKQRKESSRLQTVNKKLSAMNKLLMEENDRLQKQVSQLVCENGYMRQQMHTGSAATDASCESVVNTPQHSLRDATNPAGLLSIAEETLAEFLSKATGTAVDWVQMPGMKPGPDSVGIFAISQSCSGVAARACGLVSLEPTKIVEILKDRPSWFRDCRSLEVFTMFPAGNGGTIELVYMQTFAPTTLAPARDFWTLRYTTSLDNGSLVVCERSLSGSGAGPNPAAVAQFVRGEMLPSGYLIRPCEGGGSVIHIVDHLNLEAWSVPEVLRPLYESSKVVAQKMTIAALRYIRQIAQESSGEVVYGLGRQPAVLRTLSQRLSRGFNDAINGFSDDGWSLMNCDGVEDVIIAVNSTKNLNNSMNPSNSISYLGGILCAKASMLFQDVPPAVLVRFLREHRSEWADFNVDAYSAASVKANSCNTYPGMRPTRFTGSQIIMPLGHTIEHEEMLEVVRLEGHALGQEDPFTSRDIHLLQLCNGIDENAVGACSELVFAPIDEMFPDDAPLVPSGFRIIPLDPKSGGGKNALVTTHRTLDLTSSLDVTPANNHGSTDLSTCQTSRSVLTIAFQFPFENNLAESVATMARQYVRSVINSVQRVAMAISPSGLSPCVGPKPSPTSPEAVTLAQWICQSYTYHLGADLLSSGSLVGDSLLKDLWQHQDAILCCSLKSLPVFTFANQAGLDMLETTLVSLQDITLDKIFDDSGRKALVPEFAKIMQQGYAHLPGGICMSTMGRHITYEQAVAWKVLAADESTVHCLAFSFVNWSFV

SEQ ID NO: 9928 - protein, 844 aa, Glycine max; identical to SEQ ID NO: 9895

SEQ ID NO: 9929 - protein, 750 aa, Glycine max
MGINICLSLCFFYITTLHRTISTLAQSENYIIHMDISAMPKAYSSHHTWYLSTLSSALENSKATTDNLNSKLIYIYTNVINGFSANLSPKELEALKTSPGYVSSMRDLRAKRDTTHSPQFLGLNKNVGAWPASQFGKDIIVGLVDTGISPESKSYNDEGLTKIPSRWKGQCESSIKCNNKLIGARFFIKGFLAKHPNTTNNVSSTRDTDGHGTHTSSTAAGSVVEGASYYGYASGSATGIASRARVAMYKALWDEGDYASDIIAAIDSAISDGVDVLSLSFGFDDVPLYEDPVAIATFSAMEKGIFVSTSAGNEGPFLGRLHNGIPWVITVAAGTLDREFHGTLTLGNGVQITGMSLYHGNFSSSNVPIVFMGLCDNVKELAKVKSKIVVCEDKNGTIIDVQAAKLIDANVVAAVLISNSSYSSFFLDNSFASIIVSPINGETVKAYIKSTNYGTKGTLSFKKTVLGSRPAPSVDDYSSRGPSSSVPFVLKPDITAPGTSILAAWPQNVPVEVFGSQNIFSNFNLLSGTSMACPHVAGVAALLRGAHPDWSVAAIRSAIMTTSDMFDNTMGLIKDVGDDYKPATPLAMGAGHVNPNRALDPGLVYDVGVQDYVNLLCALGYTQKNITVITGTSSNDCSKPSLDLNYPSFIAFFKSNSSSTTQEFERTVTNVGEGQTIYVASVTPVKGYHVSVIPKKLVFKEKNEKQSYKLRIEGPIKKKEKNVAFGYLTWTDLKHVIRSPIVVSTLTFDF

SEQ ID NO: 9930 - protein, 752 aa, Glycine max
MATHICLSLCFFYITTYHLAISTLAQSDNYIIHMDISAMPKAFSSQHTWYLSTLSSALDNSKATSDNLNSVINSKLIYTYTNVINGFSANLSPKELEALKTSPGYVSSMRDLRAKRDTTHSPHFLGLNPNVGAWPVSQFGKDVIVGFVDTGISPESESFNDEGLTKIPSRWKGQCESTIKCNNKLIGAKFFNKGLLAKHPNTTNNVSSTRDTEGHGTHTSSTAAGSVVEGASYFGYASGSATGVASRARVAMYKALWEQGDYASDIIAAIDSAISDGVDVLSLSFGFDDVPLYEDPVAIATFAAMERGIFVSTSAGNEGPFLAVLHNGIPWVITVAAGTLDREFQGTLTLGNGVQVTGMSLYHGNFSSSNVPIVFMGLCNKMKELAKAKNKIVVCEDKNGTIIDAQVAKLYDVVAAVFISNSSESSFFFENSFASIIVSPINGETVKGYIKSTNSGAKGTMSFKRTVLGTRPAPSVDDYSSRGPSSSCPFVLKPDITAPGTSILAAWPQNVPVEVFGSHNIFSNFNLLSGTSMACPHVAGVAALLRGAHPEWSVAAIRSAIMTTSDMFDNTMGLIKDIGDGYKQASPLALGAGHVNPNRGLDPGLVYDVRVQDYVNLLCALGYTQKNITIITGTSSNDCSKPSLDLNYPSFIAFINSNGSSAAQEFQRTVTNVGEGKTIYDASVTPVKGYHLSVIPKKLVFKEKNEKLSYKLTIEGPTKKKVENVAFGYLTWTDVKHVVRSPIVVTTLKLDF

SEQ ID NO: 9931 - protein, 753 aa, Glycine max
MATHICLSLCFLYITTLNLVSTLAQSDNYIIHMDISAMPKTFSTQHSWYLSTLSSALDNSKATNNLNSVSSSKLIYTYTNAINGFSANLSPKELESLKTSPGYVSYMRDLPAKRDTTHSPQFLGLNPNEGAWPVSEFGKDVIVGLVDTGIWPESKSFNDKGMTEIPSRWKGQCESTIKCNKKLIGAQFFNKGMLANSPNITIAANSTRDTEGHGTHTSSTAAGSVVEGASYFGYASGSATGIASGARVAMYKALGEEGDLASDIIAAIDSAILDGVDVLSLSFGFDYVPLYEDPVAIATFAAMEKGIFVSTSAGNEGPYLGRLHNGIPWVITVAAGTLDREFHGTLTLGNGVQVTGMSLYHGNFSSSNVPIVFMGLCDNVKELAKVRRNIVVCEDKDGTFIEAQVSNVFNANVVAAVFISNSSDSIFFYDNSFASIFVTPINGEIVKAYIKITNSGANGTLSFKTTALGTRPAPSVDSYSSRGPSSSAPFVLKPDITAPGTSILAAWPPNVPVDVFIAPKNVFTDFNLLSGTSMACPHVAGVAALLRGAHPEWSVAAIRSAIMTTSDMFDNTMGLIKDIGDDYKPATPLAMGAGHVNPNRALDPGLVYDVGVQDYVNLLCALGYTQKNITVITGNSSNDCSKPSLDLNYPSFIAFFNSNSSSASQEFQRTVTNVGEGQTIYVASVTPVKGYYVSVIPNKLVFKEKNEKLSYKLRIEGPTNKKVENVAFGYFTWTDVKHVVRSPIVVTTLKVNF

SEQ ID NO: 9932 - protein, 192 aa, Glycine max
MAMRNMIVITVTTTMVTVMISIVGGSASWCVAKIGASEEALQTALDSACEAGGGADCAPIQPDGLCYVPNTLQAHASYAFNSFYQRNTRAPHACLFHGASTIAQTDPSYGSCVYPSSATPSTAGVTNTNTTVTTPAAMPNVAAPTTTTPIHGGDGVGMNPLIPENSTSAPNSNTILTTTSFLVFLLIMSLIP

SEQ ID NO: 9933 - protein, 335 aa, Glycine max
MACTDKTATVTDEASGGGATTIFAVHPDIIQTHILTCLDGRALASVASTCSQLHALSDHEPLWENICHSTWPSTNSPRVRHVISTFPCASRSFFSDSFPSFAAREGSNIDRAPELISAVDIFHRRRVVLSRVVETETESGWFRCSPFRIDVLDQKEAVATAMEYPLSDGACEILGEDLRLSWIVVNPKGKRAVNVSSGTAVSVERHWLSGEVKVRFATVVDGGERGTPAEVALCSVTVTFGNEMQVREACLQMEDMDGMFLNGRESLGILKRALEGKRGTLLKDGKEEGRSRYLEFMNRKMERKEKKQRDERRLDMLCLALAVLSFAAFSTLFLF

SEQ ID NO: 9934 - protein, 335 aa, Glycine max
MACIDNTATTSTDEAGGATTITAVHPDIIQTHILTCLDGPSLASVASTCSQLHALSAREPLWENICHSTWPSTSSPRVRHVMSTFPRASLSFFSDSFPSFAAAREGSSSRAPELISAVDIFHRRRAVLSRVVETETESDWFRCSPFRIDVLDQKEAVATAMEYPRSEEACEILGEDLRLSWIVVDPNGKRAVNVSSGRVVSVERHWLSGEVKARFATVVGGGERGTAVEVALCSVTVTFGGEMQVREACLQMEDMDGMFLNGRDSLGILQRALEGIRGTLLKDGKEEEGRNRYLEFIKRKMERKDKKERDERRLDMLCVPLALLSFAAFSTLFLF

SEQ ID NO: 9935 - protein, 191 aa, Glycine max
MESNTPVIAKKELSIIHVALFMLRKGISKGKLMMHLNNMMLKRPGKAIANLMFHHNHGVSGNSLHFSAAREYEFSCSNTPNNFFAAIASSNKRHRHIPFFTCAHAPPTLDDDVATVNAVKGVLEMLNNETVVEASPAALPGFGRSPMVRQLIRVTDSPFPLVESQDDKDNQVDKAAEEFIKRFYKELRKQT

SEQ ID NO: 9936 - protein, 197 aa, Glycine max
MESNTPVIAKKVLSIIRVAFFMLRKGISKGKLMMHLNNMMLKRPGKAIANLMFHHHHNHGVSGNNLQFSTAREYEFSCSNTPNNFFAAALASNNKRHRHNPFFTCAHAPPTLDDDAVTVNAVKGVLEMLNNEAFEEASPAVATALSGFGRSPMVRKLIRVTDSPFPLGESEDDKDNQVDKAAEEFIKRFYKELRKQT

SEQ ID NO: 9937 - protein, 191 aa, Glycine max
MESNAPVLAEKVWSMVRVLLFMLRKGISKGKLMMDLNMMLKRRGKLAGKAIANLMSHNHNHRGSHKSQLRFSAPREYEFSCSNTPHNLFPTAGKRHRHFFACVHAPPTQDDDVVTVNAMKAVLEMLNNNDVVKVEASPALPGFGRSPIVRQLRVTDSPFPLRDSDHDNDHQVDKAAEEFIKRFYKDLKKQD

SEQ ID NO: 9938 - protein, 203 aa, Glycine max
MKQIEMESNASALAKKVWSMVRVVLFMLRKGITKGKLMMDLNMMLKRRGKLAGKAIANLMSSHHHHNRGGSHNSHHLKFSAPREYEFSCSNTPHNFFFPTGGKHHRHHFFACVHAPPTQDDDVVTVNAMKAVMEMLNNNNNDAVKVEASPALPGFGRSPMVRQLRVTDSPFPLRDADQDNDHLVDKAAEDFIKRFYKELRKQD

SEQ ID NO: 9939 - protein, 195 aa, Medicago truncatula
MENNLPVISKKVWSMVRVAFFMLRKGMSKGKLMMGLNMMLKRRSKLAGKAIANLMFHHHHNHGGSTSSRRSHHQFTASREYEFSCSNTPNHFFPIGKRHRSHNNFSTSAQAPPTQDDDVATMSAMKAVLEMLSNDQSIVEASPALPGFGRSPMVRQLRVTDSPFPLREDDEKDDQVDKAAEDFINRFYSQLRNQA

SEQ ID NO: 9940 - protein, 200 aa, Medicago truncatula
MENNLPVISKRVWSMVRVAFFMLRKGISKGKLMMGLNMMLKRRSKLAGKAIANLMFHHHSHHSSSSSRSHDSRHQFTASREYEFSCSNTPHHFFPIGKRHRSNNHNHNNFFTCAHTPPTQDDDVATMSAMKAVLEMLNNDQAIVEASPALPGFGRSPMVRQLRVTDSPFPLREDDEKDNQVDKAAEDFINRFYSQLRKQD

SEQ ID NO: 9941 - protein, 862 aa, Glycine max
MCAPFNILVLLLSLLLTSSSCSSSFSQPRRVLHQPLFPRISVPPAQAPSYLSPEPQPKQQHLQPKLPFSSISSSSPPPPQKSFFPSYHSPPLPPSPAVLATFPANISSLLLPRPISRHHRSAAALAVSLSLCSIALLAAAAAFLLHHRRRTHSSSDVNDDDDDKASRSDSLRLFPPNTAASDGAERKPRGKTSPTSELLYLGTVANSVTTTTTSTTTTATTDSSSSHHESFRPPYQKLGDSPELNPLPPLPRHKFKPWTTEEENNDKDIIEKENEEEEEEEQFFSPSGSSGGKINKQQKSSPSPSGVVASSSRVFHVDKFGSRSFTSRTPSYPRSNSLSFSRSPSLNFSPPSVKSLPPNNNPASPSFSSSSSSPREEWHVPSQRKNSPAATDLPTPPPPPPPPPPQFWEAPVDKSVTFRNESEETPKPKLKALHWDKVKASSDRVMVWDRLGPSSFQLNEDMIETLFMVNNNNNNSKEGFVHSASPMPLENRVLDPKKSQNIAILLRALNVTIDEVCDALREGNCDTLGTELLESLLKMAPTKDEESKLKEFQDESPFKLGPAEKFLKVVLDIPFAFKRVDAMLYIANFDSELEYLKKSFETLEVACEELRKSRMFLKILEAVLRTGNRMNVGTNRGDAHAFKLDTLLKLVDIKGTDGKTTLLHFVVWEIVRTEGSHISGSNNNHAADNDHQYTLQDEVDFKKLGLQVVSGLSGELTNVKKTAAMDSDMLSSDVAKLARGIEKIVQVVKLNEESPLKETNQKFSDAMKCFLERGEQEISTIQGQEKNALSSVKEITEYFHGNSAKEEAHPFRIFMVVRDFLSILDGVCKEIGKVNERTLVGSRQSVMPANPIMQTFFPEIIG

SEQ ID NO: 9942 - protein, 880 aa, Glycine max
MCATFNILVLLLSLLLTSSSSFLQPRRVLHQPLFPTISVPPAEAPSYLPPEPQPKQQHQPKIPFSSISSSSPPPPQKPFFPSYHSPPLPPSPAVVATFPANISSLLLPHPVSRHHRSAAALAVSLSLCSLALLAAVVAFLLHHHRRTHSSSDDNDDDKASRSDSLRLFPPNTDASDGADRKPHDKASPTSELLYLGTVANSVITTTTTTTTTTIDSSSSHHEIFRPAYQKFGDSPELNPLPPLPRHKFKPWTTEEQNNDKDVTEKEKEEEEEEEFFSPTGSSGGNINKQQQSPPSPSALASASSSRVFHVDKFGSRSFTSRTPSHPRSNSLSFSRSPSLNFSPASVKSLPPNTNLASPSFSSSSSSPREEWNVPSHGKNSPATTTLPTPPPPPPPPPPPPQFWETPVDKSVTFRNESEETPKPKLKALHWDKVKASSDRVMVWDRLRPSSFQLNEDMIETLFMVNNHNNFKEGFGVAIRDNNNPRRQMVHSASPMPLENRVLDPKKSQNIAILLRALNVTIDEVCDALREGNCDTLGTELLESLLKMAPTKDEESKLKEFQDESSFKLGPAEKFLKAVLDIPFAFKRVDAMLYIANFDSELEYLKKSFETLEVACEELRSSRMFLKILEAVLRTGNRMNVGTNRGDAHAFKLDTLLKLVDIKGTDGKTTLLHFVVQEIVRTEGSHISGSNHPHASDNGHQYTLQDEVDFKKLGLQVVSGLSGELTNVKKAAAMDSDVLSSDVAKLSRGIEKVVQVVKLNEELPLKETNKKFSDAMKGFLERGEQELSTIQAQEKNALSSVKEITQYFHGNSAKEEAHPFRIFMVVRDFLSILDGVCKEVGKVNERTLVGSRQSVMPANSIMQTFFPEIIGKQPSDSSESD

SEQ ID NO: 9943 - protein, 529 aa, Glycine max
MEAVCAFSVGTLHIPTAHETSNSFRKSIFLSNQVASPVSLVFLRGSSKSKLLTALSPPPLTESSNQPEAEPEFESHAEKFDWYSQWYPLMPICDLDKRKPHGKRVLGIDVVVWWDRNEGAWQVHDDACPHRLAPLSDGRIDQWGRLQCVYHGWCFNGKGECQLIPQALPDGPPVHTSKKACVAAYPSTVQNDILWFWPNTDPQYKDIITRKRPPFIPEIDDPSYTKSMGNRDIPYGYEVLIENLMDPAHVPYAHYGLMRTPQPKVKADREGGRPLDMSIEKLDINGFSANQAWGKSKFMPPCIFYAYTPDQPASSGETKKSSAKKKMCLIFVCVPVSPGKSRLIWCFPRNFGLWMDKIVPRWIFHVGQNLILDSDLYLLHVEEHKLKDIGPNNWHKACFVPTKSDALVIGYRTWLRKYAGGQVDWRGKYSGALPPTPPREQLLDRYWSHVVNCKSCNSAYKSLNAVEVMLQIISVASIGIVAVMKHGTMSVAKRNSMVALAVLSFALSRWLAHFIYKNFRYHDYEHAFR

SEQ ID NO: 9944 - protein, 531 aa, Glycine max
MEAVYAFSVGTLHIPTAHETPNSFRKSIFLSNQVASPVSLVLRGASKSKLFTALSPPPLTESSNNQPEEAEPEFESHAEKFDWYSHWYPLMPICDLDKRKPHGKRVLGIDVVVWWDRNEGVWQVHDDACPHRLAPLSDGRIDQWGRLQCVYHGWCFNGKGECKLIPQAPPDGPPVHTSKKACVAAYPSTVQNDILWFWPNTDPQYKDIITRKRPPYIPELDDPSYTKLMGNRDISYGYEVLIENLMDPAHVPYAHYGLMRTPKPKVKVDREGGRPLELSIETLDINGFTANQGWSKSKFMPPCIFYVYTDSDQPASSAETQKSSAQKKFALIFVCVPVSPGKSRLIWCFPRNFGVWIDKIVPRWIFHVGQNRILDSDLYLLHVEEQKIVDIGPKNWHKACFVPTKSDALVIGYRNWLKKYAGGQVDWRGKYSGALPPTPPREQLMDRYWSHVVNCKSCNSAYKSLNVIEVMLQIISVASIGIVAIMKHGTMSVAKRNSMVALAVLSLALSRWLAHFIYKNFRYHDYEHAFR

SEQ ID NO: 9945 - protein, 529 aa, Medicago truncatula
MEAFSVSSLHIPIALEPQIPLKKSMFFNSQVHSTLPLIRGNASKFKLFTALSPSPLTESSSSNLEVDDEPEVETGSEKFDWYSQWYPLMPICDLDKRAPHAKKVMGIDVVIWWDRNESAWQVFDDACPHRLAPLSEGRIDQWGRLQCVYHGWCFNGSGDCKFIPQAPPEGPPIHTSKKACVAAYPSTVQNDILWFWPNSDPQYKDIITRKTPPFIPEIDDPSFTSLMGNRDIAYGYEVLIENLMDPSHVPYAHYGLMKTPQPKVKADREGGRPLELSIEELDVNGFTANQGWSKSKFMPPSIFYAYTDPNKPASSEETKKSSVQKKFALIFICIPVSPGNSRLIWCFPRNFGLWIDKIVPRWIFHVGQNLILDSDLYLLHVEEKKIMDVGQANWHKACFVPTKADALVIGFRKWLKKYAGGEVEWRGKYNGALPPTPPREQLLDRYWSHTVNCKSCNFAYKSLNVVEVMLQIISVASIGIVATMKQGVVSATTRNSMVLLAVLSFALSRLLAHFIYKNFRYHDYNHAFR

SEQ ID NO: 9946 - protein, 532 aa, Medicago truncatula
MFLKSQIHSTLPLIRGNTSKFKLFTALSPSPLTESSSSNLEVDDEPEVETGSEKFDWYSQWYPLMPICDLDKRAPHAKKVMGIDVVIWWDRNESAWQVFDDACPHRLAPLSEGRIDQWGRLQCVYHGWCFNGSGDCKFIPQAPPEGPPIHTSKKACVAAYPSTVQNDILWFWPNTDPQYKDIITRKTPPFIPEIDDPSFTSFMGNRDIPYGYEVLVENLMDPSHVPYAHYGLTPDPKGNNADREGGTPLDFSVEELDINGFTANQGWNKSKFMPPSIFYLYSEPDKLASSVETKKSSVQKKFSMIFICIPVSPGKSRLIWCFPRNFGVWADKIVPRWILHMGQNLILDSDLYLLHVEEQKIMDVGQGNWHKACFVPTKADALVIGFRKWLKKYAGDQVDWRGKYSGALPPTPPREQLMDRYWSHTVNCKSCNFAYKSLNVVEVMLQIISVASIGFVATMKQGIVSAATRNSIVVLAILSFALSRLLAHFIYKNFRYHDYNHVRSSMKCVSLIIFLQAGYVYTPSGPKFIIDI

SEQ ID NO: 9947 - protein, 546 aa, Medicago truncatula
MFLKSQIHSTLPLIRGNTSKFKLFTALSPSPLTESSSSNLEVDDEPEVETGSEKFDWYSQWYPLMPICDLDKRAPHAKKVMGIDVVIWWDRNESAWQVFDDACPHRLAPLSEGRIDQWGRLQCVYHGWCFNGSGDCKFIPQAPPEGPPIHTSKKACVAAYPSTVQNDILWFWPNTDPQYKDIITRKTPPFIPEIDDPSFTSFMGNRDIPYGYDFNFENITLCIPLTVTYMYEVLVENLMDPSHVPYAHYGLMKTPQPKVKADREGGRPLELSIEELDVNGFTENQGWSKSKFMPPSIFYAYTDLIKPVSSEETKKSSVQKKFALIFFCIPVSPGNSRLIWCFPRNFGLWIDKIVPRWIFHIGQNLIIDSDLYLLHVEEKKILDVGQANWHKACFVPTKADALVIGFRKWLKKYAGDQVEWRGKYNGALPPTPSREQLMDRYWSHVVNCKSCNLAYKSLSVVEVMLQIISVASIGIVATMKQGLVSTTTRNSMVVLAVLSFALWRLLAHFIYKNFCYHDYNHASSNCFPPYPILIVDEDFNSFVSKK

SEQ ID NO: 9948 - protein, 325 aa, Vitis vinifera
MAEEKCFIAKDVTELIGKTPLVYLNNVVDGCVARIAAKLEMMEPCSSVKDRIGYSMITDAEEKGLITPGESVLIEPTSGNTGIGLAFMAAAKGYKLIITMPASMSLERRIILRAFGAELVLTDPAKGMKGAVQKAEEILAKTPNSYILQQFENPANPKIHYETTGPEIWRGTGGKVDAFVSGIGTGGTITGAGKFLKEQNSDIKLYGVEPVESAVLSGGKPGPHKIQGIGAGFIPGVLDVNLLDEVVQVSSEEAIETAKLLALKEGLLVGISSGGAAAAAIKLAKRPENAGKLIVVVFPSFGERYLSSVLFDSVKREAENMLFEP

SEQ ID NO: 9949 - protein, 325 aa, Ricinus communis
MVEEKSAIAKDVTELVGKTPLVYLNHVVDGCVARIAAKLEMMEPCSSVKDRIGYSMITDAEEKGLIKPGESVLIEPTSGNTGIGLAFMAAAKGYKLIITMPASMSLERRMVLRAFGAELVLTDPARGMKGAVQKAEEILAKTPNSYILQQFENPANPKIHYETTGPEIWKGSGGKVDFFVSGIGTGGTVTGAGGYLREQNPDIKLIGVEPVESAVLSGGKPGPHKIQGIGAGFIPGVLDVSLLDEVVQISSEEAIETAKLLALKEGLLVGISSGAAAAAAIKIARRPENAGKLIVVIFPSFGERYLSSVLFESVKREAESMVFEP

SEQ ID NO: 9950 - protein, 325 aa, Glycine max
MAAEKSNIAKDVTELIGKTPLVYLNHIVDGCVAKVAAKLEMMEPCSSVKDRIGYSMIVDAEEKGLITPGESVLIEPTSGNTGIGLAFMAAAKGYKLIITMPSSMSLERRTILRAFGAELVLTDPAKGMKGAVQKAEEIRDKTPNSYMLQQFENPANPKVHYETTGPEIWKGSSGKVDALVSGIGTGGTVTGAGKYLKEQNPDIKLYGIEPVESPILSGGKPGPHKIQGIGAGFIPGVLDVDLLDEVVQISSEEAIETAKLLALKEGLLVGISSGAAAAAAVKIAKRPENAGKLIVAVFPSFGERYLSSVLFESVKREAESLVFEP

SEQ ID NO: 9951 - protein, 325 aa, Populus trichocarpa
MAEEKGSIAKDITELIGKTPLVYLNNVVDGCVARIAAKLEMMEPCSSVKDRIGYSMITDAEEKGLIKAGESVLIEPTSGNTGIGLAFMAAAKGYRLIITMPASMSLERRMVLLAFGAELVLTDPARGMKGAVQKAEEISAKTPNSYILQQFENPANPKVHYETTGPEIWKGSGGKVDAFVSGIGTGGTITGAGKYLKEQNPDIKLYGVEPVESAVLSGGKPGPHKIQGIGAGFIPGVLNVDLLDETVQISSEEAIETAKLLALKEGLLVGISSGAAAAAAIKIAKRPENAGKLIVAIFPSFGERYLSSVLFESVKKEAENMVFEP

SEQ ID NO: 9952 - protein, 325 aa, Populus trichocarpa
MAEEKGSIAKDVTELIGKTPLVYLNNVVDGCVARIAAKLEMMEPCSSVKDRIGYSMIKDAEEKGLIKPGESVLIEPTSGNTGIGLAFMAAAKGYRLIITMPASMSLERRMVLLAFGAELILTDPARGMKGAVQKAEEILAKTPNAYLLQQFENPANPKIHYETTGPEMWKGSGGKVDAFVSGIGTGGTITGAAKYLKEQNPDIKIYGVEPVESAVLSGGKPGPHKIQGIGAGFIPAVLDVGLLDETVQISSEEAIETAKLLALKEGLLVGISSGAAAAAAIEIAKRPENAGKLIIVIFPSFGERYLSTVLFESVRKEAENMVFVP

SEQ ID NO: 9953 - protein, 325 aa, Populus trichocarpa
MAEEKGSIAKDVTELIGKTPLVYLNNVVDGCVARVAAKLEMMEPCSSVKDRIGYSMITDAEEKGLIKPGESVLIEPTSGNTGIGLAFMAAAKGYRLIITMPASMSLERRMVLLAFGAELILTDPARGINGAVQKAEEILAKTPNAYILQQFENPANPKVHYETTGPEMWKGSGGKVDAFVSGIGTGGTITGAAKYLKEQNPDIKIYGVEPVESAVLSGGKPGPHKIQGIGAGFIPGVLDVGLLDETVQISSEEAIETAKLLALKEGLLVGISSGAAAAAAIEIAKRPENAGKLIVVIFPSFGERYLSTVLFESVRKEAENMVFVP

SEQ ID NO: 9954 - protein, 325 aa, Glycine max
MAAEKSNIAKDVTELIGKTPLVYLNHIVDGCVAKVAAKLEMMEPCSSVKDRIGHSMIVDAEEKGLITPGESVLIEPTSGNTGIGLAFMAAAKGYKLIITMPSSMSLERRTILRAFGAELVLTDPAKGMKGAVQKAEEIRDKTPNSYMLQQFENPTNPKVHYETTGPEIWKGSSGKVDALVSGIGTGGTVTGAGKYLKEQNPDIKLYGIEPVESPILSGGKPGPHKIQGIGAGFIPGVLDVDLLDEVVQISSEEAIETAKLLALKEGLLVGISSGAAAAAAVKIAKRPENAGKLVVAVFPSFGERYLSSVLFESVKREAESLVFEP

SEQ ID NO: 9955 - protein, 325 aa, Cucumis melo subsp. melo
MVDTKSTIAKDVTELIGNTPLVYLNRVVDGCVARVAAKLEMMEPCSSVKDRIGYSMISDAEKNGLISPGESVLIEPTSGNTGIGLAFIAAAKGYKLIICMPASMSLERRTILRAFGAELVLTDPARGMKGAVQKAEEIKAKTPNSYILQQFENPANPKIHYETTGPEIWKGSGGKVDALVSGIGTGGTVTGAGKYLKEQNPSIKLYGVEPVESAILSGGKPGPHKIQGIGAGFIPGVLDVNLLDEVVQVSSEESIEMAKLLALKEGLLVGISSGAAAAAAIKLAKRPENAGKLIVAVFPSFGERYLSTVLFESVKRETENMTFEP

SEQ ID NO: 9956 - protein, 325 aa, Citrullus lanatus subsp. vulgaris
MADAKSTIAKDVTELIGNTPLVYLNRVVDGCVARVAAKLEMMEPCSSVKDRIGYSMISDAENKGLITPGESVLIEPTSGNTGIGLAFIAAAKGYRLIICMPASMSLERRTILRAFGAELVLTDPARGMKGAVQKAEEIKAKTPNSYILQQFENPANPKIHYETTGPEIWRGSGGKIDALVSGIGTGGTVTGAGKYLKEQNPNIKLYGVEPVESAILSGGKPGPHKIQGIGAGFIPGVLDVNLLDEVIQVSSEESIETAKLLALKEGLLVGISSGAAAAAAIRIAKRPENAGKLIVAVFPSFGERYLSTVLFESVKRETENMVFEP

SEQ ID NO: 9957 - protein, 325 aa, Populus trichocarpa
MAVEKYEIAKDVTELIGKTPLVYLNNVLDGCVARIAAKLEGMEPCSSVKDRIGYSMIADAEAKGLITPGESVLIEPTSGNTGIGLAFMAAAKGYKLIITMPASMSNERRIILRAFGAELVLTNPAKGMKGAVQKAEEIKAKTPNAYILQQFENPSNPKVHYETTGPEIWKGSGGKVDALVSGIGTGGTITGAGKYLKEQNPNIKLYGVEPVESPILSGGKPGPHKIQGIGAGFVPGVLDVKIVDEVVQISSDEAIETAKLLALKEGLLVGISSGAAAAAAVKIAKRPENAGKLIVVVFPSFGERYLSSVLFDSVKREAESMKFEP

SEQ ID NO: 9958 - protein, 204 aa, Medicago truncatula
MSIFEYNGSALVAMVGKNCFAIASDRRLGVQLQTIATDFQRISKIHDKLFIGLSGLATDSQTLYQRLVFRHKLYQLREERDMKPETFASLVSSMQYEKRFGPYFCQPVIAGLGDDDKPFICTMDAIGAKELAKDFVVAGTASESLYGACESMFKPDMEAEELFETISQALLSSVDRDCLSGWGGHVYVVTPTEVKERILKGRMD

SEQ ID NO: 9959 - protein, 204 aa, Medicago truncatula
MSIFEYNGSALVAMVGKNCFAIASDRRLGVQLQTIATDFQRISKIHDKLFIGLSGLATDSQTLYQRLVFRHKLYQLREECDMKPETFASLVSSMQYEKRFGPYFCQPVIAGLGDDDKPFICTMDAIGAKELAKDFVVAGTASESLYGACESMFKPDMEAEELFETISQALLSSVDRDCLSGWGGHVYVVTPTEVKERILKGRMD

SEQ ID NO: 9960 - protein, 204 aa, Medicago truncatula
MTIFKHNGSAVVAMVGKNCFAIASDRRLGVQLQTIATDFQRISKIHDKLYIGLSGLATDSQTLYQRLVFRHKLYQLREELDMKPETFASLVSAMQYEKRFGPYFCQPVIAGLGDDDKPFICTMDAIGAKELAKDFVVAGTASESLYGACESMFKPDMEAEELFETISQALLSSVDRDCLSGWGGHVYVVTPTEVKERILKGRMD

SEQ ID NO: 9961 - protein, 204 aa, Glycine max
MSIFEYNGSALVAMVGKNCFAIASDRRLGVQLQTIATDFQRISKIHDKLFIGLSGLATDAQTLYQRLLFRHKLYQLREERDMKPQTFASLVSAILYEKRFGPYFCQPVIAGLGDDDKPFICTMDAIGAKELAKDFVVAGTASESLYGACESMFKPDMEPEELFETISQALLSSVDRDCLSGWGGHVYVVTPTEVKERILKGRMD

SEQ ID NO: 9962 - protein, 204 aa, Arabidopsis thaliana
MSIFEYNGSAVVAMVGKNCFAIASDRRLGVQLQTIATDFQRISKIHDRVFIGLSGLATDVQTLYQRLVFRHKLYQLREERDMKPETFASLVSAILYEKRFGPYLCQPVIAGLGDDDKPFICTMDSIGAKELAKDFVVSGTASESLYGACEAMYKPDMEAEELFETISQALLSSVDRDCLSGWGGHVYIVTPTEIKERILKGRMD

SEQ ID NO: 9963 - protein, 204 aa, Glycine max
MSIFEYNGSAVVAMVGKNCFAIASDRRLGVQLQTIATDFQRISKIHDKLFIALSGLATDAQTLYQRLVFRHKLYQLREERDMKPETFASLVSALLYEKRFGPYFCQPVIAGLGDEDKPFICTMDCLGAKELAKDFVVSGTASESLYGACEAMFKPDMEPEELFETISQALLSSVDRDCLSGWGGHVYVVTPTEVKERILKGRMD

SEQ ID NO: 9964 - protein, 204 aa, Arabidopsis lyrata subsp. lyrata
MQIFEYNGSAVVAMVGKNCFAIASDRRLGVQLQTIATDFQRISKIHDRVFIGLSGLATDVQTLYQRLVFRHKLYQLREERDMKPETFASLVSAILYEKRFGPYLCQPVIAGLGDDDKPFICTMDSIGAKELAKDFVVSGTASESLYGACEAMYKPDMEAEELFETISQALLSSVDRDCLSGWGGHVYIVTPTEIKERILKGRMD

SEQ ID NO: 9965 - protein, 204 aa, Arabidopsis thaliana
MSIFEYNGSAVVAMVGKNCFAIASDRRLGVQLQTIATDFQRISKIHDHLFIGLSGLATDVQTLYQRLVFRHKLYQLREERDMKPETFASLVSAILYEKRFGPFLCQPVIAGLGDDNKPFICTMDSIGAKELAKDFVVSGTASESLYGACEAMFKPDMEAEELFETISQALLSSVDRDCLSGWGGHVYVVTPKEVKERILKGRMD

SEQ ID NO: 9966 - protein, 204 aa, Arabidopsis lyrata subsp. lyrata
MSIFEYNGSAVVAMVGKNCFAIASDRRLGVQLQTIATDFQRISKIHDHLFIGLSGLATDVQTLYQRLVFRHKLYQLREERDMKPETFASLVSAILYEKRFGPFLCQPVIAGLGDDNKPFICTMDSIGAKELAKDFVVSGTASESLYGACEAMYKPDMEAEELFETISQALLSSVDRDCLSGWGGHVYVVTPNEVKERILKGRMD

SEQ ID NO: 9967 - protein, 204 aa, Arabidopsis thaliana
MSIFEYNVSAVVAMVGKNCFAIASDRRLGVQLQTIATDFQRISKIHDRVFIGLSGLATDVQTLYQRLVFRHKLYQLREERDMKPETFASLVSAILYEKRFGPYLCQPVIAGLGDDDKPFICTMDSIGAKELAKDFVVSGTASESLYGACEAMYKPDMEAEELFETISQALLSSVDRDCLSGWGGHVYIVTPTEIKERILKGRMD

SEQ ID NO: 9968 - protein, 759 aa, Glycine max
MMVQERSLPKSVNSKPHARTAALASTKSLDFSAWVSDNLVRIVAVVLLVATVAAVFFLRNAGDTAALLCFENQARELERIAYPRVDWSAIAPIADRTSKFSSFRSEKWIVVSVSGYPSDALRRLVKMKGWQVVAVGGSNTPSDWTLKGAIFLSLEEQVNLGFRVVDYLPYDSFVRKSVGYLFAIQHGAKKIFDADDRGEVIDGDLGKHFDVELVGEAARQEVLLQYSHDNPNRTVVNPYVHFGQRSVWPRGLPLENVGEIGHEEFYTQVFGGKQFIQQGISNGLPDVDSVFYFTRKSGLEAFDIQFDEHAPKVALPQGMMVPVNSFNTMYHSPAFWALMLPVSVSTMASDVLRGYWGQRLLWEVGGYVVVYPPTVHRYDRIEAYPFSEEKDLHVNVGRLINYLISWRSDKHRLFEKILDLSFAMAEEGFWTEKDVKLTAAWLQDLLAVGYQQPRLMSLELGRPRANIGHGDQKEFVPQKLPSVHLGVEETGTVNYEIANLIWWRKTFGNVVLIMYCNGPVERTALEWRLLYGRIFRSVVILSEKKDVDLVVEEGHLDYAYRYLPKIFDQFSSAEGFLFVQDNTILNYWNLLQADKTKLWITNKVSESWSSILTNGEDSDWLSQQARMVQKVVSTMPAHFQVSYKETSDNDKNLLICSSEVFYVPQRLISDFVELVNLVGDLEIHQKVAIPMFFVSLDSPQNFDPVLDTMIYKQNPPANSTTLYSAKVPAVHPWSVSSEQEFIKLIRIMAEGDPLLMELV

SEQ ID NO: 9969 - protein, 759 aa, Glycine max
MMVQERSLPKSVNPKPHTRTAALASTKSLDFSAWVSDNLVRIVAVLLLVATVAALFFLRNVGDTAALLCFENQARELERIAYPRVDWSAIAPIADKTSKFSSFRSEKWIVVSVSGYPSEALRRLVKMKGWQVVAVGGSNTPSDWTLKGAIFLSLEEQVNLGFRVVDYLPYDSFVRKSVGYLFAIQHGAKKIFDADDRGEVIDDDLGKHFDVELVGEGARQEVLLQYSHDNPNRTVVNPYVHFGQRSVWPRGLPLEKVGEIGHEEFYTQVFGGMQFIQQGISNGLPDVDSVFYFTRKSVLETFDIRFDEHAPKVALPQGMMVPVNSFNTMYHSSAFWALMLPVSVSTMASDVLRGYWGQRLLWEVGGYVVVYPPTVHRYDRIEAYPFSEEKDLHVNVGRLINYLISWRSDKHRLFEKILDLSFAMAEEGFWTEKDVKLTAAWLQDLLAVGYQQPRLMSLELGRPRANIGHGDQKEFVPQKLPSVHLGVEETGTVNYEISNLIRWRKTFGNVVLIMHCNGPVERTALEWRLLYGRIFRSVVILSEKKDVDLVVGEGHLDYAYRYLPKIFDQFSSAEGFLFVQDNTILNYWNLLQADKTKLWITNKVSESWSSILTNGEDSDWLSQQARMVQKVVSMMPAHFQVSYKETSDNDKNLLICSSELFYVPQRLISDFVELVNLVGDLEIHQKVAIPMFFVSLDSPQNFDPVLDRMIYKQNPPANSTTLYSAKVPAVHPLSVSSEQDFIKLIRIMAEGDPLLMELV

SEQ ID NO: 9970 - protein, 762 aa, Vitis vinifera
MLVQDRSTPKSPKTHIRALHSLHPDRFTEPKNLDFSTWFSENLYKIVTISLLIATVAALFFLRNVADTAALVSYETQAKSLEKIEFPQINWNSVALVSDKSPYANFRSERWILVSVSNYPTDSLRKLVKIKGWQVLAIGNSKTPSDWSLKGAIFLSLEQQANLGFRVVDHLPYDSFVRKNVGYLFAIQHGAKKIFDADDRGDVIDNDLGKHFDVELIGEGARQDIILQYSHENPNRTIVNPYIHFGQRSVWPRGLPLENVGEIGHEEFYTEVFGGKQFIQQGISNGLPDVDSVFYFTRKPGLEAFDIRFDEHAPKVALPQGTMVPVNSFNTLYHSSAFWALMLPVSVSTMASDVLRGYWGQRLLWEIGGYVVVYPPTVHRYDRIESYPFSEEKDLHVNVGRLLKFLVSWRSSKHRLFEKILELSYVMAEEGFWTEKDVKFTAAWLQDLLAVGYQQPRLMSLELDRPRASIGHGDRKEFIPQKLPSVHLGVEETGVVNNEIGSLIRWRKNFGNVVLIMFCSGPVERTALEWRLLYGRIFRTVVILAEQKNADLAVEEGRLDFVYKQLLNIFSRFTSAEGFLFLHDNTILNYWNLLQADKSNLWITDKVSKSWSTVSTSGNSDWFSKQADMVKKVVSMMPVHFQVNYKETINSDQLLTVCSSDVFYIPRRFIADFTELVNLVDNLEIHHKVAIPMFFLSMDSPQNFDPVLSRMIYEENPPSTNSSTFYSDKVPAVHPWNVSSEQEFIKLIRIMAAGDLLLLELV

SEQ ID NO: 9971 - protein, 762 aa, Vitis vinifera
  misc_feature (718)..(718): Xaa can be any naturally occurring amino acid
  misc_feature (753)..(753): Xaa can be any naturally occurring amino acid
MLVQDRSTPKSPKTHIRALHSLHPDRFTEPKNLDFSTWFSENLYKIVTISLLIATVAALFFLRNVADTAALVSYETQAKSLEKIEFPQINWNSVALVSDKSPYANFRSERWILVSVSNYPTDSLRKLVKIKGWQVLAIGNSKTPSDWSLKGAIFLSLEQQANLGFRVVDHLPYDSFVRKNVGYLFAIQHGAKKIFDADDRGDVIDNDLGKHFDVELIGEGARQDIILQYSHENPNRTIVNPYIHFGQRSVWPRGLPLENVGEIGHEEFYTEVFGGKQFIQQGISNGLPDVDSVFYFTRKPGLEAFDIRFDEHAPKVALPQGTMVPVNTFNTLYHSSAFWALMLPVSVSTMASDVLRGYWGQRLLWEIGGYVVVYPPTVHRYDRIESYPFSEEKDLHVNVGRLLKFLVSWRSSKHRLFEKILELSYVMAEEGFWTEKDVKFTAAWLQDLLAVGYQQPRLMSLELDRPRASIGHGDRKEFIPQKLPSVHLGVEETGVVNNEIGSLIRWRKNFGNVVLIMFCSGPVERTALEWRLLYGRIFRTVVILAEQKNADLAVEEGRLDFVYKQLLNIFSRFTSAEGFLFLHDNTILNYWNLLQADKSNLWITDKVSKSWSTVSTSGNSDWFSKQADMVKKVVSMMPVHFQVNYKETINSDQLLTVCSSDVFYIPRRFIADFTELVNLVDNLEIHHKVAIPMFFLSMDSPQNFDPVLSRMIYEENPXSTNSSTFYSDKVPAVHPWNVSSEQEFIKLIRIMAXGDLLLLELV

SEQ ID NO: 9972 - protein, 814 aa, Ricinus communis
MRNQIIDCLLVCLYKESKCRGTEQRRVRDSQRNCSRSSSSSTCFLGFSNVVQERATPKSPKSPRTTLPTVNHHNNYRFSPSKSLDFSTWFTENLYKIIICFFLIATVAAVFFFRNTGDTAAFLYLQSKSQPIEKTLPFPHINWNQIKPITDSASPFVNFRTERWIVASVSDYPSDSLKKLVKIKGWQLLAIGNSKTPKGWALKGCIYLSLEQQASLGFRVVDFVPFDSYVRKSVGYLFAIQHGAKKIFDADDRGEVIGDDLGKHFDVELVGEGARQETILQYSHENENRTVVNPYIHFGQRSVWPRGLPLENVGEIGHEEFYTQVFGGKQFIQQGISNGLPDVDSVFYFTRKSGLESFDIRFDEHAPKVALPQGIMVPLNSFNTIYQSSAFWGLMLPVSVSTMASDVLRGYWGQRLLWEIGGYVVVYPPTVHRYDRIEAYPFSEEKDLHVNVGRLIKFLIAWRSTKHRLFEKILELSYAMAEEGFWTEQDVKFTAAWLQDLIAVGYQQPRLMSLELDRPRASIGHGDRREFIPRKLPSVHLGVEEIGTVNYEIGNLIRWRKNFGNIVLIMFCTGPVERTALEWRLLYGRIFKTVVILSQQKNEDLAVEEGNLEQLYRHLPKIFDRFTSAEGFLFLKDDTVLNYWNLLQADKSKLWITDKVSKSWSTVATNGNSDWYAKQAEMVKRVVGSMPVHFQVNYKDAMKNDQSITICSSEIFYIPRHFVPDFVDLVSLVGDQEIHNNIAIPMFFVSMDSPQNFDSVLSTMVYKRKPPSNNSTLYNAQASAVHPWNVSSEQDFIKLVRIMAEGDPLLMELV

SEQ ID NO: 9973 - protein, 771 aa, Populus trichocarpa
MLVQGRVTTNPNPKSPKSQIRPTINHNHHDLHQRFSESKSLDFSTWVSENFYKIITITVLIATVAAIFFLRSTGDTAAFLYLQSQAQPLDKTHHFPRIDWNNIPAITDKSSPYANFRSEKWIVVSVSHYPSDSLKKLVRIKGWQLLAIGNSRTPNDWSLKGAIYLSLEQQASLGFRVLGYVPYDSYLRKSVGYLFAIQHGAKKIFDADDRGEVIDGDLGKHFDVELIGEGARQETILQYSHENENRSVVNPYVHFGQRTVWPRGLPLENVGELGHEEFYTEVYGGKQFIQQGISNGLPDVDSVFYYTRKTGLEAFDIRFDERAPKVALPQGVMVPVNSFNTIYHSSAFWGLMLPVSVSNMASDVLRGYWGQRLLWEIGGYVVVYPPTVHRYDTVGGYPFSEEKDLHVNVGRLVKFLVAWRSSEHRLFEKILELSFAMAEGGFWSEQDVKFTAAWLQDLLAVGYRQPRLMSFELDRPRPTIGHGDRKEFVPRKFPSVHLGVEETGTVNYEIANLIRWRKNFGNVVLIMFCNGPVERTALEWRLLYGRIFKTVIILSWQKNEDLAVEAGHLDHIYKHLPKIFDRYSSAEGFLFLQDDTILNYWNLLQASKAKLWITDKVSKSWTTVSTNGNTDWYAKQAEMVRKVVGSMPVHFQVNYKEAMKSDQSLVIGSSEIFYIPQHFITDFVDLVGLVGDLDIHQKVAIPMFFMSMDSPQNFDSVLSTMVYKRKPPPDNSTLYSAQVPAVHPWNVSSEQDFIKLIRIMAEGDPLLMELV

SEQ ID NO: 9974 - protein, 771 aa, Populus trichocarpa
MLVQDRVTTNPNPKSPKSQIRASINSHHHDLHHRFSESKSLDFSTWVSENFCKIVTITVLVATVAAILFLLSTGDTAALSYIQSKAQPLDKAHHPPRINWNNIPSIADKSSPYTNFRSEKWIVVSVSHYPSDSLKKLVRIKGWQLLAIGNSRTPNDWSLKGAIYLSLEQQATLGFRVSGYLPFDSYLRKSVGYLFAIQHGAKKIFDADDRGEVIDGDLGKHFDVELIGEGARQETILQYSHENENRSVVNPYVHFGQRTVWPRGLPLENVGEIGHEEFYTEVFGGKQFIQQGISNGLPDVDSVFYHTRKTGLEAFDIRFDERAPKVALPQGVMMPVNSFNTIYHSSAFWGLMLPVSVSTMASDVLRGYWGQRLLWEIGGYVVVYPPTVHRYDTVGGYPFSEEKDLHVNVGRLIKFLVAWRSSKHELFEKILELSFAMAEEGFWSEQDVKFTAAWLQDLLAVGYQQPRLMSFELDRPRPNIGHGDRKEFVPRKLPSVHLGVEETGTVNYEIGNLIRWRKNFGNVVLIMFCNGPVERTALEWRLLYGRIFKTVIILSSQKNEDLAIEAGHLDRMYKHLPKIFDRYSSAEGFLFLQDDTILNYWNLLQADKTKLWITDKVSKSWTTVSTNGNTGWYAKQAEMVRKVVGSMPVHFQVNYKEAMKSDQSLVIGSSEIFYIPQQLVTDFVDLVGLVGDLNIHQKVAIPMFFMSMDSPQNFDSVLSTMVYKPKPPPANSTFYSAQAPAVHPWNVSSEQDFIKLTRIMAEGDPLLMELF

SEQ ID NO: 9975 - protein, 726 aa, Vitis vinifera
MLVQDRSTPKSPKTHIRALHSLHPDRFTEPKNLDFSTWFSENLYKIVTISLLIATVAALFFLRNSPYANFRSERWILVSVSNYPTDSLRKLVKIKGWQVLAIGNSKTPSDWSLKGAIFLSLEQQANLGFRVVDHLPYDSFVRKNVGYLFAIQHGAKKIFDADDRGDVIDNDLGKHFDVELIGEGARQDIILQYSHENPNRTIVNPYIHFGQRSVWPRGLPLENVGEIGHEEFYTEVFGGKQFIQQGISNGLPDVDSVFYFTRKPGLEAFDIRFDEHAPKVALPQGTMVPVNSFNTLYHSSAFWALMLPVSVSTMASDVLRGYWGQRLLWEIGGYVVVYPPTVHRYDRIESYPFSEEKDLHVNVGRLLKFLVSWRSSKHRLFEKILELSYVMAEEGFWTEKDVKFTAAWLQDLLAVGYQQPRLMSLELDRPRASIGHGDRKEFIPQKLPSVHLGVEETGVVNNEIGSLIRWRKNFGNVVLIMFCSGPVERTALEWRLLYGRIFRTVVILAEQKNADLAVEEGRLDFVYKQLLNIFSRFTSAEGFLFLHDNTILNYWNLLQADKSNLWITDKVSKSWSTVSTSGNSDWFSKQADMVKKVVSMMPVHFQVNYKETINSDQLLTVCSSDVFYIPRRFIADFTELVNLVDNLEIHHKVAIPMFFLSMDSPQNFDPVLSRMIYEENPPSTNSSTFYSDKVPAVHPWNVSSEQEFIKLIRIMAAGDLLLLELV

SEQ ID NO: 9976 - protein, 771 aa, Arabidopsis thaliana
MLVQDRAAPSPAKPPKSQIRELPTHQQIRRRFSEPKNLDFSTWFSENLSRIAVFSLLIVTIVAFFFLYNTTDTASLLCFQSQSTQFLQSLSRPQIKWNSIPVVPDKTSPYANFQTEKWIVVSVTKYPTEELKSLVKIRGWQVLAIGNSATPKDWSLKGSIFLSLDAQAELGYRVLDHLPYDSFVRKSVGYLFAIQHGAKKIYDADDRGEVIDGDLGKHFDVELVGLDSKQEPILQYSHENPNRTVVNPYIHFGQRSVWPRGLPLENVGEINHEEYYTEVFGGKQFIQQGISNGLPDVDSVFYFTRKTTLEAFDIRFDEHSPKVALPQGVMVPVNSFNTLYHSSAFWGLMLPVSVSSMASDVLRGYWGQRLLWELGGYVAVYPPTAHRFDRIEAYPFVEEKDLHVNVGRLIKFLLAWRSEKHSFFETVLDLSFAMAEEGFWTEQDLKFTAAWLQDLIAVGYQQPRLMSLELDRPRASIGHGDRKEFVPRKLPSVHLGVEETGTVSTEIGNLIRWRKNFGNVVLVMFCNGPVERTALEWRLLYGRIFKTVVILSSQKNSDLYVEEAKLDHIYKHLPKIFDRYSSAEGFLFVEDDTVLNYWNLLQADKSKIWTTDKVSKSWTSVKPTGNSDWFSVQAELVKKTVSTMPAHFQVNYKDATKNNHETLTVCSSEVFYVPKRLVTDFIDLVDLVGDMDLHYKVAVPMFFLSMDSPQNFDPVLGSMVYKRKSASFNTSSSLYSAKAPAVHPWSISSEQDFIKLVQQMAEGDPLLMELV

SEQ ID NO: 9977 - protein, 765 aa, Arabidopsis lyrata subsp. lyrata
MLVQDRVAPKPPKSRIRELPSRDRFAEPKNLDFSSWVSDNVYRIVIFFLFIVTVAAFFFLYNTTDTASLLCFQSQSTQSLQSLTRPQINWNSIQIVSDKTSPYASFRTEKWIVVSVTKYPTEELKGLVKIKGWQVLAIGNSLTPKDWILKGAIFLSLDAQAELNYRILDHLPYDSFVRKSVGYLFAIQHGAKKIYDADDRGEVIDGDLGKHFDVELVGEDARQEPILQYSHENPNRTVVNPYIHFGQRSVWPRGLPLENVGEINHEEYYTEVFGGKQFIQQGISNGLPDVDSVYYSTRKTTFEPFDIRFDEHSPKVALPQGMMVPVNSFNTLYHSSAFWGLMLPVSVSSMASDVIRGYWGQRLLWELGGYVAVYPPTVHRYDRVEAYPFSDEKDLHVNVGRLIKFLLAWRSNKHRFFETILDLSFVMAEQGFWTELDVKFTAAWLQDLLMVGYQQPRLMSLELDRPRATIGHGDRKEFVPRKLPSVHLGVEEIGTVSSEIGNLIKWRKNFGNVVLIMFCNGPVERTALEWRLLYGRIFKTVVILSSRKDSDLYVQEAKLDHIYKRLPKIFDRYSSADGFLFVEDDTILNYWNLLQADKTKLWTTDKVTESWTTVRAAGNADWYSVQAELVKKIVSTMPVHFQVNYKEATKKTDDKSFLMCSSEVFYVPKRFVSDFTDLVNLVGEMDLHYKVAVPMFFLSMDSPQNFDPVLGSMVYKSEPASLNSSLSLYSAEAPAVHPWSISNEQDFIRLVREMAEGDPLLMELV

SEQ ID NO: 9978 - protein, 292 aa, Populus tremula x Populus alba
RIAAKLEMMEPCSSVKDRIGYSMITDAEEKGLIKAGESVLIEPTSGNTGIGLAFMAAAKGYRLIITMPASMSLERRMVLLAFGAELVLTDPARGMKGAVQKAEEISAKTPNSYILQQFENPANPKVHYDTTGPEIWKGSGGKVDAFVSGIGTGGTITGAGKYLKEQNPDIKLYGVEPVESAVLSGGKPGPHKIQGIGAGFIPGVLNVDLLDETVQISSEEAIETAKLLALKEGLLVGISSGAAAAAAIKIAKRPENAGKLIVAIFPSFGERYLSSVLFESVKKEAENMVFEP

SEQ ID NO: 9979 - protein, 234 aa, Glycine max
MTRTRIKIKKIDNITARQVTFSKRRRGLFKKAEELSVLCDAEVGLIVFSSTGKLFDYSSSSMNDIVTKYSTHSHGINKLDKPSLELQLEASNSAKLSKEIADRTQELSWLKGDDLQGLGLNELQQLEKTLEIGLDRVTDIKENQIMSQISELQKKGILLEEENKHLTKKLAEKEKEAMLCKAKIPFMVDSDKGIMQEEGVSLDSTNNISSCISDPPLEDGSSDISLTLGLPFSN

SEQ ID NO: 9980 - protein, 233 aa, Glycine max
MTRAKIKIKKIDNITARQVTFSKRRRGLFKKAEELSVLCDAEVGLIVFSSTGKLFDYSNASINDIITIYNTHSHGVNKLGKPSLELQLEASNSAKFSKEIVDRTQELSWLKDDDLQGLGLNELKQFEKTIEIGLDRVIEIKEKQIMSQISELQKKGNLLEEENKHLKKKLVETEMEAMLCEPEIPFMVDLDKGIMQEEGVSLDSTNSISSFINDPPPEDGSSNISLTLGLPLL

SEQ ID NO: 9981 - protein, 309 aa, Vitis vinifera
MAGFVPPPAPPAPPAPPKPDEKVDYLDLPCPIPYEEIHREALMSLKPELFEGMRFDFTKGLNQKFSLSHSVFMGPTEIPSQSSETIKIPTAHYEFGANFIDPKLMLFGRILTDGRLNARVKCDLTENLTLKANAQLTSEPHMSHGMVNFDYKGGDYRTQLQLGNGALFGASYIQSVTPYLSLGGEVFWAGQHRKSGIGYAARYNTDKMVATGQVASTGMVALSYVQKVSEKVSLASDFMYNYMSRDVTASFGYDYILRQCRLRGKIDSNGCTAAFLEERLNMGLNFILSAEIDHRKKDYKFGFGLTVGE

SEQ ID NO: 9982 - protein, 309 aa, Vitis vinifera
MAGFVPPPPPPAPPAPPKPDEKVDYLDLPCPIPYEEIHREALMSLKPELFEGMRFDFTKGLNQKFSLSHSVFMGPTEIPSQSSETIKIPTAHYEFGANFIDPKLMLFGRILTDGRLNARVKCDLTENLTLKANAQLTSEPHMSHGMVNFDYKGGDYRTQLQLGNGALFGASYIQSVTPYLSLGGEVFWAGQHRKSGIGYAARYNTDKMVATGQVASTGMVALSYVQKVSEKVSLASDFMYNYMSRDVTASFGYDYILRQCRLRGKIDSNGCTAAFLEERLNMGLNFILSAEIDHRKKDYKFGFGLTVGE

SEQ ID NO: 9983 - protein, 308 aa, Ricinus communis
MAGIVPPPTTASSKTINEVHSKVDYMDLPCPIPYEELHREALMSLKPELFEGMRFDFTKGLNQKFSLSHSVFMGPMELPSQSSETIKIPTAHYEFGANYIDPKLMLFGRVLTDGRLNARVKCDLTDNLTLKANAQLTNEPHMSHAMFNFDYKGNDYRTQLQLGNGALFGASYIQSVTPHLSLGGEVFWAGQHRKSGVGYAARYETDKMVGTGQVASTGMVALSYVQKVSEKVSLATDLMYNYMSRDVTASVGYDYILRQARLRGKIDSNGCASAFLEERLNMGLNFILSAELDHKKKDYKFGFGLTVG

SEQ ID NO: 9984 - protein, 308 aa, Glycine max
MATPIPPPPAAAAAAAADTKVDYLNLPCPIPFEELHREAMMSLKPDLFEGMRFDFTKMLNQKFSLNHSVLMGPTEVPSQSTETIKIPTAHYEFGSTFIDHPRLLLWGRILTDGRLNARVKCDLSENLTFKANAQLTNEPHMSHAMINFDYKGKDYRTQFQLGNGALLGASYIQSVTQHLSLGGEVFWAGQHRKSGIGYAARYNTDKSVATGQVASTGMVLLSYVQKVSEKVSLASEFMCNYLSRDVTASFGYDYILRQCRLRGKIDSNGCVAAFLEERLNMGLNFILSAELDHRKKDYKFGFGLTVGE

SEQ ID NO: 9985 - protein, 310 aa, Glycine max
MATLIPPPPPPPPPPAAAADPKVDYLNLPCPIPFEELHREAMMSLKPDLFEGMRFDFTKMLNQKFSLNHSVLMGPTEVPSQSTETIKIPTAHYEFGSTFIDHPRLLLWGRILTDGRLNARVKCDLSENLTFKANAQLTNEPHMSHAMINFDYKGKDYRTQFQLGNGALLGASYIQSVTQHLSLGGEVFWAGQHRKSGIGYAARYNTDKSVATGQVASTGMVLLSYVQKVSEKVSLASEFMCNYLSRDVTASFGYDYILRQCRLRGKIDSNGCVAAFLEERLNMGLNFILSAELDHRKKDYKFGFGLTVGE

SEQ ID NO: 9986 - protein, 308 aa, Glycine max
MATPIPPPPAAAAAAAADTKVDYLNLPCPIPFEELHREAMMSLKPDLFEGMRFDFTKMLNQKFSLNHSVLMGLTEVPSQSTETIKIPTAHYEFGSTFIDHPRLLLWGRILTDGRLNARVKCDLSENLTFKANAQLTNEPHMSHAMINFDYKGKDYRTQFQLGNGALLGASYIQSVTQHLSLGGEVFWAGQHRKSGIGYAARYNTDKSVATGQVASTGMVLLSYVQKVSEKVSLASEFMCNYLSRDVTASFGYDYILRQCRLRGKIDSNGCVAAFLEERLNMGLNFILSAELDHRKKDYKFGFGLTVGE

SEQ ID NO: 9987 - protein, 316 aa, Populus trichocarpa
MAGFVPQGTTFLGNEATSEAAKKINEVHKKVDYLSLPCPIPYEELHREALMSLKPEYFEGMRFDFTKGLNQKFSLSHSVMMGPMEIPSQSSEAIKIPTAHYEFGANFIDQKTMLIGRVLTDGRVNARVKCDLTDDLALKANAQLTNEPHMSHVMLNFDYKGKDYRSQLQLGNGALFGASYIQSVTPHMSLGAEVFWAGQHRKSGVGYAGRYETDKMVAAGQVASTGLMALSYVQKVSEKVSLATDFMYNYLSKDVTASVGYDYALRQARLRGKIDSNGCTSAFLEERLNMGLNFVLSAELDHKKKDYKFGFGLTVG

SEQ ID NO: 9988 - protein, 305 aa, Glycine max
MATPIPPPPAAAAAATKVDYLNLPCPIPFKELHREAMMSLKPDLFEGMRFDFTKMLNQKFSLNHSVLMGPTEVPSQSTETIKIPTAHYEFGSTFIDHPRLLLWGRILTDGRLNARVKCDLSENLTFKANAQLTNEPHMSHAMINFDYKGKDYRTQFQLGNGALLGASYIQSVTQHLSLGGEVFWAGQHRKSRIGYAARYNTDKSVATGQVASTGMVLLSYVQKVSEKVSLASEFMCNYLSRDVTASFGYDYILRQCRLRGKIDSNGCVAAFLEERLNMGLNFILSAELDHRKKDYKFGFGLTVGE

SEQ ID NO: 9989 - protein, 300 aa, Populus trichocarpa
TSAAAKKVNEVHKNVDYMNLPCPIPYEELHREALMSLKPEYFEGMRFDFTKGLNQKFSLSHSVMMGPMEIPSQSSEAIKIPTAHYEFGANFIDQRTMLIGRVLTDGRLNARVKCDLTDDLALKANAQLTNEPHMSHVMLNFDYKGKDYRSQLQLGNGALFGASYIQSVTPHLSLGAEVFWAGQHRKSGVGYAGRYETDKMVAAGQVASTGLMALSYVQKVSEKVSLATDFMYNYLSRDVTVSVGYDYALRQARLRGKIDSNGCTSAFLEERLNMGLNFILSAELDHKKKDYKFGFGLTVG

SEQ ID NO: 9990 - protein, 307 aa, Medicago truncatula
MATMVPPIPTADDKKVDQKVDYSNLSCPIAFEELHREAMMSLKPELFEGLRFDFTKMLNQKFSLNHSVSMGPTEIPSQSAEVIKIPTANYEFGANFIDHPKLLLLGRAMTDGRVTARVKYDVFDNLTLKANAQLTSEPHMSQGMINFDYKGKDYRTQFQMGNGALLGASYIQSVTNHLSLGGEVFWAGQHRKSGVGYAARYNTDKMVATGQVASTGMVLLSYVQKVSEKVSLAADLMCNYLSRDVTASFGYDYILRQCRLRGKVDSNGVCAAFLEERLNMGLNFILSAELDHKKKDYKFGFGLTVGE

SEQ ID NO: 9991 - protein, 254 aa, Glycine max
  misc_feature (113)..(113): Xaa can be any naturally occurring amino acid
  misc_feature (133)..(133): Xaa can be any naturally occurring amino acid
  misc_feature (144)..(144): Xaa can be any naturally occurring amino acid
  misc_feature (175)..(175): Xaa can be any naturally occurring amino acid
MPMELELELGSTTIQRSFDARYTRHTRDLLDELPDSFTVTDPSILGHPIVFASPGFLKLTGYSLREVLGRPTAIFQGPLTFPKSVIEIRKVVREERNAQVILPKSVVHFVAVXVPLQKKEGSGVRDFGFECCXKEVCVDSLAEXDCVCSLEQVPEPDVREVEREELCEASDDEKXSVVTAMDSIFYVLTHYSEATGRLVCRKRSNIPDVGLLSTSLIISLGRIKQSFVLTNLHLPDMPIVYASDTFLELTNSVS

SEQ ID NO: 9992 - protein, 270 aa, Glycine max
  misc_feature (71)..(71): Xaa can be any naturally occurring amino acid
  misc_feature (116)..(116): Xaa can be any naturally occurring amino acid
  misc_feature (140)..(140): Xaa can be any naturally occurring amino acid
MSSLPSNSFTITDPSIPGHPIVFANPSFLKLTGYSLREVLGWPAAIFSGPLTSQKFVIKIHEIVREERNAXVILLNYHRDGMPFWMLFCVSPIFSSDGGAVVHFIVVQVPLQKKEXGSGVRDFGFGCYRKEVCVDSLAEXDRICSLEQLLEPDVRELEREESCEASDDEKRSVVTAMDCIFSVLTHYGEATGRLVCRKRSSIPDVGLLSTSLIISLGRIKQSFVLTNPHLPDMPTVYASDTLLNLTGFKVVTLYKLDQVQMNLLIFSHSS

SEQ ID NO: 9993 - protein, 382 aa, Glycine max
MGNACAKGKPVAHVSSSNFSGGKKHASRPKQYSNSSEQLSAPITSELNVPKSFSSNLKSFSLNDLKEATKNFRQENLIGEGGFGRVFKGWIDENTYGPTKPGTGIVVAIKNLKPESFQGHKEWLQEVNYLGQLQHENLVKLIGYCLEGKNRLLVYEFMQKGSLENHLFRKGVQPMAWVTRVNIAIGVARGLTLLHSLDQNVIFRDLKASNILLDSDFNAKLSDFGLARDGPTGDNTHVSTRVLGTQGYAAPEYVATGHLTPRSDVYSYGVVLLELLTGRRAVEDDRPGFSEETLVDWAKPFLSDNRRVLRIMDTKLGGQYSKKGAQAAAALALQCLNIDPKFRPPMVEVLAALEALNSSNSFTRTPKHESHATKQSGGPSQK

SEQ ID NO: 9994 - protein, 382 aa, Glycine max
MGNACAKGKPVAHVSSSNFSGSKKPASKPKQYSNSSEQRSAPTTSELNVPKSISSNLKSFSLNDLKEATKNFRRENLIGEGGFGRVFKGWIDENTYGPTKPGTGIVVAIKNLKPESFQGHKEWLQEVNYLGMLQHENLVKLIGYCLEGKNRLLVYEFMQKGSLENHLFRKGVQPMAWVTRVNIAIGVARGLTFLHSLDQNVIFRDLKASNILLDSDFNAKLSDFGLARDGPTGDNTHVSTRVIGTQGYAAPEYVATGHLTPRSDVYSFGVVLLELLTGRRAVEDDGPGFSEETLVDWAKPFLNDNRRVLRIMDTRLGGQYSKKGAQAAAALALQCLNTDPKFRPPMVEVLAALEALNSSNSFTRTPKHESHSTKISGGPSQK

SEQ ID NO: 9995 - protein, 407 aa, Medicago truncatula
MGNTCRKPVCHDSSPSLFGSTNTQSNIKQTSDSPDQKTDSKTSSSNDDKSISKDVKSFSFNDLKEATRNFRQENLIGEGGFGFVYKGWIDENTGAPTKPGNGIVVAIKKLKPESFQGHKEWLAEVNYLGQLHHENLVKLIGYCSEGKNRLLVYEFMQKGSLENHLFRKGVQPISWMTRISIAIGVARGLAFLHSLDANVIYRDLKASNILLDSDFNANLSDFGLARDGPTGDNTHVSTRIIGTHGYAAPEYVATGHLTLRSDVYSFGVVLLELLTGRRVVEDDRQVYTEETLVDWAMPFLSDSRRILRIMDTKLGGQYSKKGAQAAAALVLKCLNTDPKHRPTMVNVLAALEALHSSNSFPKKPKSGTDNHNSVPRTPKSGTENHHPTKHSSHHHLHKSIANTTRKH

SEQ ID NO: 9996 - protein, 403 aa, Vitis vinifera
MGNCCRRPAKCAHASSTHFSVQSDRTKPPSKANKDSTSSSQHTPFGTLNKILVSSKSDISASNSVKDFSFNDLKNASKNFRSESLLGEGGFGCVFKGWLDENTLAPTKPGTGMVVAIKKLKTESFQGHKEWLAEVNYLGQLHHENLVKLIGYCSESENRLLVYEFMSKGSLENHLFKKGVQPITWATRMSIAIDVAQGISFLHSLDANVIYRDLKASNILLDSDFKAKLSDFGLARDGPTGDNTHVSTRVVGTRGYAAPEYVATGHLTPKSDVYSFGVVLLELLSGRRAMDDEKAGGVEETLVDWAKPFLSDNRRVLRIMDTRLGGQYSKKGAQAAASLALQCLHTDPKNRPLMTDVLAALERLPTSKDIPRTPSPRVEYHIMKHSSNPGHTHKATAGATNLV

SEQ ID NO: 9997 - protein, 422 aa, Vitis vinifera
MGNCCRRPAKCAHASSTHFSVQSDRTKPPSKANKDSTSSSQHTPFGTLNKILVSSKSDISASNSVKDFSFNDLKNASKNFRSESLLGEGGFGCVFKGWLDENTLAPTKPGTGMVVAIKKLKTESFQGHKEWLAEVNYLGQLHHENLVKLIGYCSESENRLLVYEFMSKGSLENHLFKKGVQPITWATRMSIAIDVAQGISFLHSLDANVIYRDLKASNILLDSDFKAKLSDFGLARDGPTGDNTHVSTRVVGTRGYAAPEYVATGHLTPKSDVYSFGVVLLELLSGRRAMDDEKAGGVEETLVDWAKPFLSDNRRVLRIMDTRLGGQYSKKGAQAAASLALQCLHTDPKNRPLMTDVLAALERLPTSKDIPRTPSPRVEYHIMKHSSNPGHTHKATAGATNLILTSFYFFECFVKPCSISEN

SEQ ID NO: 9998 - protein, 545 aa, Glycine max
MGGDSAVEESEGVNVNINVRCSNGSKFSVQIAVDSTVSSFKDAAACSCDIPAEQQRLIYKGRILKDDQTLRSYGLEADHTVHLVRGSALANPTGGTNTSSTDTNTNTNIPTDNARVAGANEGEGLGGLGFGASLFPGLGVNGTGGNGLFGEGFPDLEQMQQPFISNPNLVREIMNSPTMQNLINNPEIVRNLIMNNPQMQELMDRNPELAHILNDPSTLRQTLEATRNPEIMREMMRNTDRAMSNIESSPEGFNMLRRMYENIQEPFLNATTMAGNTGNNNAAVSGTHGGHARDPSTNPSTTSSEATAGSPLPNTNPLPNPWSSTGTGGAQNNSRRSLTTGVDARQQGPTGLGGHGLPDLESMLGGSAMPDPALLTQLMQNPAISQMMQSMLSNPQTLNQILGANTEQRGMPDLNSLREVMQNPEFLRLFSSPETLQQLLSFQQTLMSQLGQQQSTWESGQTGGGTGPMNNLGLEMLSSMFGGLGAGSLAVPNRSNEPPEQLYASQLSQLQEMGFFDSQENIRALIATSGNVHAAVERLLGNSGQ

SEQ ID NO: 9999 - protein, 541 aa, Glycine max
MGGDSAIEESEGVNVNINVRCSNGFKFSVQIAVDSTVSSFKDVVARNCDIPAEQQRLIYKGRILKDDQTLRSYGLEADHTVHLVRGSAPANPTGGTNTSSTNTNTTTNNARGAGANEGGGLGGLGFGASLFPGLGVNGTGGNGLFGEGFPDLEQMQQPFISNPNLVREIMNSPTMQNLMNNPEIVRNLIMNNPQMQELMDRNPELAHILNDPSTLRQTLEATRNPEIMREMMRNTDRAMSNIESSPEGFNMLRRMYENIQEPFLNATTMAGNTGNNNAAVSGTHGGHARDRSTNPSTTSSEATAGSPLPNTNPLPNPWSSTGTGGAQNNPRRSLTTGVDARQQGPTGLGGLGLPDLESMMGGSAMPDAALLTQLMQNPAISQMMQSMLSNPQTLNQILGANTEQRGMPDLNSLREVMQNPEFLRLFSSPETLQQLLSFQQALMSQLGQQQSTRESGQTGGGTGPMNNLGLEMLSSMFGGLGAGSLAVPNRSNEPPEQLYASQLSQLQEMGFFDTQENIRALIATSGNVHAAVERLLGNSGQ

SEQ ID NO: 10000 - protein, 553 aa, Glycine max
MGGDSAIEESEGVNVNINVRCSNGFKFSVQIAVDSTVSSFKDVVARNCDIPAEQQRLIYKGRILKDDQTLRSYECFASIACIRQKGLEADHTVHLVRGSAPANPTGGTNTSSTNTNTTTNNARGAGANEGGGLGGLGFGASLFPGLGVNGTGGNGLFGEGFPDLEQMQQPFISNPNLVREIMNSPTMQNLMNNPEIVRNLIMNNPQMQELMDRNPELAHILNDPSTLRQTLEATRNPEIMREMMRNTDRAMSNIESSPEGFNMLRRMYENIQEPFLNATTMAGNTGNNNAAVSGTHGGHARDRSTNPSTTSSEATAGSPLPNTNPLPNPWSSTGTGGAQNNPRRSLTTGVDARQQGPTGLGGLGLPDLESMMGGSAMPDAALLTQLMQNPAISQMMQSMLSNPQTLNQILGANTEQRGMPDLNSLREVMQNPEFLRLFSSPETLQQLLSFQQALMSQLGQQQSTRESGQTGGGTGPMNNLGLEMLSSMFGGLGAGSLAVPNRSNEPPEQLYASQLSQLQEMGFFDTQENIRALIATSGNVHAAVERLLGNSGQ

SEQ ID NO: 10001 - protein, 541 aa, Glycine max
MGGDATAAAESATAESNAANGVNINIRCSNGSKFSVQIGLDSTIRSFKDAVARNCDISADQQRLIYKGRILKDDQTLQSYGLEADHTVHLVRGFAPSNTTGGTNSVGGGNTTTANTRGAGANEGGGLGGPGFGASLFPGLGGNNGMGGGGLNGLFGAGFPDLEQMQQPFLSNPNLMRDIMNTPAMQNLINNPDIVRNLIMNNPQMQELMDRNPELAHILNDPSTLRQTLEATRNPEIMREMMRNTDRAMSNIESSPEGFNMLRRMYENVQEPFLNATTMAGNTGNDAAAVRNQSTNPSTTNSEATSPVPNTNPLPNPWSSTGTGGGQNNTRRSTTTGGEARQSTPTGLGGLGLPDLEGMLGGTGMPDAAMLTQLMQNPAISQMMQSILSNPQTMNQILGVNNEQRGMPDLNSLREVMQNPEFLRLFSSPETLQQLLSFQQALLSQLGQQQSTQEPGQTGGGTGPMNNLGLEMLSSMFGGLGAGSLAVPNRSNEPPEQLYATQLSQLQEMGFFDTQENIRALIATSGNVHAAVERLLGNSGQ

SEQ ID NO: 10002 - protein, 542 aa, Medicago truncatula
MGGDATAETTTEPQSTDGGVKINIRCSNGSKFSVQISLDSTVVSFKDVIAQNCDISADQQRLIYKGRILKDDQTLQSYGLEADHTVHLVRGFTPANTTGGANTTGANTTTTNARAAGANEGGGLGGPGLGASLFPGLGGINGMGGGGGLNSLFGAGPPDLEQLQQPFMSNPNLVREIMNSPAMQNLLNNPEIVRNLLMSNPQMQELMDRNPELAHILNDPSTLRQTLEATRNPEIMREMMRNTDRAMSNIESSPEGFNMLRRMYENVQEPFLNATTMAGNDSSRILGTQGGQTRNPSTNPSTTNAEATSPVPNTNPLPNPWSSAPTGGAQTNVRRSTPTAADARQQTPTGLGGLGMPDLEGMLGGMPDAGSLTQLMQNPAISQMMQSIMSNPQTMNQILGMNTDQRGMPDMNSMREVMQNPEFLRMFSSPETMQQLLSMQQALMTQLGQQQSTQEPGQTGGGTGPVNNLGLEMLSSMFGGLGAGSLAVPNRSNEPPETLYATQLTQLQEMGFFDTQENLRALIATSGNVHAAVERLLGNSGQ

SEQ ID NO: 10003 - protein, 539 aa, Medicago truncatula
MGGDGAVEDSASESKTEVNINVRCSNGTKYSVQVSLDSTVGSFKDLIARNCDIPAQQQRLIYKGRILKDDQTLQSYGLEADHAVHLVRSFAPTNASGGTNSSGTNTTTNDAAGAGANAAGGLGGLGFGASLFPGLGANGTGRNTLFGEGFPDLEQMQQPFISNPNLMREMMNSPAMQNLVSNPEIVRNLIMNNPQMQELMDRNPELAHVLNDPSTLRQTLEATRNPEIMREMMRNTDRAMSNIESSPEGFNMLRRMYENVQEPFLNATTMAGNTALSGTQGGLSRDQSTNPSTTNSETTAGSPIPNANPLPNPWSSTGTGAPQNNTRSSTTGGDARQQAPTGLGGLGLPGLEGMLGGSGMPDPALLTQLMQNPAISQMMQSMLSNPQTLSQILGAANTEQRGGMPDLNSLRDVMQNPEFLRLFQSPETMQQLMSFQQALLSQQQSTRESGQTGQTGGGTGPFNNMGLEMLSSMFGGLGAGGLGAAPNRSNEPPEQLYATQLTQLQEMGFFDTQENIRALIATSGNVHAAVERLLGNTGQ

SEQ ID NO: 10004 - protein, 541 aa, Glycine max
MGGDDAAAESATTERNAANEVNINIRCSNGSKFSVQIGLDSTVRSFKEAVAHNCDISSDQQRLIYKGRILKDDQPLQSYGLEADHTVHLVRGFSPSNTTGGTNSGGGGGGNTTTANTRGAGANEGGGLGGPGFGASPFPGLGGNNGMGGGGLNGLFGAGFPDLEQMQQPFLSNPNLMRDIMNTPAMQNLINNPDIVRNLIMNNPQMQELMDRNPELAHILNDPSTLRQTLEATRNPEIMREMMRNTDRAMSNIESSPEGFNMLRRMYENVQEPFLNATTMAGNTGNDAAAVRNQSTNPSTTNSEATSPVPNTNPLPNPWSSTGTGGGGQTNTRRSTTTGGDARQPAPTGLGGLGLPDLEGMMGGMPDTAMLTQLMQNPAISQMMQSILSNPQTMNQILGVNNEQRGMPDLNSLREVMQNPEFLRLFSSPETLQQLLSFQQTLLSQLGQQQSAQEPGQTGGGTGPLNNMGLEMLSSMFGGLGAGSLAVPNRSNEPPEQLYATQLSQLQEMGFFDTQENIRALIATSGNVHAAVERLLGNPGQ

SEQ ID NO: 10005 - protein, 785 aa, Glycine max
MLTPTPNPPSHSDACVHLLQSAIKSRDPFIGRCIHARIIKHGLRYLGVFLTNNLLNLYVKTGSSSDAHRLFDEMPLKTTFSWNTILSAHAKAGNLDSARRVFDEIPQPDSVSWTTMIVGYNHLGLFKSAVHAFLRMVSSGISPTQFTFTNVLASCAAAQALDVGKKVHSFVVKLGQSGVVPVANSLLNMYAKCGDSVMAKVVFDRMRLKDTSTWNTMISMHMQFCQFDLALALFDQMTDPDIVSWNSIITGYCHQGYDIRALETFSFMLKSSSLKPDKFTLGSVLSACANRESLKLGKQIHAHIVRADVDIAGAVGNALISMYAKSGAVEVAHRIVEITGTPSLNVIAFTSLLDGYFKIGDIDPARAIFDSLKHRDVVAWTAMIVGYAQNGLISDALVLFRLMIREGPKPNNYTLAAVLSVISSLASLDHGKQLHAVAIRLEEVSSVSVGNALITMYSRSGSIKDARKIFNHICSYRDTLTWTSMILSLAQHGLGNEAIELFEKMLRINLKPDHITYVGVLSACTHVGLVEQGKSYFNLMKNVHNIEPTSSHYACMIDLLGRAGLLEEAYNFIRNMPIEPDVVAWGSLLSSCRVHKYVDLAKVAAEKLLLIDPNNSGAYLALANTLSACGKWEDAAKVRKSMKDKAVKKEQGFSWVQIKNKVHIFGVEDALHPQRDAIYCMISKIWKEIKKMGFIPDTNSVLHDLEQEVKEQILRHHSEKLAIAFALINTPKHTTVRIMKNLRVCNDCHSAIRYISLLVEREIIVRDATRFHHFKDGSCSCQDYW

SEQ ID NO: 10006 - protein, 735 aa, Vitis vinifera
MNNLMNFYAKTGFIYDAHRVFDEMPVKSVFSWNIILSGYAKGGRLEEAHRVFEEMPEPDSVSWTAMIVGYNQMGQFENAIGMFREMVSDDVPPTQFTLTNVLASCAAVECLGIGRKVHSFVVKHGLSSYISVANSLLNMYAKSGDPVTAKIVFDRMKLKSTSSWNTMISSHMQSGLVDLAQVQFEQMIERDVVSWNAMISGYNQHGFDREALDIFSKMLMDSSSKPDKFTLASALSACANLENLKLGKQIHAHIIRTEFDTFGAVGNALISMYSKSGGVEIAQKIIEQSMISNLDVIAFTALLDGYVKLGDINPARRIFDSLRVRDVVAWTAMIVGYVQNGFNQDAMELFRSMIKEGPKPNNYTLATMLSVSSSLASLDHGRQIHASATRSGNASSVSVSNALITMYAKSGSINDARWVFNLIHWKRDTITWTSMIIALAQHGLGEEALTLFERMLENGIKPDHITYVGVLSACTHVGLVEQGRSYYNLMQNAHKIIPTPSHYACMIDLFGRAGLLQEAHAFIENMPIEPDVIAWGSLLASCKVHKNVELAEVAAERLLLIEPENSGAYSALANVYSACGQWENAANIRKSMKDKGVKKDQGFSWVQIKNKVHIFGVDDGLHPQRDAIYEMMAKIWKEIKKMGFVPDTESVLHDLEEELKEQILSHHSEKLAIAFGLICTPENTTLRIMKNLRVCNDCHSAIKFISKLVGREIIVRDATRFHHFKNGLCSCRDYW

SEQ ID NO: 10007 - protein, 698 aa, Oryza sativa Japonica Group
MFAKSGRLADARGVFAEMPERDAVSWTVMVVGLNRAGRFGEAIKTLLDMTADGFTPTQFTLTNVLSSCAVTQAGAVGRKVHSFVVKLGLGSCVPVANSVLNMYGKCGDSETATTVFERMPVRSVSSWNAMVSLNTHLGRMDLAESLFESMPDRSIVSWNAMIAGYNQNGLDAKALKLFSRMLHESSMAPDEFTITSVLSACANLGNVRIGKQVHAYILRTEMAYNSQVTNALISTYAKSGSVENARRIMDQSMETDLNVISFTALLEGYVKIGDMESAREMFGVMNNRDVVAWTAMIVGYEQNGRNDEAIDLFRSMITCGPEPNSYTLAAVLSVCASLACLDYGKQIHCRAIRSLLEQSSSVSNAIITMYARSGSFPWARRMFDQVCWRKETITWTSMIVALAQHGQGEEAVGLFEEMLRAGVEPDRITYVGVLSACSHAGFVNEGKRYYDQIKNEHQIAPEMSHYACMVDLLARAGLFSEAQEFIRRMPVEPDAIAWGSLLSACRVHKNAELAELAAEKLLSIDPNNSGAYSAIANVYSACGRWSDAARIWKARKEKAVRKETGFSWTHIRSKIHVFGADDVVHPQRDAVYAMAARMWEEIKGAGFVPDLQSVLHDVDDELKEELLSRHSEKLAIAFGLISTPEKTTLRVMKNLRVCNDCHAAIKAISKVTDREIIVRDATRFHHFRDGLCSCKDYW

SEQ ID NO: 10008 - protein, 260 aa, Glycine max
MSTFAFTSLFQITVSSSSSSLHAIRASASEYVPSQHTLRREFLKGVAALMPLPLVVLIEPPPSDAREVEVGSFLPPSPSDPSFVLFKASAKDTPALRAGNVQPYKFILPPTWKQARVANILSGNYCQPKCAEPWVEVKFEDEKQGKVQVVASPLIRLTNKPNATIEDIGSPEKLIASLGPFVTGNTFDPEELLETSVEKLGDQTYYKYVLETPYALTGTHNLAKATAKGNTVVLFVVSANDKQWQTSEETLKAVLNSFEV

SEQ ID NO: 10009 - protein, 265 aa, Glycine max
MTTFAFTSLLPLTVSSPSSSSKFSAFHAIRASLDSEYVASRHTLRREFLKGVALMPLPLVVMREPPPSHAREVEVGSFLPPSPSDPSFVLFKATPKDTPALRAGNVQPYKFILPPTWKQARVANILSGNYCQPKCAEPWVEVKFEDEKQGKVQVVASPLIRLTNKPNASIEDIGSPEKLIASLGPFVTGNTLDPDELLETSVEKIGDQTYYKYVLETPYALTGTHNLAKATAKGNTVVLFVVSANDKQWQTSEETLKAVLNSFEV

SEQ ID NO: 10010 - protein, 265 aa, Glycine max
MTTFAFTSLLPLTVSSPSSSSKFSAFHAIRASLDSEYVASRHTLRREFLKGVALMPLPLVVMREPPPSHAREVEVGSFLPPSPSDPSFVLFKATPKDTPAPRAGNVQPYKFILPPTWKQARVANILSGNYCQPKCAEPWVEVKFEDEKQGKVQVVASPLIRLTNKPNASIEDIGSPEKLIASLGPFVTGNTLDPDELLETSVEKIGDQTYYKYVLETPYALTGTHNLAKATAKGNTVVLFVVSANDKQWQTSEETLKAVLNSFEV

SEQ ID NO: 10011 - protein, 259 aa, Medicago truncatula
MATSPFTSLFPFTSSSTTSHSKLSHFRAFIKASSSISVPRREFLKGIALSLPLIALTEPPQSQAREVSVGSFLPPSSSDPSFVLFKASPKDTPALRAGNVQPYQFILPPTWKQLRIANILSGNYCQPKCAEPWVEVKFEDEKQGKIQVVASPLIRLTNKPNATIEDIGSPEKLIASLGPFVTGNTLDPDELLEASVEKIDDQTYYKYVLETPYALTGSHNLAKATAKGNTVVLFVASANDKQWQTSEKILKTMLDSFKV

SEQ ID NO: 10012 - protein, 260 aa, Ricinus communis
MATASLSPFFSTSTSPKYPLKTSPPTTITAIVCKNRSNSTLRRQILKGIAVSPLILIKEAPISEAKEVEVGSYLPSSPSDPSFVLFKASPKDTPALRAGNVQPYQFILPPTWKQARVANILSGNYCQPKCAEPWVEVKFEDEKQGKVQVVASPLIRLTNKPNATIEEIGTPEKLIASLGPFVTGNSYDPDELLETSIEKLGDQTYYKYVLETPYALTGTHNLAKATAKGSTVVLFVASANDKQWQASEKTLKAIIDSFIV

SEQ ID NO: 10013 - protein, 264 aa, Vitis vinifera
MATASFAPLSHVFSRLSHISSSKSATSILPHSSPFKNSPNQLTFRREFLKGLALAPLIFISEEALPAHAREVEVGSYLPTSPSDPSFVLFKASPKDTPALRAGNVQPYQFVLPPTWKQTRVANILSGNYCQPKCAEPWVEVKFEDENQGKVQVVASPLIRLTNKPNASIEDIGSPEKLIASLGPFVTGNTYDSDELLETSVEKLGDQTYYKYVLETPFALTGSHNLAKATAKGNSVVLFVASANDKQWQASQKTLKAMLDSFQV

SEQ ID NO: 10014 - protein, 257 aa, Populus trichocarpa
MATASLTPIFSSPLKTSRTTTLTTTTTSLDQHRNQVVLRRQILKGLVLSPLILIKAPPSSEAREIEVGSYLPPSPTDPSFVLFKASSKDTPALRAGNVQPYQFILPPSWKQTRVANILSGNYCQPKCAEPWVEVKFEDEKQGKVQVVASPLIRLTNKPNATIEEIGNPEKLIASLGPFVTGNSYDPDELLETKIEKFGDQTYYKYMLETPFALTGTHNLAKATAKGSTVVLFVASANDKQWQASEKTLKAILDSFQI

SEQ ID NO: 10015 - protein, 262 aa, Arabidopsis lyrata subsp. lyrata
MATASLVLTSKVFSVSSKCSALIKARTGVVVASAQQQQQPRRRELLLKSAVAIPAILQLKEAPISEAREVEVGSYLPPSPSDPSFVLFKAKPSDTPALRAGNVQPYQFVLPPNWKQLRIANILSGNYCQPKCAEPWIEVKFENEKQGKVQVVASPLIRLTNKPNATIEDIGEPEKVIASLGPFVTGNSYDSDELLKTSIEKIGDQTYYKYVLETPFALTGSHNLAKATAKGNTVVLFVVSATEKQWQSSQKTLEAILDSFQL

SEQ ID NO: 10016 - protein, 541 aa, Glycine max; identical to SEQ ID NO: 9999

SEQ ID NO: 10017 - protein, 545 aa, Glycine max; identical to SEQ ID NO: 9998

SEQ ID NO: 10018 - protein, 548 aa, Ricinus communis
MGGGNGASVDESSNGGDEVNVNIRCSNGSKFSVGISLSESVETFKTVLAGKCDVPADQQRLIYKGRILKDDQTLQSYGLEADHTVHLVRGFAPAAAANTAPPSNTGGSNPASTNTRAVGSNEGGALGGSDLGLFPGMRLNGLGGSAGLFGAGLPEFEQVQQQLTRNPNIMREIMNTPVVQNLMNNPEIMRNLIMNNPQMREIIDRNPELAHILNDPSTLRQTLEAARNPELMREMMRNTDRAMSNIESSPEGFNMLRRMYETVQEPFLNATTMAGNTGGDSANPFAALLGNQAGNQASDATTNPSIASSESTTGSPAPNTNPLPNPWTATGTGGALNNTARSSNTGDARPQTPVGLGGLGLPEFDSMFGAMPDSNVMSQMLQNPAISQMMQSLLSNPQYMNQMLGSNPQFRSMLDSNSQFREMMQNPEFLRQLTSPETMQQLLTFQQALLSQFGRQQSNQEPGQTGAGTGTPNNMGLDMLMNMFGGLGAGSLAVPNRSNVPPEELYATQLSQLQEMGFFDTQENIRALIATAGNVHAAVERLLGNSGQ

SEQ ID NO: 10019 - protein, 549 aa, Populus trichocarpa
MGGGNGDVEGGSNDTDGGDDEVNVNIRCSNGSKFTVKISLSSTVDSFKQLIANQCDVPSDQQRLIYKGRILKDDQTLQSYGLEADHAVHLVRGFAPSAPVNATAATNTGGSNTAPTNTRAAGSTDDGELGGSGFGSLFPGLGLNGLGGSGGLLGAGLPEFEQVQQQLTQNPNIMRDIMNTPVVQNLMNNPEIMRNLLMNNPQMREIIDRNPELAHILNDPSTLRQTLEAARNPELMREMMRNTDRAMSNIESSPEGFNMLRRMYETVQEPFLNATTMAGNAGGDSANPFAALLGTQTGNQARDGSTNLSTTSSETTTGSPAPNTNPLPNPWSSGGAQTNTTRSNPTSDTRPQAPTGLGGLGLPDLDNMFSAMPDAAMVSQLMQNPAISQMMQSFMSSPQYMNQILGMNPQLRSMLDSNPQLREMMQNPEFLRQLTSPETMQQLLTFQQSLMSQLGQRQSTLAQGQTGAGTGTTNNAGLEMLMNMFGGLGAGSLAVPNRSNVPPEELYATQLSQLQEMGFFDTQENIRALIATAGNVHAAVERLLGSTGQ

SEQ ID NO: 10020 - protein, 465 aa, Medicago truncatula
MEGLAMLKQLIGQLQQLLDSHHHSSSSSSSSSVLQQQSSHQTIFLQHHPPRWTSFDLEDSSVDDCCGLVMAAGKSHSFRMSEPLKPPPAKKPRRDRSRGKSSGRSSTSEVMEQEIWKDFPEDLFEAVIARLPIAAFFRFRSVCRQWNSLLASQSFSKQCAEVPQENPWFYTITHENVNSGAMYDPSLKKWHHPSISPLPTKLIVLPVASAGGLVCFLDIGHRNFYVCNPLTQSFKELPARSVKVWSRVAVGMTVNRNSIGSGYKILWVGCDGEYEVYDSVKNSWSRPGNMPGSMNLPLSLNFRSQTVSIDSTLYFMRSDPEGVVSYDMATGVWKQYIIPAPLHLTDHTLAEYDGQIMLVGLLTKNAATCVCIWELQRMTLLWKEVDRMPNIWCLDFYGKHVRMTCLGNKGLLMLSLRSKQMNRLVTYNIAKKEWLKVPGCVVPNGKKRQWIACGTAFHPCLTAVA

SEQ ID NO: 10021 - protein, 450 aa, Glycine max
MEGLAMLKQLIAQLQHLFDTYHSQSSLIFQQQHPRWTTSLDIEDNSVDDFCGLVMTAGKSGSFRMSEPGKPPPTKKSRRDRSRGKSSGRSCTTEVMEQEIWKDFPEDLFEAVIARLPISTFFRFRSVCRQWNSMLNSQSFSQHCTQVTQENPWFYTITHENVNSGAMYDPSLKKWHHPTISTPPTKLIVLPVASSGGLVCFLDIGHRNFFVCNPLTQSFKELPARSVKVWSRVAVGMMANGNFAGSGYKIVWVGCDGEYEVYDSVRNSWSRPGNMPVGMKLPLSLNFRSQAVSIGSTLYFMRSDPDGIVSYDMATGVWKQYIIPAPLHLTDHTLAECDGQVMLVGLLTKNAATCVCIWELQKMTLLWKEVDRMPNIWCLDFYGKHVRMTCLGNKGLLMLSLRSKQMNRLVTYNIAKKEWLKVPGCVVPRGRKRQWIACGTAFHPCLTAVV

SEQ ID NO: 10022 - protein, 462 aa, Glycine max
MEGLGMLKQLIGQLQQLLDTYQSQSHSSSTLILQPPHTLLFQQQHPRWTTSLDIEDSSVDDLCGLVMTARKSGSFRMSDPVKPPPSKKSRRDRSRGKSSGRSCTTEVMEQEIWKDFPEDLFEAVIARLPIATFFRFRSVCRQWNSMLTSQSFSLHCTQVTQESPWFYTITHENVNSGAMYDPSLKKWHHPTISTPPTKLIVLPVASAGGLVCFLDIGHRNFFVCNPLTQSFKELPVRSVKVWSRVAVGMTTNGNSVGSGYKILWVGCDGEYEVYDSVRNSWSRPGNMPAGMKLPLSINFRSQAVSIGSTLYFMRSDPEGIVSYDMATGVWKQYIIPAPLHLTDHTLAECDGQIMLVGLLTKNAATCVCIWELQKMTLLWKEVDRMPNIWCLDFYGKHVRMTCLGNKGLLMLSLRSKQMNRLVTYNIAKKEWLKVPGCVVPRGRKRQWIACGTAFHPCLTAVA

SEQ ID NO: 10023 - protein, 462 aa, Glycine max
MEGLGMLKQLIGQLQQLLDTYQSQSHSSSTLILQPPHTLLFQQQHPRWTTSLDIEDSSVDDLCGLVMTARKSGSFRMSDPVKPPPSKKSRRDRSRGKSSGRSCTTEVMEQEIWKDFPEDLFEAVIARLPIATFFRFRSVCRQWNSMLTSQSFSLHCTQVTQESPWFYTITHENVNSGAMYDPSLKKWHHPTISTPPTKLIVLPVASAGGLVCFLDIGHRNFFVCNPLTQSFKELPVRSVKVWSRVAVGMTTNGNSVGSGYKILWVGCDGEYEVYDSVRNSWSRPGNMPAGMKLPLSINFRPQAVSIGSTLYFMRSDPEGIVSYDMATGVWKQYIIPAPLHLTDHTLAECDGQIMLVGLLTKNAATCVCIWALQKMTLLWKEVDRMPNIWCLDFYGKHVRMTCLGNKGLLMLSLRSKQMNRLVTYNIAKKEWLKVPGCVVPRGRKRQWIACGTAFHPCLTAVA

SEQ ID NO: 10024 - protein, 468 aa, Citrus trifoliata
MGELAMLRQLIGQLQQFLQLYGSFPPHNTDSCFLYFHSHQHQQLPEEQTHQLHRWCLPEVDDSAADDYYGFVMAAGKSGSCKMLEPVKPPPSKRSRKERNRGKLAGSTSTAEAMEQEIWKEFPEDLYEAVIARLPIATFFRFRSVCQKWNSLLESHSFSQHCAQVPQGNPWFYTITHENVNSGAMYDPSLKKWHHPTISSLPTKMIILPVASARGLVCFLDIGHRNFYVCNPLTQSFKELPARSVKVWSRVAVGMTLNGNSTSSGYKILWVGCDGEYEIYDSLRNSWTRPGSMPSNIKLPLSLNFRSQAVSVDGILYFMRSDPEGIVSYNMVTGVWKQFIIPAPLHLNDHTLAECGGRIMLVGLLTKNAATCVCIWELQKMTLLWKEVDRMPNIWCLDFYGKHVRMTCLGNKGLLMLSSRSRQMNRLVTYNVMSREWLKVPGCVVPRGRKRQWIACGTAFHPCLTATA

SEQ ID NO: 10025 - protein, 472 aa, Malus x domestica
MEGLAMLRQLIGQLQELVGSHPPPPHYHHHLQLQFQPPPLLRHHHSQQPPQDHHHHLRWCPINVDEGSADDYYSIMMAAGKSRSFKMLEPCKPPPTKRSRKEQTRGKSSGTTNTTEPMEQHIWKDFPEDLYEAVIARLPVATFFRFRTVCRKWNSLLDSESFSQHCAEVPQATPWFYTITHENVNSGAMYDPSLKKWHHPTIFSLPTKLIVLPVASAGGLVCFLDIGNRNFYVCNPLNQSFKELPARSVKVWSRIAVGMTLNRSSASGGYKILWVVCDGEYEVYDSVTNSWTRPGIMPSGVKLPLSLNFRSQAVSIDGTLYFMRSDPEGIVSYDMATGIWKQFIIPTPLHLTDHTLAECGGRIMLVGLLSKNAVTCVCIWELQKMTLLWKEVDRMPNIWCLEFYGKHVRMTCLGNKGLLMLSLRSRQMTRLVTYNVSSREWLKVPGCVVPRGKKRQWIACGTAFYPSLTAVA

SEQ ID NO: 10026 - protein, 470 aa, Ricinus communis
MEEELAMLRQLIGQLHDLLNLYGSPPPPLPPPFHLRHQPFLELRNHHHHHVDNRNRWCVLDINDGSADDYCDLVMAAGKSGRCKMLEPSKPPPSKKSKKERNRGKLLGTTNTTEVMEEEIWKDFPEDLFEAVIARLPIATFFRFRTVCRKWNSLLSSESFSQHCTKVLQANPWFYTITHENVNSGAIYDPSLKKWHHPTISSLPTKMIVLPVASAGGLVCFIDIGHRNFYVCNPLTQSFKELPARSVKVWSRIAVGMTLNGSATSGGYKILWVCCDGEYEVYDSLKNSWIRPGSMPANIKLPLLLNFRSQAVSIDATVYFMRSDPEGIVSYNMVTGVWRQFIIPAPLHLSDHTLAEYGGRIMLVGLLSKNAATCVCIWELQKMTLLWKEVDRMPNIWCLEFYGKHVRMTCLGNKGLLMLSLRSRQMNRLVTYNVKSREWLKVPGCLVPRGRKRQWIACGTAFYPCLTATA

SEQ ID NO: 10027 - protein, 522 aa, Vitis vinifera
MIRSQVSKRRIRQQSNKGRVGELRGKNIRGERGRRRRRREEERRTAEAVAEVVEERRDGRRGMEGLAMLRQLIGEVQELCELYGSSNYIPHQPHTQLLYHHHQHSHRWCFSNFDDDSAEDDYCDPIMRSGKSGTLKTMETYEPPPTKKSRKERNRGKLPGTTNSAEVMEQEIWKEFPEDLFEAVIARLPIATFFRFRLVCRKWNSLLNSNSFSQHCAQVPQGHPWFYTITHENVDPGAMYDPSLKKWHHPTIPSLRAKTVLPVASAGGLVCFLDINHRNFFVCNPLTQSFKELPARSVRVWSRVAVGMTLNGNSTTAGYKILWVGCDGEYEVYDSVKNSWARPGSMPLHVKLPLSLNFLSQAVSIDGTIYLMRSDPDGIVSYDMVTGAWKQFIIPAPLHLTDHTLAECGGRIMLVGLLTKNAATCVCIWELQKMMLLWKEVDRMPNIWCLEFYGKHVRMTCLGNKGLLMLSLRSRQMNRLVTYNVLSREWLKVPGCVVPRGGKKRQWIACGTAFHPCLTASA

SEQ ID NO: 10028 - protein, 481 aa, Populus trichocarpa
MEEELAMLRQFIGQLQDLLNLYGSPLPPFDSLQPFHFHNHQQQNHNNGNNNRIFFFLLLAASTLIYRWCFLNLDDGSADDYCSLVMAAGKSGSFKMLEPCKPPPSKKPRKERNRGKSLGTTSSTEVMQQEIWKEFPEDLFEAVIARLPITTFFRFRSVCRKWNSFLDSQSFSQHCAQVPQSNPWFYTIAHENVNSGAMYDPSLKKWHHPTISYLPTKTIVLPVASAGGLVCFLDIGHRNFYVCNPLTQSFKELPPRSVKVWSRVAVGMTLNSNAASGGYKILWVCCDGEHEVYDSLKNSWTRPGSMPSCIKLPLSLNFRSQAVSLGGTLYFMRSDPEGIVSYNMVTGVWKQSIIPAPHHLSDRTLAQCEGRIILVGLLTKNAATCVCIWELQKMTLLWKEVDRMPNIWCLDFYGKHVRMTCLGNSGLLMLSLRSRQMNRLVTYNVVSREWLKVPGCLVPRGRKRQWIACGTAFNPCLTATA

SEQ ID NO: 10029 - protein, 453 aa, Glycine max
MEEEEEGLAMLITHLHHFSHSLSPLFFTLHPPLLSHQLPRLSFFDIDDYSLDDFCGLVMAAGKSGSSRMLEPLKHPSKKSRRDRSLGKSSGRSSRDEAMEQQIWKKLPEDLFEPVIARLPIATFFCFRSVCQRWNSLLTSQSFSQHCAQVPQANPWFYTVTHEHANSGAMYDPSMKKWYHPTISTLPAELIVLPVASAGGLVCFLDIYRQNFYVCNPLTQSLKELPARSVRVGSRASVGMTVNGNSTSAGYKILLVGCDGEYEIYDSVTKSWSHPENMPADIKLPLSLNFRSQAVSIDSTLYFMHSDPEGIVLYDMATGVWTQYIIPAPLHLTDHMLAECDGRILLVGLLTKNAATCICIWELQKMTFLWKEVDRMPNVWCLDFYGKHVRMTCLGNKGLLMLSLRSRQMNRLVTYNIASREWVKVPACLVPHGRKRQWVAHGTAFYPCLTAMA

SEQ ID NO: 10030 - protein, 462 aa, Glycine max; identical to SEQ ID NO: 10022

SEQ ID NO: 10031 - protein, 619 aa, Medicago truncatula
MEQVTSSSSSKTLFLFWAILVFDLVLKASSNVEGDALNALKSNLNDPNNVLQSWDATLVNPCTWFHVTCNGDNSVTRVDLGNAELSGTLVSQLGDLSNLQYLELYSNNITGKIPEELGNLTNLVSLDLYLNHLSGTIPTTLGKLLKLRFLRLNNNTLTGHIPMSLTNVSSLQVLDLSNNDLEGTVPVNGSFSLFTPISYQNNRRLIQPKNAPAPLSPPAPTSSGGSNTGAIAGGVAAGAALLFAAPAIALAYWRKRKPQDHFFDVPAEEDPEVHLGQLKRFSLRELLVATDNFSNKNILGRGGFGKVYKGRLADSTLVAVKRLKEERTQGGELQFQTEVEMISMAVHRNLLRLRGFCMTSTERLLVYPYMANGSVASCLRERNEVDPPLEWPMRKNIALGSARGLAYLHDHCDPKIIHRDVKAANILLDEEFEAVVGDFGLAKLMDYKDTHVTTAVRGTIGHIAPEYLSTGKSSEKTDVFGYGVMLLELITGQRAFDLARLANDDDVMLLDWVKGLLKDKKLETLVDAELKGNYEDDEVEQLIQVALLCTQGSPMERPKMSEVVRMLEGDGLAEKWEQWQKEETYRQDFNNNHMHHHNANWIVVDSTSHIQPDELSGPR

SEQ ID NO: 10032 - protein, 616 aa, Glycine max
MERVTSSFMGSFFFWAILVLDLVLKASGNQEGDALNALKSNLQDPNNVLQSWDATLVNPCTWFHVTCNSDNSVTRVDLGNADLSGQLVSQLGQLTNLQYLELYSNKITGKIPDELGNLTNLVSLDLYLNTLNGPIPTTLGKLAKLRFLRLNNNSLTGGIPISLTNVSSLQVLDLSNNHLKGEIPVNGSFSLFTPISYQNNLGLIQPKYTPSPVSPTPPPASSGNSNTGAIAGGVAAGAALLFAAPAIALAYWRRRKPQDHFFDVPAEEDPEVHLGQLKRFSLRELQVATDNFSNKHILGRGGFGKVYKGRLADGSLVAVKRLKEERTQGGELQFQTEVEMISMAVHRNLLRLRGFCMTPTERLLVYPYMANGSVASCLRERQESQPPLGWPERKRIALGSARGLAYLHDHCDPKIIHRDVKAANILLDEEFEAVVGDFGLAKLMDYKDTHVTTAVRGTIGHIAPEYLSTGKSSEKTDVFGYGVMLLELITGQRAFDLARLANDDDVMLLDWVKGLLKDRKLETLVDADLQGSYNDEEVEQLIQVALLCTQGSPMERPKMSEVVRMLEGDGLAEKWEQWQKDETFRQDFNNNIHHPNANWIVDSTSHIQADELSGPR

SEQ ID NO: 10033 - protein, 620 aa, Glycine max
MNLHMERVTSSFMGSFFFWAILVLDLVLKASGNQEGDALNALKSNLQDPNNVLQSWDATLVNPCTWFHVTCNSDNSVTRVDLGNADLSGQLVSQLGQLTNLQYLELYSNKITGKIPDELGNLTNLVSLDLYLNTLNGPIPTTLGKLAKLRFLRLNNNSLTGGIPISLTNVSSLQVLDLSNNHLKGEIPVNGSFSLFTPISYQNNLGLIQPKYTPSPVSPTPPPASSGNSNTGAIAGGVAAGAALLFAAPAIALAYWRRRKPQDHFFDVPAEEDPEVHLGQLKRFSLRELQVATDNFSNKHILGRGGFGKVYKGRLADGSLVAVKRLKEERTQGGELQFQTEVEMISMAVHRNLLRLRGFCMTPTERLLVYPYMANGSVASCLRERQESQPPLGWPERKRIALGSARGLAYLHDHCDPKIIHRDVKAANILLDEEFEAVVGDFGLAKLMDYKDTHVTTAVRGTIGHIAPEYLSTGKSSEKTDVFGYGVMLLELITGQRAFDLARLANDDDVMLLDWVKGLLKDRKLETLVDADLQGSYNDEEVEQLIQVALLCTQGSPMERPKMSEVVRMLEGDGLAEKWEQWQKDETFRQDFNNNIHHPNANWIVDSTSHIQADELSGPR

SEQ ID NO: 10034 - protein, 620 aa, Medicago truncatula
MNINMEQVASSSTVSFLFWAILVLHLLLKASSNDESDALFAFRNNLNDPNNALQSWDATLVNPCTWFHITCSGGRVIRVDLANENLSGNLVSNLGVLSNLEYLELYNNKITGTIPEELGNLTNLESLDLYLNNISGTIPNTLGNLQKLRFLRLNNNSLTGVIPISLTNVTTLQVLDVSNNNLEGDFPVNGSFSLFTPISYHNNPRIKQPKNIPVPLSPPSPASSGSSNTGAIAGGVAAAAALLFAAPAIALAYWKKRKPQDHFFDVPAEEDPEVHLGQLKRFSLHELLVATDHFSNENIIGKGGFAKVYKGRLADGTLVAVKRLKEERSKGGELQFQTEVEMIGMAVHRNLLRLRGFCVTSTERLLVYPLMANGSVASCLRERNDSQPPLDWPMRKNIALGAARGLAYLHDHCDPKIIHRDVKAANILLDDEFVAVVGDFGLARLMAYKDTHVTTAVQGTLGHIPPEYLSTGKSSEKTDVFGYGTMLLELTTGQRAFDLARLAGDDDVMLLDWVKGLLQDKKLETLVDAELKGNYDHEEIEKLIQVALLCTQGSPMERPKMSEVVRMLEGDGLSEKWEQWQKEETNRRDFNNNHMHHFNTNWIVVDSTSHIQADELSGPR

SEQ ID NO: 10035 - protein, 615 aa, Arabidopsis thaliana
MERRLMIPCFFWLILVLDLVLRVSGNAEGDALSALKNSLADPNKVLQSWDATLVTPCTWFHVTCNSDNSVTRVDLGNANLSGQLVMQLGQLPNLQYLELYSNNITGTIPEQLGNLTELVSLDLYLNNLSGPIPSTLGRLKKLRFLRLNNNSLSGEIPRSLTAVLTLQVLDLSNNPLTGDIPVNGSFSLFTPISFANTKLTPLPASPPPPISPTPPSPAGSNRITGAIAGGVAAGAALLFAVPAIALAWWRRKKPQDHFFDVPAEEDPEVHLGQLKRFSLRELQVASDNFSNKNILGRGGFGKVYKGRLADGTLVAVKRLKEERTQGGELQFQTEVEMISMAVHRNLLRLRGFCMTPTERLLVYPYMANGSVASCLRERPESQPPLDWPKRQRIALGSARGLAYLHDHCDPKIIHRDVKAANILLDEEFEAVVGDFGLAKLMDYKDTHVTTAVRGTIGHIAPEYLSTGKSSEKTDVFGYGVMLLELITGQRAFDLARLANDDDVMLLDWVKGLLKEKKLEALVDVDLQGNYKDEEVEQLIQVALLCTQSSPMERPKMSEVVRMLEGDGLAERWEEWQKEEMFRQDFNYPTHHPAVSGWIIGDSTSQIENEYPSGPR

SEQ ID NO: 10036 - protein, 620 aa, Gossypium hirsutum
MKENMTQRLISFCLWLIFVFDLAFRVAGNAEGDALNALKTNMVDPNNVLQSWDPTLVNPCTWFHVTCNSENSVTRVDLGNANLTGQLVPQLGSLPNLQYLELYSNNISGTIPDELGNLTELVSLDLYLNKLTGDIPTTLGQLKKLRFLRLNNNSLAGTIPRSLTTIDTLQVLDLSNNGLVGDVPVNGSFSLFTPISFANNKLNNPPPAPPPPIPPTPPAQSGISSTGAIAGGVAAGAALLFAAPAIVLALWRKRKAPDHFFDVPAEEDPEVHLGQLKRFSLRELQVATDNFSNKNILGRGGFGKVYKGRLADGSLVAVKRLKEERTQGGELQFQTEVEMISMAVHRNLLRLRGFCMTPTERLLVYPFMVNGSVASCLRERSESQPALDWAIRKRIALGAARGLAYLHDHCDPKIIHRDVKAANILLDEEFEAVVGDFGLAKLMDYKDTHVTTAVRGTIGHIAPEYLSTGKSSEKTDVFGYGVMLLELITGQRAFDLARLANDDDVMLLDWVKGLLKERKLETLVDSDLNGNYIDEEVEQLIQVALLCTQGTPMERPKMSEVVRMLEGDGLAERWEEWQKEEMVRQEFNQAHHYSHHQPNANWIIADSTSHIPPDELSGPR

SEQ ID NO: 10037 - protein, 615 aa, Arabidopsis thaliana
MERRLMIPCFFGLILVLDLVLRVSGNAEGDALSALKNSLADPNKVLQSWDATLVTPCTWFHVTCNSDNSVTRVDLGNANLSGQLVMQLGQLPNLQYLELYSNNITGTIPEQLGNLTELVSLDLYLNNLSGPIPSTLGRLKKLRFLRLNNNSLSGEIPRSLTAVLTLQVLDLSNNPLTGDIPVNGSFSLFTPISFANTKLTPLPASPPPPISPTPPSPAGSNRITGAIAGGVAAGAALLFAVPAIALAWWRRKKPQDHFFDVPAEEDPEVHLGQLKRFSLRELQVASDNFSNKNILGRGGFGKVYKGRLADGTLVAVKRLKEERTQGGELQFQTEVEMISMAVHRNLLRLRGFCMTPTERLLVYPYMANGSVASCLRERPESQPPLDWPKRQRIALGSARGLAYLHDHCDPKIIHRDVKAANILLDEEFEAVVGDFGLAKLMDYKDTHVTTAVRGTIGHIAPEYLSTGKSSEKTDVFGYGVMLLELITGQRAFDLARLANDDDVMLLDWVKGLLKEKKLEALVDVDLQGNYKDEEVEQLIQVALLCTQSSPMERPKMSEVVRMLEGDGLAERWEEWQKEEMFRQDFNYPTHHPAVSGWIIGDSTSQIENEYPSGPR

SEQ ID NO: 10038 - protein, 617 aa, Ageratina adenophora
MDRIVSVISASVLVWLILVFNNLSIVYGNAEGDALNALKTQLGDPNNVLQSWDATLVNPCTWFHVTCNNENSVTRVDLGNANLSGQLVPQLGQLTNLQYLELYSNNITGKIPNELGNLTNLVSLDLYLNRLDGVIPETLGKLQKLRFLRLNNNTLTGTIPMSLTTITSLQVLDLSNNNLSGDVPVNGSFSLFTPISFAGNPNLIAPPVPPQAPTPPSSQSPSVGNSATGAIAGGVAAGAALLFAGPAIALAWWRRRKPQDHFFDVPAEEDPEVHLGQLKRFSLRELQVATDNFSNRHILGRGGFGKVYKGRLADGTLVAVKRLKEERTQGGELQFQTEVEMISMAVHRNLLRLKGFCMTPTERLLVYPYMANGSVASCLRERPDTQEPLDRPIRKRIALGSARGLAYLHDHCDPKIIHRDVKAANILLDEEFEAVVGDFGLAKLMDYKDTHVTTAVRGTIGHIAPEYLSTGKSSEKTDVFGYGVMLHELITGQRAFDLARLANDDDVMLLDWVKGLLREKKLETLVDADLKGNYIDAEVEQLIQVALLCTQGTPLERPKMSEVVRMLEGDGLAERWEEWQKEEMFRHEFNTTHNPNTDWIIADSTYNLRPDELSGPR

SEQ ID NO: 10039 - protein, 612 aa, Arabidopsis lyrata subsp. lyrata
MIPYFFWLILVLDLVLRVSGNAEGDALSALKNSLADPNKVLQSWDATLVTPCTWFHVTCNSDNSVTRVDLGNANLSGQLVMQLGQLPNLQYLELYSNNITGTIPEQLGNLTELVSLDLYLNNLSGPIPSTLGRLKKLRFLRLNNNSLSGEIPRSLTAVLTLQVLDLSNNGLTGDIPVNGSFSLFTPGLISFANTKLTPLPASPPPPISPTPPSPAGSNRITGAIAGGVAAGAALLFAVPAIALAWWRRKKPQDHFFDVPAEEDPEVHLGQLKRFSLRELQVASDNFSNRNILGRGGFGKVYKGRLADGTLVAVKRLKEERTQGGELQFQTEVEMISMAVHRNLLRLRGFCMTPTERLLVYPYMANGSVASCLRERPESQPPLDWPKRQRIALGSARGLAYLHDHCDPKIIHRDVKAANILLDEEFEAVVGDFGLAKLMDYKDTHVTTAVRGTIGHIAPEYLSTGKSSEKTDVFGYGVMLLELITGQRAFDLARLANDDDVMLLDWVKGLLKEKKLEALVDVDLQGNYIDEEVEQLIQVALLCTQSSPMERPKMSEVVRMLEGDGLAERWEEWQKEEMFRQDFNYPTHHPAVSGWIIGDSTSQIENEYPSGPR

SEQ ID NO: 10040 - protein, 620 aa, Gossypium hirsutum
MKENMTRRLISFCLWLIFVLDLAFRVAGNAEGDALNALKTNMADPNNVLQSWDPTLVNPCTWFHVTCNSENSVTRVDLGNANLTGQLVPQLGSLPNLQYLELYSNNISGMIPDELGNLTELVSLDLYLNKLTGDIPTTLGQLKKLRFLRLNNNSLVGTIPLSLTTIDTLQVLDLSNNGLIGDVPVNGSFSLFTPISFANNKLNNPPPAPPPPIPPTPPAQSGISSTGAIAGGVAAGAALLFAAPAIVLALWRKRKAPDHFFDVPAEEDPEVHLGQLKRFSLRELQVATDNFSNKNILGRGGFGKVYKGRLADGSLVAVKRLKEERTQGGELQFQTEVEMISMAVHRNLLRLRGFCMTPTERLLVYPFMVNGSVASCLRERSEFQPALDWAIRKRIALGAARGLAYLHDHCDPKIIHRDVKAANILLDEEFEAVVGDFGLAKLMDYKDTHVTTAVRGTIGHIAPEYLSTGKSSEKTDVSGYGVMLLELITGQRAFDLARLANDDDVMLLDWVKGLLKERKLETLVDSDLNGNYIDEEVEQLIQVALLCTQGTPMERPKMSEVVRMLEGDGLAERWEEWQKEEMVRQEFNQAHHYNHHQPNANWIIADSTSHIPPDELSGPR

SEQ ID NO: 10041 - protein, 374 aa, Glycine max
MGFTFSTMTLNLVLLMAMVATNILSLYHLSSTLQSPKSPKPPPPVPDQLLHQLHTIRATISHLTRLQNTHNPAQKSTIPSDLLLYSHLSPIASSCHNHPELLHKYMTYIPFSLCPSDSDLAESLILRGCHPLPRRRCFSKTPQKPPVSLPENPFPSSLPDNAVIWDHYSCKSFDCLNKQNPNLGFEPSRDISRFNSYKTDLDLPIQQLLQIAAAAKSALRLGLDVGGGTGSFAASMRLRNVTVVTTTMNVAVPNSEAVALRGLVPLHVPLQQRLPLFDGVVDLVRCGRAVNRWIPLTVMEFLLLDVDRVLRGGGYLWVDHFFSKVVDLEKVYAPLIGKLGYKKVKWATGNKTDASGVKNGEVYLTALLQKPVSR

SEQ ID NO: 10042 - protein, 376 aa, Populus trichocarpa
MGFSMGLNLVLLLAMVATNILSLYHLSSTLQSPKPPTQQPVPDHLLHQLNTIRATISHLTRHQPPSITPSPTSTKPSIPQDLLLYSHLSPIASSCHNHPDLLHKYMAYTPYSLCPLDSDLLAESLILHGCHPLPRRRCFSKTPPKPPSSLPRNPFPSSFLDSNVIWNKYPSCKSFSCLAKKSPGLGFDLNTEISKFMTYKTELDLPVPQLLQVAKSANSAIRLGIDIGGATGTFAARMKQYNVTVVTTTMNFNVPNNEVVAMRGLVPLHVPLQQRLPVFDGVVDLVRCAHAVNRWIPLTMMEFLFYDVDRVLRGGGYLWFDHFFCKRMDLDKVFGPLIGKLGYKKVKWAVGNKTDSSGLKNEEVYLTALLQKPVSK

SEQ ID NO: 10043 - protein, 375 aa, Populus trichocarpa
MGFTMGLNLVLVLAMVATNILSLYHLSSRVQSPKPPSDQQPVPDHLLHQLNTIRATISHLTRHQPPSTTPSPTTTKPSVPQDLLLYSHLSPIASSCHNHPDLLHKYMSYSPYSLCPLDSDLLAESLILHGCHPLPRRRCFSKTPPKPPSSLPRNPFPSSFLDSNVIWNKYPTCRSFSCLAKQNPSLGFDLNNEISKFMTYKTELDLPIPQLLQVAKSADSVIRLGIDIGGATGTFAARMKQYNVTVVTTTMNFNVPNNEVVAMRGLVPLHVPLQHRLPVFDGVVDLVRCGHAVNRWMPLTMMEFLFYDVDRVLRGGGYLWFDHFFSKRVDLDKVFGPLIGKLGYKKVKWAVGNKTDSSGLKNGEVYLTALLQKPV

SEQ ID NO: 10044 - protein, 377 aa, Ricinus communis
MGFTMGLNLLLLLAMVATNILSLYHLTSPTLQSPKPPQPPLLQVPDHLLHQLQTIRATINHLTRHQPPTTSDPTTATTIPPDLLLYSKLSPIASSCHNHPDLLHKYMTYTPFSLCPLDSDNLAESLILRGCHPLPRRRCFSKTPSKPPSSLPHNPFPSSFLDSNVLWEKYPSCRSFSCLVKENSNLGFDINTEISKFMTYKTELDLPIPQLLQVAKSASSVIRLGVDIGGGTGTFAARMKMYNVTVVTTTMNFNVPNNEVVAMRGLVPLHVPLQQRLPMFDGVVDLVRCGRAVNRWIPLKMMEFLLFDVDRVLRGGGYLWLDHFFSKRADLDKIYGPLIGKLGYKKVKWAVGNKTDSSGIKNGEVYLTALLQKPVSR

SEQ ID NO: 10045 - protein, 306 aa, Glycine max
MAIFTSARNVARYTKINALTTSSSCHNHPELLHKYMTYTPFSLCPSDSDLAESLILRGCHPLPRRRCFSKTPQKQIPPNSLPKNPFPSSLPDNAVIWDHYQCKSFDCLNKQNPNLGFQPSRDISRFNSYKTDLDLPIQQLFQIAAAAKSVLRLGLDVGGGTGSFAAAMRLRNVTVVTTTMNVVAPNSEAVALRGLVPLHMPLQQRLPLFDGVLDLVRCGRAVNRWIPLTVMEFLLLDVDRVLRGGGYLWVDHFFSKGVDLEKVYAPLIGKLGYKKVKWATGNKTDAGGVKNGEVYLTALLQKPVSR

SEQ ID NO: 10046 - protein, 366 aa, Vitis vinifera
  misc_feature (190)..(190): Xaa can be any naturally occurring amino acid
MGLTMGLNLLLLVAMVATNILSLYHLSSTIQSKPTPPPAPVPDHLRHQLNTIRATLTHLTRLRSTSSSSASSATPSDLLLYTHLSPMASSCRDHPDLLHTYMTYTPFSLCPDDSQLAESLILRGCHPLPRRRCFARTPSKLPSSLPADPFSPLPDSAVLWTKYSCKSFSCFDGGLGFNMKLEASRFTSSXSNLDLTIPQLLQIAKDASSVIRIGLDIGGGTGTFAAKMKPYNVTVVSTTMSQGAPYNEATALRGLVPLHAPLQQRLPVFDGVVDLVRCGRAVNRWIPTVAMEFFFYDVDRVLRGGGYLWLDHFFSKGADLQKLYAPVIGKLGYKKVKWTMANKTDSSGVKNGEVYLTALLQKPVSR

SEQ ID NO: 10047 - protein, 366 aa, Vitis vinifera
MGLTMGLNLLLLVAMVATNILSLYHLSSTIQSKPTPPPAPVPDHLRHQLNTIRATLTHLTRLRSTSSSSASSATPSDLLLYTHLSPMASSCRDHPDLLHTYMTYTPFSLCPDDSQLAESLILRGCHPLPRRRCFARTPSKLPSSLPADPFSPLPDSAVLWTKYSCKSFSCFDGGLGFNMKLEASRFTSSGSNLDLTIPQLLQIAKDASSVIRIGLDIGGGTGTFAAKMKPYNVTVVSTTMSQGAPYNEATALRGLVPLHAPLQQRLPVFDGVVDLVRCGRAVNRWIPTVAMEFFFYDVDRVLRGGGYLWLDHFFSKGADLQKLYAPVIGKLGYKKVKWTMANKTDSSGVKNGEVYLTALLQKPVSR

SEQ ID NO: 10048 - protein, 252 aa, Glycine max
MTDGSWNRQQQPFLPSSAMLKRPRTEYDISPSGLTSGGNEMHNYIGRNDDHTGHRILKDTKTLGSAFDRYLQSAGLTSFNSGEASAIGSVGLERGVGGLPRHSLTDPAVMGHPGGGHDLARGGRNVNYGDQLPVDAASMPGPETVPLPPDASSTLYVEGLPSDSTRREVAHIFRPFVGYREVRLVSKESKHRGGDPLILCFVDFANPACAATALSALQGYKVDELNPESSHLRLQFSRFPGPRSGPGPRGKR

SEQ ID NO: 10049 - protein, 244 aa, Glycine max
MTDGSWNRQQQPFLPSSAMLKRPRTEYGGNEMHNYIGRNDDHTGHRILKDTKTLGSAFDRYLQSAGQLTSFNSGEASAIGSVGLERGVGGLPRHSLTDPAVMGHPGGGHDLARGGRNVNYGDQLPVDAASMPGPETVPLPPDASSTLYVEGLPSDSTRREVAHIFRPFVGYREVRLVSKESKHRGGDPLILCFVDFANPACAATALSALQGYKVDELNPESSHLRLQFSRFPGPRSGPGPRGKR

SEQ ID NO: 10050 - protein, 251 aa, Glycine max
MTDGSWNRQQSFLPPSAMLKRPRTEYDMSPSGLTSGGNEMHNYIARNDDHTGHRILKDTKTLGSAYDRYLQSAGLTSFNSGEASAISSVGLGRGVGGLPHHSLTDPAVTGHPGGGHDLSRNGRNVNYASQLPVDAASMPGPETLPLPPDASSTLYVEGLPSGSTRREVAHIFRPFVGYREVRLVSKESKHRGGDPLILCFVDFANPACAATALSALQGYKVDELNPESSHLRLQFSRFPGPRSGPGLRGKR

SEQ ID NO: 10051 - protein, 251 aa, Glycine max
MTDGFWNRQQPLHPSSTMLKRPRTEYDMSPSGLTSGGNEMHNYIARNDDHTGHRMLKDTKTIGSAYDRYLQSAGLTSFNSGEASAVGGVGLGRGAGGLPHHSLTDPAVMGHPGGGHDHARNGRNVNYGGQLPLDAASMPGPETVPLPPDASSTLYVEGLPSDSTRREVAHIFRPFVGYREVRLVSKESKHRGGDPLILCFVDFANPACAATALSALQGYKVDELNPESSHLRLQFSRFPGPRSGPGPRGKR

SEQ ID NO: 10052 - protein, 251 aa, Glycine max
MTDGFWNRQQPLHPSSTMLKRPRTEYDMSPSGLTSGGNEMHNYIARNDDHTGHRMLKDTKTIGSAYDRYLQSARLTSFNSGEASAVGGVGLGRGAGGLPHHSLTDPAVMGHPGGGHDHARNGRNVNYGGQLPLDAASMPGPETVPLPPDASSTLYVEGLPSDSTRREVAHIFRPFVGYREVRLVSKESKHRGGDPLILCFVDFANPACAATALSALQGYKVDELNPESSHLRLQFSRFPGPRSGPGPRGKR

SEQ ID NO: 10053 - protein, 252 aa, Glycine max
MTDGFWNRQQQQPLQPSSAMLKRPRTEYDMSPSGLTGGNEMHNYIARNDDHTGHRMLKDTKTLGSAYDRYLQSAGLTSFNSGEASAIGGVGLGRGVGGLPRHSLTDPAVMGHPGGGHDLARNGRNVNYGGQLTVDAASMPGPETVPLPPDASSTLYVEGLPSDSTRREVAHIFRPFVGYREVRLVSKESKHRGGDPLILCFVDFANPACAATALSALQGYKVDELNPESSHLRLQFSRFPGPRSGPGPRGKR

SEQ ID NO: 10054 - protein, 243 aa, Glycine max
MTDGSWNRQQSFLPPSAMLKRPRTEYGGNEMHNYIARNDDHTGHRILKDTKTLGSAYDRYLQSAGQLTSFNSGEASAISSVGLGRGVGGLPHHSLTDPAVTGHPGGGHDLSRNGRNVNYASQLPVDAASMPGPETLPLPPDASSTLYVEGLPSGSTRREVAHIFRPFVGYREVRLVSKESKHRGGDPLILCFVDFANPACAATALSALQGYKVDELNPESSHLRLQFSRFPGPRSGPGLRGKR

SEQ ID NO: 10055 - protein, 245 aa, Glycine max
MTDGFWNRQQQQPLQPSSAMLKRPRTEYGGNEMHNYIARNDDHTGHRMLKDTKTLGSAYDRYLQSAGQLTSFNSGEASAIGGVGLGRGVGGLPRHSLTDPAVMGHPGGGHDLARNGRNVNYGGQLTVDAASMPGPETVPLPPDASSTLYVEGLPSDSTRREVAHIFRPFVGYREVRLVSKESKHRGGDPLILCFVDFANPACAATALSALQGYKVDELNPESSHLRLQFSRFPGPRSGPGPRGKR

SEQ ID NO: 10056 - protein, 252 aa, Medicago truncatula
MADGFWNRQQQHLPPPGGMLKRPRTEYDTAPSGVTSGNEVHNYIAQNNGHQMLNDTKILGSAYDRFLQSAGLTSFNSGEASVIGGVGFARGVGELPGHSLGDPSAMGHLSGVGGGPDLSRNGRDVNFGGQLPIDAVSRPGPETIPLPRDASSTLYVEGLPSDSTKREVAHIFRPFVGYREVRLVAKESKHRGGDPLILCFVDFANPACAATALSALQGYKVDEINPESSYLRLQFSRSPGRRSGGPGPRGKR

SEQ ID NO: 10057 - protein, 242 aa, Glycine max
MTDGYWNRQQTLLSQSGMLKRPRSDYGNEMHNNFARDDDRTGHRMLKDTKTIGSAYDRYLQSGQLSSFTSGEASTVGGLGLARGGGGLSDHSLADPSVMGRHGGGGPDLAPNGRGVNYGGQLPVDAVSRPGPETVSLPPDASSTLYVEGLPSDSTRREVAHIFRPFVGYREVRLVSKESKHRGGDPHYLCFVDFANPACAATAMSALQGYKVDELNPESSHLRLQFSRYPGPRSGPAFRGKR

SEQ ID NO: 10058 - protein, 453 aa, Glycine max; identical to SEQ ID NO: 10029

SEQ ID NO: 10059 - protein, 454 aa, Glycine max
MEEEEGLAMLITHLHLHLHHFSHSLSPPFTLHPPVSHQLPRFSFFDIDDYSVDDFCGLVMAAGKSGSSRMMEPLKHPSKKSRRDRSCGKSSGRSSRDEAMEQQIWKNLPEDLFEPVIARLPIATFFRFRSVCQRWNSLLSSQSFSLHCAQVKQANPWFYTVTHEHANSGAMYDPSMKKWYHPTISTLPAELIVLPVASAGGLVCFLDIYHQNFYVCNPLIQSLKELPARSVRVWARDAVGMTVNGNSTGAGYKILLVGCDGEYEIYDSLTKSWSHPEKMPSDIKLPLSLNFRSHAVSINSTLYFMHSDPKGIVSYDMATGVWTQYIIPAPLHLTDHMLAECDGRLLLVGLLTKNAATCICIWELQKMTFLWKEVDRMPNVWCLDFYGKHVRMTCLGNKDLLMLSLRSRQMNRLVTYNIASREWVKVPWCLVPHGRKRQWIAHGTAFYPCLSAMA

SEQ ID NO: 10060 - protein, 454 aa, Glycine max
MEEEEGLAMLIAHLHLHLHHFSHSLSPPFTLHPPVSHQLPRFSFFDIDDYSVDDFCGLVMAAGKSGSSRMMEPLKHPSKKSRRDRSCGKSSGRSSRDEAMEQQIWKNLPEDLFEPVIARLPIATFFRFRSVCQRWNSLLSSQSFSLHCAQVKQANPWFYTVTHEHANSGAMYDPSMKKWYHPTISTLPAELIVLPVASAGGLVCFLDIYHQNFYVCNPLIQSLKELPARSVRVWARDAVGMTVNGNSTGAGYKILLVGCDGEYEIYDSLTKSWSHPEKMPSDIKLPLSLNFRSHAVSINSTLYFMHSDPKGIVSYDMATGVWTQYIIPAPLHLTDHMLAECDGRLLLVRLLTKNAATCICIWELQKMTFLWKEVDRMPNVWCSDFYGKHVRMTCLGNKDLLMLSLRSRQMNRLVTYNIASREWVKVPWCLVPHGRKRQWIAHGTAFYPCLSAMA

SEQ ID NO: 10061 - protein, 450 aa, Glycine max; identical to SEQ ID NO: 10021

SEQ ID NO: 10062 - protein, 127 aa, Glycine max
MDVLTTLTADKPVVIFSKSTCCMSHTVKALICSFGASPTIIEVDKMPSGQQVERALIQLGCKPSVPAVFIGQQFIGGADEVIKLNVQNKLAQLLLGAKAIFIWSRTALFVLYIANYALTIYDDGHVM

SEQ ID NO: 10063 - protein, 105 aa, Glycine max
MDVVTSLTADKPVVIFSKSTCFMSHTVKALICSFGASPSVIELDKMQSGHQVERALIQLGCKPSVPAVFIGQQFIGGADEVIKLNVQNKLAQLLLGAKAIFIWSR

SEQ ID NO: 10064 - protein, 77 aa, Oryza sativa Japonica Group
MGGGNGQKSKMARERNMEKNKGAKGSQLEANKKAMNIQCKICMQTFICTTSETKCKEHAEAKHPKSDLTACFPHLKK

SEQ ID NO: 10065 - protein, 77 aa, Oryza sativa Indica Group
MGGGHGQKSKMARERNMEKNKGAKGSQLEANKKAMNIQCKICMQTFICTTSETKCKEHAEAKHPKSDLTACFPHLKK

SEQ ID NO: 10066 - protein, 77 aa, Zea mays
MGGGNGQKSKMARERNAEKNKGGKGSQLEANKKAMNIQCKICMQTFICTTSEAKCKEHAEARHPKNDLYQCFPHLKN

SEQ ID NO: 10067 - protein, 77 aa, Hordeum vulgare subsp. vulgare
MGGGNAQKSKMARERNLEKLKGGKGSQLEANKKAMNIQCKICMQTFICTTSEAKCKEHAEAKHPKSDLVQCFPHLKQ

SEQ ID NO: 10068 - protein, 77 aa, Sorghum bicolor
MGGGNGQKSKMARERNAEKNKGSKGSQLETNKKAMNIQCKICMQTFICTTSEAKCKEHAEARHPKNDLYQCFPHLKN

SEQ ID NO: 10069 - protein, 77 aa, Brachypodium distachyon
MGGGNAQKSKMARERNLEKLKGGKGSQLEANKKAMNIQCKICMQTFICTTSEAKCKEHAEAKHPKSELTQCFPHLKQ

SEQ ID NO: 10070 - protein, 77 aa, Zea mays
MGGGNAQKSKMARERNAEKNKGGKGSQLEANKKAMNIQCKICMQTFICTTSEAKCKEHAEARHPKNDLYQCFPHLKN

SEQ ID NO: 10071 - protein, 77 aa, Zea mays
MGGGNGQKSKMARERNLEKNKGAKGSQLETNKKAMSIQCKVCMQTFMCTTTEVKCREHAEAKHPKTDVYQCFPHLKK

SEQ ID NO: 10072 - protein, 77 aa, Glycine max
MGGGNGQKAKMARERNMEKNKPAKGSQLEANKKAMNIQCKVCMQTFICTTSEVKCREHAEAKHPKAHLYTCFPHLKN

SEQ ID NO: 10073 - protein, 77 aa, Vitis vinifera
MGGGNGQKSKTARERNMEKTKAAKGSQLESNKKAMTIQCKVCMQTFICTTSEAKCKEHAEAKHPKSELSTCFPHLKK

SEQ ID NO: 10074 - protein, 454 aa, Glycine max; identical to SEQ ID NO: 10059

SEQ ID NO: 10075 - protein, 465 aa, Medicago truncatula; identical to SEQ ID NO: 10020

SEQ ID NO: 10076 - protein, 578 aa, Ricinus communis
MAVSGAITPGQVSFLLGIIPVFVAWAYSEFLDYKKFSSPSKVHSDNNLVELEKETIKEDDRAVLLEGGLPRTASMKFHSASIKMNLIRFMTMDDAFLLEHRATLKAMSEFGAIMIFFYISDRTTLLGDSAKSYSRDLFLFLYFLLIIVSAMTSLKKHNDKSAFSGKAILYLNRHQTEEWKGWMQVLFLMYHYFAATEIYNAIRVFIAAYVWMTGFGNFSYYYIRKDFSLARFAQMMWRLNFFVAFCSIVLNNDYMLYYICPMHTLFTLMVYGALGIFNKYNENSSVMAVKILSCFLVVILIWEIPGVFDILWSPLFFLLGYTDPAKPDLPRMHEWHFRSGLDRYIWIIGMIYAYYHPNIEKWMEKLEESETKRRLSIKTGIVAVASLVGCLWYEYIYKLDKVTYNKYHPYTSWIPITVYICLRNCTQQLRNFSLTLFAWLGKITLETYISQFHIWLRSNVPNGQPKWLLSIIPEYPLLNFMLTTAIYVLVSHRLFELTNTLKTVFIPTKDNRRLFYNFVAGATISLFLYFVSLILLQIPHSLKKSVFNNLRGEMLSDALTELKLDTGFASVFGQHAEE

SEQ ID NO: 10077 - protein, 543 aa, Populus trichocarpa
MVVSGPITPGQVSFLLGFIPVFVAWIYSEFLEYKKTSSPQKVHSDNNLLDLEKETIKEDDRAVLLEGGLPRSASAKFHSSAIKMNLIRFMTLDDSFLLENRATLRAMSEFGAVLLYFYICDRTNILGESTKSYNRDLFVFLYILLIIVSSMTSLRKHTDKSAFTGKSMLYLNRHQTEEWKGWMQVLFLMYHYFAAAEIYNAIRIFIAAYVWMTGFGNFSYYYIRKDFSVARFSQMMWRLNFFVAFCCIILNNDYMLYYICPMHTLFTLMVYGALGIFNKYNENSSVMAVKILSCFLVVILIWEIPGVFDFLWSPLTFLLGYSDPAKPDLPRLHEWHFRSGLDRYIWIIGMIYAYFHPNIEKWMEKLEESETKKKLSMKTGIVAVSVSVGYLWYEYIYKLDKVSYNKYHPYTSWIPITVYICLRNCTQQLRSFSSTLFAWLGKITLETYISQFHIWLRSDIPNGQPKWLLSFIPEYPLLNFMLTTAIYVLVSHRLFELTNTLKTVFIPTKDNKRLFYNSVAGAAISVCLYCVAVILLHIPHSPA

SEQ ID NO: 10078 - protein, 565 aa, Populus trichocarpa
MVVSDGPIISAGQVAFLLGIIPIFVAWIYSEFLEYKKTSSLSKLHSDNNLLDLEKETIKEDDRAVLLEGGLPRSASAKFHSSATKMNLIRFMTMDDSFLLENRTTLRVMSEFGAVLVYFYICDRTNILGESTKNYNRDLFVFLYLLLIIVSAMTSLRKHTDKSTFTGKSTLYLNRHQTEEWKGWMQVIFLMYHYFAATEIYNAIRVFIAAYVWMTGFGNFSYYYIRKDFSVARFAQMMWRLNLFVAFCCIVLNNDYMLYYICPMHTLFTVMVYGVLGIFNKYNENSSVIAVKILSCFLMVILIWETPGVFDILWSPLTFLLGYTDPAKPDLPRLHEWHFRSGLDRYIWIIGMIYAYFHPNVEKWMEKLEESEIKKKLSIKTGLVAVSLSVGYLWYECIYKLDKVSYNKYHPYTSWIPITVYICLRNCTQQLRSFSLTLFAWLGKITLETYISQFHIWLRSDMPNGQPKWLLSVIPEYPLLNFMLTTAIYVLVSHRLFELTNTLKTVFIPTKDNMRLFYNFVAGAAISLCLYCVAVILLHILHSAVSPSLVLENNMVASDDLELCS

SEQ ID NO: 10079 - protein, 546 aa, Vitis vinifera
MVVSSPITPGQVSFLLGIIPVFVAWIYSEFLEYKKSSSPSKVHSDNNLVELGSETIKEDDRAILLEGGLTKSASAKFNSSSIKVNLIRFLTMDDSFLLENRLTLRAMSEFGAILTYFYVCDRTELLGDSTKNYNRDLFIFLYLLLVIVCFMTSLKKHHDKSAFSGKALLYLNRHQTEEWKGWMQVLFLMYHYFAAAEIYNAIRVFIAAYVWMTGFGNFSYYYIRKDFSLARFTQMMWRLNFFVAFCCIVLNNDYMLYYICPMHTLFTLMVYGALGIFNKYNEIRSVMAVKILACFLVVILIWEIPGVFDIFWSPSAFLLGYSDPDPSKQGLPRLHEWHFRSGLDRYIWIIGMIYAYYHPNVEKWMEKLEETETKRRLTIKTSIVTVTVFVGYLWYEYIYKLDKVTYNKFHPYTSWIPITVYISLRNFTQQLRSYSLTLFAWLGKITLETYISQFHIWLRSNKPNGQPKWLLSFIPDYPLLNFMLTTAIYILISLRLFELTNTLKTVFIPTKDNRRLLHNFLAGIGISVCLYCIGFILHKIPHAQNP

SEQ ID NO: 10080 - protein, 543 aa, Glycine max
MVVSGPITPGQVSFLLGVIPVFVSWIYSEYLEYKKLSSPPKVHSDASLEELGKDAIKEDDRAILLESGLTRSASAKFHPPSVKLNLIRFLTMDDSFLLENRATLRAMAEFGLILFYFYICDRTNILGDSTKSYSRDLFIFLYLLLIIVSALSSLKKHNDSSTFSGKNILYLNRHQTEEWKGWMQVLFLMYHYFAATEIYNAIRVFIAAYVWMTGFGNFSYYYVRKDFSLPRFAQMMWRLNFFVAFCCIVLNNDYMLYYICPMHTLFTLMVYGALGIYNKYNEIPSVMAAKILACFLVVILVWEIPGFFDIFWSPFALFLGYTDPAKPDLPRMHEWHFRSGLDRYIWIIGMIYAYFHPNVEKWMEKLEESDTKRRVTIKTGIVSVALFVGYLWYEYIYKLDKVSYNKLHPYTSWIPITVYICLRNFSQRLRNFSLTLFAWLGKITLETYISQFHIWLRSNMPNGQPKWLLSLIPEYPMLNFMLTTAIYVFVSHRLFELTNTLKTVFIPTKDNRRLLHNFITGVTLCISLYCIALILLLIPHSTV

SEQ ID NO: 10081 - protein, 540 aa, Arabidopsis thaliana
MADSQPITPGQVSFLLGVIPVFIAWIYSEFLEYKRSSLHSKVHSDNNLVELGEVKNKEDEGVVLLEGGLPRSVSTKFYNSPIKTNLIRFLTLEDSFLIENRATLRAMAEFGAILFYFYISDRTSLLGESKKNYNRDLFLFLYCLLIIVSAMTSLKKHNDKSPITGKSILYLNRHQTEEWKGWMQVLFLMYHYFAAAEIYNAIRVFIAAYVWMTGFGNFSYYYIRKDFSLARFTQMMWRLNLFVAFSCIILNNDYMLYYICPMHTLFTLMVYGALGIFSRYNEIPSVMALKIASCFLVVIVMWEIPGVFEIFWSPLTFLLGYTDPAKPELPLLHEWHFRSGLDRYIWIIGMIYAYFHPTVERWMEKLEECDAKRKMSIKTSIIAISSFVGYLWYEYIYKLDKVTYNKYHPYTSWIPITVYICLRNSTQQLRNFSMTLFAWLGKITLETYISQFHIWLRSNVPNGQPKWLLCIIPEYPMLNFMLVTAIYVLVSHRLFELTNTLKSVFIPTKDDKRLLHNVLAGAAISFCLYLTSLILLQIPH

SEQ ID NO: 10082 - protein, 545 aa, Glycine max
MVVSGPITPGQVSFLLGVIPVFVSWIYSEYLEYKKPSSPPKVHSDVCLEELGKDAIKEDDRAILLESGLTRSASAKFHPSSVKLNLIRFLTMDDSFLLENRATLRAMAEFGLILFYFYICDRTNILGDSTKSYSRDLFIFLYLLLIIVSALSSLKKHNDSSTFSGKNILYLNRHQTEEWKGWMQVLFLMYHYFAATEIYNAIRVFIAAYVWMTGFGNFSYYYIRKDFSLPRFAQMMWRLNFFVAFCCIVLNNDYMLYYICPMHTLFTLMVYGALGIYNKYNEVPSVMAAKILACFLVVILVWEIPGFFDIFWSPFALFLGYTDPAKPDLPRMHEWHFRSGLDRYIWIIGMIYAYFHPNVEKWMEKLEESEIKRRATIKTSIVSVALFVGYLWYEYIYKLDKVSYNKLHPYTSWIPITVYICLRNFSQRLRNFSLTLFAWLGKITLETYISQFHIWLRSNMPNGQPKWLLSLIPEYPMLNFMLTTAIYVFVSHRLFELTNTLKTVFIPTKDNRRLLHNFITGVVLCLSLYCIALILLLIPHSTELN

SEQ ID NO: 10083 - protein, 540 aa, Arabidopsis lyrata subsp. lyrata
MADSEPITPGQVSFLLGVIPVFIAWIYSEFLEYKRSSLHSKVHSDNNLVELGEVKNKEDEVAVLLEGGLARSVSTKFYNSPIKTNLIRFLTLEDSFLIENRATLRAMAEFGAILFYFYISDRTSLLGESKKNYNRDLFLFLYCLLIIVAYMTSLKKHNDKSPITGKSILYLNRHQTEEWKGWMQVLFLMYHYFAAAEIYNAIRVFIAAYVWMTGFGNFSYYYIRKDFSLARFTQMMWRLNLFVAFSCIILNNDYMLYYICPMHTLFTLMVYGALGIFSRYNEIPSVMVLKIASCFLVVIVMWEIPGVFEIFWSPLTFLLGYTDPAKPDLPLLHEWHFRSGLDRYIWIIGMIYAYFHPTVERWMEKLEEFDAKRKMSIKTSIIAISSFVGYLWYEYIYKLDKVTYNKYHPYTSWIPITVYICLRNSTQQLRNFSLTLFAWLGKITLETYISQFHIWLRSNVPNGQPKWLLCIIPEYPMLNFMLVTAIYVLVSHRLFELTNTLKSVFIPTKDDKRLLHNVLAGAAISFCLYLTALILLQIPH

SEQ ID NO: 10084 - protein, 540 aa, Arabidopsis thaliana
MVDPGPITPGQVSFLLGVIPIFVGWIYSELLEYRKSWVPLKPHSDNNLVELGDVAEKDDDKADLLEGGLARSPSVKFHNSSIRTNIIRFLSMEDSFLLEHRATLRAMSEFGAILIYFYICDRTELLGDSTKNYNRDLFLFLYVLLIIVSAMTSLRKHNDKSPISGKSILYLNRHQTEEWKGWMQVLFLMYHYFAAAEIYNAIRIFIAAYVWMTGFGNFSYYYVRKDFSVARFAQMMWRLNFFVAFCCIVLNNDYMLYYICPMHTLFTLMVYGALGIFSKYNEIGSVMALKIFSCFLVVFLLWEIPGAFEIFWGPLTFLLGYNDPAKPDLHRLHEWHFRSGLDRYIWIIGMIYAYYHPTVERWMEKLEDCETKKRLSIKAAIVTITVLVGYVWYECIYKLDRTSYNMYHPYTSWIPITVYICLRNFTHQLRSVSLTLFAWLGKITLETYISQFHIWLRSNMPDGQPKWLLSIIPGYPMLNFMLTTAIYVLVSHRLFELTNTLKTVFVPTKDNKRLFSNFIAGIAIALPLYCFSFVLLQIHR

SEQ ID NO: 10085 - protein, 540 aa, Arabidopsis thaliana
MVDPGPITPGQVSFLLGVIPIFVGWIYSELLEYRKSWVPLKPHSDNNLVELGDVAEKDDDKADLLEGGLARSPSVKFHNSSIRTNIIRFLSMEDSFLLEHRATLRAMSEFGAILIYFYICDRTELLGDSTKNYNRDLFLFLYVLLIIVSAMTSLRKHNDKSPISGKSILYLNRHQTEEWKGWMQVLFLMYHYFAAAEIYNAIRIFIAAYVWMTGFGNFSYYYVRKDFSVARFAQMMWRLNFFVAFCCIVLNNDYMLYYICPMHTLFTLMVYGALGIFSKYNEIGSVMALKIFSCFLVVFLLWEIPGAFEIFWGPLTFLLGYNDPAKPDLHRLHEWHFRSGLDRYIWIIGMIYAYYHPTVERWMEKLEDCETKKRLSIKAAIVTITVLVGYVWYECIYKLDRTSYNMYHPYTSWIPITVYICLRNFTHQLRSVSLTLFAWLGKITLETYISQFHIWLRSNMPDGQPKWLLSIIPGYRMLNFMLTTAIYVLVSHRLFELTNTLKTVFVPTKDNKRLFSNFIAGIAIALPLYCFSFVLLQIHR

SEQ ID NO: 10086 - protein, 293 aa, Glycine max
MVVKPIEDIVVTNTCPKAVESKPRPQKEQAINCPRCHSINTKFCYYNNYSLTQPRYFCKTCRRYWTEGGTLRNIPVGGGSRKNKRSSASCSTPNNSHNNNNSTNKKLLSDLVITPPTLSHTQNPNSNNAIHQGQDLNLAFPSSTPDFRKISELVQQNNNNNNSSNNSMSASASSSSTTTTTSTSHLSALELLTGITSSSSAGLTSFMPVPVPSDPNSIYTCGFPLQDFKPTLNFSLDGIGNGYTSLQNVQSGRLLFPSDDLRQVSSSTITTMDQKQQGDSTGYWTGMLGGGSW

SEQ ID NO: 10087 - protein, 302 aa, Glycine max
MDTAQWPQEMVVKPIEDIVVTNTCPKAVESKPRPQKEQAINCPRCHSINTKFCYYNNYSLTQPRYFCKTCRRYWTEGGTLRNIPVGGGSRKNKRSSASCSTPNNSHNNNNSTNKKLLSDLVITPPTLSHTQNPNSNNAIHQGQDLNLAFPSSTPDFRKISELVQQNNNNNNSSNNSMSASASSSSTTTTTSTSHLSALELLTGITSSSSAGLTSFMPVPVPSDPNSIYTCGFPLQDFKPTLNFSLDGIGNGYTSLQNVQSGRLLFPSDDLRQVSSSTITTMDQKQQGDSTGYWTGMLGGGSW

SEQ ID NO: 10088 - protein, 269 aa, Glycine max
MDTAQWPQEMVVKPIEDIVVTNTTCTKAAVGSVERKPRPQKEQAINCPRCHSINTKFCYYNNYSLTQPRYFCKTCRRYWTEGGTLRNIPVGGGSRKNKRSSASCSNNSHHNDNNSTNKKLSADLVITPPTLSHTTQNPKSNDNSIIHQGQDLNLAFPSTTNLSALELLTGITSSSSTGLSTSFMPIPVPSNPNSIYTCGFPLQDFKPGTLNFSLDGIGKGYTSLQNVHGGRLLFPFEDLKQVSSTTTMNQTQQGDSTGYWTGMLGGGSW

SEQ ID NO: 10089 - protein, 452 aa, Glycine max
MLVALLLLVALSNAVRVNGDGGQCGSNPTLDPRPHSVSILEFGAVGDGKTLNTIAFQNAIFYLKSFADKGGAQLYVPPGKWLTGSFNLTSHLTLFLEKGAVLIGTQDPSHWDVVEPLPSYGRGLEVPGGRYQSLINGYMLHDVVVTGNNGTIDGMGMVWWDWYSTHSLNHSRPHLVEFVASDYVVVSNLTFLNAPAYSIHPVYCSHVHIQNVSISTPPESPYTVGIVPDSSDNVCIEDCIVAMGFDAISLKSGWDEYGIAYGRPTENVHIRRVQLHAFSGSALAFGSDMSGGISNVLVEHAHLFNSNSGIEFRTTKGRGGYMKEIVMSDIQMENVHTAIAATGNCGSHPDDKFDPNALPHLDHITLKDVIGTNITIAGNLAGIDESPFTNICLSNITLSTNSVSPITWACSNVSGFSDSVLPEPCPELGNTSYDSSSSCFYLLSVSGKTALQ

SEQ ID NO: 10090 - protein, 579 aa, Glycine max
MIDVGPTIPQFCSVNPHAPSNLCAPCTPQTLSFPHPPLPPITLHVSPRGASSSSPHPPVSRLVALPQQHLCRFLSPLDSDPVASFDSRRCLLEFSFKFLVIRCVLSEVNYLGYLLRINGLHFAFSTLFQVALLLLVALSNAVRVNGNGGQCGSNPRLDPRPHSVSILEFGAVGDGKTLNTIAFQNAIFYLKSFADKGGAQLYVPPGKWLTGSFNLTSHLTLFLEKGAVIIGTQDPSHWDVVEPLPSYGRGLEVPGGRYQSLINGYMLHDVVVTGNNGTIDGMGMVWWDWYSTHSLNHSRPHLVEIVASDYVVVSNLTFLNAPAYSIHPVYCSHVHIQNVSISTPPESPYTVGIVPDSSDNVCIEDCIVAMGFDAISLKSGWDEYGIAYGRPTENVHIRRVHLHAFSGSALAFGSDMSGGISNVLVEHAHLFNSKSGIEFRTTKGRGGYMKEIVMSDIQMENVHTAIAATGNCGSHPDDKFDPNALPHLDHITLKDVTGTNISIAGNIAGIEESPFTNICLSNITLSTNSVSPITWECSNVSGFSDSVLPEPCPELGNPSYDSSSSCFYLLSVSGKTVVQ

SEQ ID NO: 10091 - protein, 460 aa, Glycine max
MNVLISLPKILVQVALLLLLALSNEVRVNGDSDGRQCEVNPALKPRPHTVSILEFGAVGDGKTLNTIAFQNAIFYLKSFADKGGAQLYVPPGTWLTQSFNLTSHLTLFLEKGAVILGSQDPFHWEVVDPLPSYGRGVEVPGGRYQSLVNGYMLHDVVITGNNGIIDGMGLGWWELFSSHSLNYSRPHLIELVASNRVVVSNLTFLNAPAYSIHPVYCSNVHIHNVSISAPQESPYTIGIVPDSSDHVCIEDCVIATGYDAISLKSGWDEYGIAYGRPTENVHIRRVHLQAYSGSTIAFGSDMSGGISNILVENVHLYNSKSGIEFRTMRGRGGYMKEIIISDIEMENIYTAMAATGYCGSHPDDKFDPNALPLLDHIILQDMIGTNITIAGSFAGLQESPFTNICLSNVTLSINSVSSIPWECSNVSGFSDSVLPKPCPDLETLSDCLSLLSIKGKTAVM

SEQ ID NO: 10092 - protein, 449 aa, Glycine max
MLVAFLLLLALSNEVRVNGDGSGRQCEINPALKPRPHTVSILEFGAVGDGKTLNTMAFQNAIFYLKSFADKGGAQLYVPPGTWLTQSFNLTSHLTLFLEKGAVILGSQDPFHWEVVDPLPSYGRGVEVPGGRYQSLINGNMLHDVVITGNNGNIDGMGFAWWELFSSHSLNYSRPHLIELVASDHVVVSNLTFLNAPAYSIHPVYCSNVHIHNVSISAPPESPNTVGIVPDSSDHVCIEDCVIATGYDAISLKSGWDEYGIAYGRPTENVHIRRVHLQASSGSTIAFGSDMSGGISNILVENVHLYNSKSGIEFRTMRGRGGYMKEIIISDIEMENIYTAIAATGYCGSHPDDKFDPNALPLLDHIILQDMIGTNITIAGSFAGLQESPFTNICLSNITLSTNSVSSIPWECSNVSGFSDYVLPKPCPDLETLSNCLSLLIIKGKTAVM

SEQ ID NO: 10093 - protein, 459 aa, Medicago truncatula
MLVALVLLLLALSNEVRVNGERGDRQCGFNPSLKPRPHSVSILEFGAVGDGKTLNTIAFQNAIFYLKSFADKGGAQLYVPPGTWLTQSFNLTSHLTLFLEKGAVIIGSQDHYNWDVLDPLPSYGRGLEVPGGRYQSLINGYMLQDVVITGNNGTIDGMGSTWWESFSSHSLNYSRPHLVELVASTDVVVSNLTFLNAPAYNIHPVYCRNVHIHNISIFAPPESPYTVGIVPDSSDHVCIEDCTIATGYDAIALKSGWDEYGIAYGRPTENVHIRRVHLQASYGSTLAFGSDMSGGISNVFVEHVHLYNSKGGIEFRTIRGRGGYMKDIILSDIEMKNIYRAISATGYCGSHPDDKFDPNALPLLDHFIFQDIIGTNITIAGSFAGLQESPFTNICLSNITLSVNYASSTSWECSNVSGFSDSVLPIPCPDLDSPSNYSSSCLSKLSMKGKIAGSGSVSM

SEQ ID NO: 10094 - protein, 457 aa, Vitis vinifera
MKMLLPLLVILVLSNAVESNGQERGGQCTNSLTLDPRPHSVSILEFGAVGDGKTLNTIAFQNAIFYLKSFADKGGAQLYVPPGKWLTGSFNLTSHLTLFLERGAVILGSQDPSHWEVIEPLPSYGRGIELPGGRYRSLINGYMLRDVVITGDNGTINGQGSVWWDWFTSHSLNYSRPHLVEFLASTNVVVSNLTFLNAPAYNIHPVYCSNVRVQNISVYAPPESPYTVGIVPDSSDSTCIEDCSIAMGHDAIALKSGWDEYGIAYGRPTTNVHIRRVNLQSSSGSSLAFGSEMSGGISNVCVEQVHLYNSFSGIEFRTTKGRGGYIQEIIISDVAMENIHTAFSATGQIGSHPDDHFDPNALPVLDHITLQNVIGTNITIAGSFTGIQESPFTSICLSNISLSTTPPASISWVCSNVSGFSQWVFPEPCPSLESSLLNSSSTCLSRLNSSPTQTAVL

SEQ ID NO: 10095 - protein, 482 aa, Vitis vinifera
MLLPLLVILVLSNAVESNGQERGGQCTNSLTLDPRPHSVSILEFGAVGDGKTLNTIAFQNAIFYLKSFADKGGAQLYVPPGKWLTGSFNLTSHLTLFLERGAVILGSQDPSHWEVIEPLPSYGRGIELPGGRYRSLINGYMLRDVVITGDNGTINGQGSVWWDWFTSHSLNYSRPHLVEFLASTNVVVSNLTFLNAPAYNIHPVYCSNVRVQNISVYAPPESPYTVGIVPDSSDSTCIEDCSIAMGHDAIALKSGWDEYGIAYGRPTTNVHIRRVNLQSSSGSSLAFGSEMSGGISNVCVEQVHLYNSFSGIEFRTTKGRGGYIQEIIISDVAMENIHTAFSATGQIGSHPDDHFDPNALPVLDHITLQNVIGTNITIAGSFTGIQESPFTSICLSNISLSTTPPASISWVCSNVSGFSQWVFPEPCPSLESSLLNSSSTCLSRLNSSPTQTAVLSSESNLHEKTKPPSPLHCIIAPIACNV

SEQ ID NO: 10096 - protein, 1026 aa, Glycine max
MFFSGDPFTRKRVDLGGRSSKERDRKNLLEQTRVERNRRLWLRQQNSAVLKIQKCFRGRKAVRTEQSKLREQFYKIYGKYCQNVDRNSFGPDSNFLCQFLYFFKAENIEDFLVLVQICRLLWWSVQDNGDVVKLFAGVDYSSTRALVNYRVKLFVQACICALHQNRNQLKDQLLLTPEELNVSAIPLLEVLVLLIDPKLPWSCNLVQYLIQNNGVGLLREIVLTGKDNAENCFSIGKGSSLERVLIAVISHVGQKPCICSHINPRYSSASQIITIPFLWHLFPNLQQIFAANNLNQCYIHQMAKFGQNLIKLLPKDISNEFPSHACMLGNVLETAGIALSHPNCSFDMAVDLVAVTTFLLEALPSLKTSNSRESSVIAKDDMIEDDEVMEIALDSKLEQQIYNAINPRFLLQLTNILFKEISSVNGSDYGPNDRDVTAVDGVCGFLNVTFNKLPLERIMTVLAYRTELVPTLWNFMKQCHENQKWSSHLSNDAPGWLLPLAVFCPVYKHMLMIVDNEEFYEQEKPLSLKDIRSLIIILRQVLWQLLWVNHITSANSVKSVPVSSASKGQSVQTIQQRVCIVVSELLSQLQDWNNRRQFTSPSNFHADGVNDLFSSQAVIENTRANEILKQAPFLIPFTSRVKIFSSQLAAVRQRHGPQAVFSRNRFRIQRDHILEDAYNQMSQLTEDSLRGSIRVTFVNEFGVEEAGIDGGGIFKDFMENITRAAFDVQYGLFKETADHLLYPNPGSGMIHEQHFQFFHFLGTLLAKAMFEGILVDIPFATFFLSKLKQKHNYLNDLPSLDPELYRHLIFLKHYKGDISELELYFVIVNNEYGEQTEEELLPGGRNLRVTNENVITFIHLVANHRLNFQIRQQSSHFLRGFQQLMQKDWIDMFNEHELQLLISGSLDSLDIDDLRLHTNYAGGYHNEHFVMEMFWEVLKGFSLENRKKFLKFVTGCSRGPLLGFRYLEPMFCIQRASGNAVEESLDRLPTSATCMNLLKLPPYTSKEQLETKLLYAINADAGFDLS

SEQ ID NO: 10097 - protein, 1012 aa, Glycine max
MFFSGDPFTRKRVDLGGRSSKERDRKNLLEQTRVERNRRLWLRQQNSAVLKIQKCFRGRKAVRTEQSKLREQFYKIYGKYCQNVDRNSFGPDSNFLCQFLYFFKAENIEDFLVLVQICRLLWWSVQDNGDVVKLFAGVDYSSTRALVNYRVKLFVQACICALHQNRNQLKDQLLLTPEELNVSAIPLLEVLVLLIDPKLPWSCNLVQYLIQNNGVGLLREIVLTGKDNAENCFSIGKGSSLERVLIAVISHVGQKPCICSHINPRYSSASQIITIPFLWHLFPNLQQIFAANNLNQCYIHQMAKFGQNLIKLLPKDISNEFPSHACMLGNVLETAGIALSHPNCSFDMAVDLVAVTTFLLEALPSLKTSNNDEVMEIALDSKLEQQIYNAINPRFLLQLTNILFKEISSVNGSDYGPNDRDVTAVDGVCGFLNVTFNKLPLERIMTVLAYRTELVPTLWNFMKQCHENQKWSSHLSNDAPGWLLPLAVFCPVYKHMLMIVDNEEFYEQEKPLSLKDIRSLIIILRQVLWQLLWVNHITSANSVKSVPVSSASKGQSVQTIQQRVCIVVSELLSQLQDWNNRRQFTSPSNFHADGVNDLFSSQAVIENTRANEILKQAPFLIPFTSRVKIFSSQLAAVRQRHGPQAVFSRNRFRIQRDHILEDAYNQMSQLTEDSLRGSIRVTFVNEFGVEEAGIDGGGIFKDFMENITRAAFDVQYGLFKETADHLLYPNPGSGMIHEQHFQFFHFLGTLLAKAMFEGILVDIPFATFFLSKLKQKHNYLNDLPSLDPELYRHLIFLKHYKGDISELELYFVIVNNEYGEQTEEELLPGGRNLRVTNENVITFIHLVANHRLNFQIRQQSSHFLRGFQQLMQKDWIDMFNEHELQLLISGSLDSLDIDDLRLHTNYAGGYHNEHFVMEMFWEVLKGFSLENRKKFLKFVTGCSRGPLLGFRYLEPMFCIQRASGNAVEESLDRLPTSATCMNLLKLPPYTSKEQLETKLLYAINADAGFDLS

SEQ ID NO: 10098 - protein, 1026 aa, Glycine max
MFFSGDPSTRKRVDLGGRSSKERDRKNLLEQTRVERNRRLWLRQQNSAVLKIQKCFRGRKAVRTEQSKVREQFYKIYGKHCQNVDRNSFGPDSNFLYQFLYFFKAENIDDFLVLVQICRLLWWSVQDNGDVVKLFAGVDYSSTRALVNFRVKRFVQACVCALHQNRNQLKDQLLLTPEELNVSAIPLLEVLVLLIDPKLPWSCKIVEYLIQNNAVGLLREIILTGKDNAENYFSIGKGSSLERVLIAVICHVGQKPCICSQINPRYSFASQIITIPFLWHLFPNLQQIFAADDLNQCYIHQMAMFGQNLINLLPKDISTEFPSHACMLGNVLETAGIALSHPNCSFDMAIDLAAVTTFLLEALPSVKTSNSRESPMIAEDDMTGDNEVMEIALDRKLEQQIYNAINPRFLLQLTNILFKEISSVNGSDYGPNDRDVTAVDGVCGFLNVTFNKLPLERIMTVLAYRTELVPTLWNFMKRCHENQKWSSHFSNDAPGWLLPLAVFCPVYKHMLMIVDNEEFYEQEKPLSLKDIRSLIIILRQVLWQLLWGNHITSANSVKSVPVSSASKGQSVQTIQQRVSIVVSELLSQLQDWNNRQQFTSPSNFQADGVNDLFSSQAVIENTRANEILKQAPFLIPFTSRVKIFSSQLAAVRQRHGPQAVFSRNRFRIKRDRILEDAYNQMSQLTEDSLRGSIRVTFVNEFGVEEAGIDGGGIFKDFMENITRAAFDVQYGLFKETADHLLYANPGSGMIHEQHFQFFHFLGTLLAKAMFEGILVDIPFATFFLSKLKQKHNYLNDLPSLDPELYRHLIFLKHYKGDISELELYFVIVNNEYGEQTEEELLPGGRNLRVTNENVITFIHLVANHRLNFQIRQQSSHFLRGFQQLIQKDWIDMFNEHELQLLISGSLDSLDIDDLRLHTNYAGGYHGEHYVMEMFWEVLKGFSLENRKKFLKFVTGCSRGPLLGFRYLEPMFCIQRASGNAAEESLDRLPTSATCMNLLKLPPYTSKEQLETKLLYAINADAGFDLS

SEQ ID NO: 10099 - protein, 1012 aa, Glycine max
MFFSGDPSTRKRVDLGGRSSKERDRKNLLEQTRVERNRRLWLRQQNSAVLKIQKCFRGRKAVRTEQSKVREQFYKIYGKHCQNVDRNSFGPDSNFLYQFLYFFKAENIDDFLVLVQICRLLWWSVQDNGDVVKLFAGVDYSSTRALVNFRVKRFVQACVCALHQNRNQLKDQLLLTPEELNVSAIPLLEVLVLLIDPKLPWSCKIVEYLIQNNAVGLLREIILTGKDNAENYFSIGKGSSLERVLIAVICHVGQKPCICSQINPRYSFASQIITIPFLWHLFPNLQQIFAADDLNQCYIHQMAMFGQNLINLLPKDISTEFPSHACMLGNVLETAGIALSHPNCSFDMAIDLAAVTTFLLEALPSVKTSNNNEVMEIALDRKLEQQIYNAINPRFLLQLTNILFKEISSVNGSDYGPNDRDVTAVDGVCGFLNVTFNKLPLERIMTVLAYRTELVPTLWNFMKRCHENQKWSSHFSNDAPGWLLPLAVFCPVYKHMLMIVDNEEFYEQEKPLSLKDIRSLIIILRQVLWQLLWGNHITSANSVKSVPVSSASKGQSVQTIQQRVSIVVSELLSQLQDWNNRQQFTSPSNFQADGVNDLFSSQAVIENTRANEILKQAPFLIPFTSRVKIFSSQLAAVRQRHGPQAVFSRNRFRIKRDRILEDAYNQMSQLTEDSLRGSIRVTFVNEFGVEEAGIDGGGIFKDFMENITRAAFDVQYGLFKETADHLLYANPGSGMIHEQHFQFFHFLGTLLAKAMFEGILVDIPFATFFLSKLKQKHNYLNDLPSLDPELYRHLIFLKHYKGDISELELYFVIVNNEYGEQTEEELLPGGRNLRVTNENVITFIHLVANHRLNFQIRQQSSHFLRGFQQLIQKDWIDMFNEHELQLLISGSLDSLDIDDLRLHTNYAGGYHGEHYVMEMFWEVLKGFSLENRKKFLKFVTGCSRGPLLGFRYLEPMFCIQRASGNAAEESLDRLPTSATCMNLLKLPPYTSKEQLETKLLYAINADAGFDLS

SEQ ID NO: 10100 - protein, 1031 aa, Glycine max
MFFSGDSSTRKRVDLGGRSSKERDRNNLLEQTRLERNRRMWLRQQNSAALRIQKCFRGRKVVRTEQSKLREKFLSIYGKNCQNLDRNAYAPGSDFLRQFLYFFNAENIDDFLILVQICRMLQRFVQDSGDVVRLFAGVDYSSTCALVNYRVKQFVYTCICAVHQNRNKLKDQLLLTPKDFNASAIPLLEILVLLIDPKLPWSCKTVVSLSQNNAFGLLREIILTGKDNAENCIYSEKGSSLECVLTVVMCHIGQKPCICSHTDPLYSFSSQILTIPFLWHVFPNLKQVFAKQGLSQHYVHQMATWVPNLISSLPKDISDEFPTYACLLGNILETGGFALSRPDCSFDMAIDLAAVITFLLESHPSLTRSDGRESSSIAEDEMTGEDEVMEVALDRKLNQQICNAIDTRFLLQLTNILFGDFSSANSSDHEPDDKEVAAVGAVCGFLYVIFNTLPLEKIMTVLAYRTELVPILWNFMKRCHENEKWSSLSERLSYLSGDAPGWLLPLAVFCPVYKHMLMIVDNEEYYEQEKPLSLKDIRSLIILLRQALWQLMWVNHTTSANSVKSVPVSPAIKKQSEAIQQRVSIVVSELLSQLQDWNNRRQFTSPTDFHADGVNDFFISQAVMENTQANEILKQAAFLIPFTSRVKILTSQLAAARQRHGSQAVYTRNRFRIRRNHILEDAYNQMSQLSEDDLRGLIRVAFVNELGVEEAGIDGGGIFKDFMENITRAAFDVQYGLFKETADYLLYPNPGSGMIHEQHLQFFHFLGTLLAKAMFEGILVDLPFATFFLSKLKQKHNYLNDLPSLDPELYRHLIFLKHYERDISELELYFVIVNNEYGEQTEEELLPGGKNLRVTNENVITFIHLVANHRLNFQIRQQSSHFLRGFQQLIQKDWIDMFNEHELQLLISGSLDSLDVDDLRQHTNYAGGYHSDHHVIEMFWEVLKGFSLENKKKFLKFVTGCSRGPLLGFQYLEPLFCIQRAGSNDPDEALDRLPTSATCMNLLKLPPYKSKEQLETKLLYAINADAGFDLS

SEQ ID NO: 10101 - protein, 1027 aa, Populus trichocarpa
MFFNGDPSTRKRVDLGGRSSKERDRQKLLEQTRLERNRRLWVKQQNAAALKIQKWFRGRKAVEAEQSTVREQFFGTYGKYCQNVDRHCFSPDSEFLRQLLFFFNAQNSDDFTILVETCRLLLQNVRDSGDIVSLFAGVDYSTKHGLVDYRVKQLAFTCIWAIYQNSRKQLKDQLVMVPRDSSLTATLLLEAVVLLIDPKLPWACKVVGYLLQRNAFALFREIVLTGKENTKSDNSIRNASPLERILALLISHIGQHPCICPNINPQWSFSSQMLTIPLLWRLFPSLKEVFATRGLSQHYIHQMAQCVRNAYVLPNDVSVECPGYACLLGNTVETAGAALSHADCSFEMAMDLAAVTTFLLEALPPIKSSSSTMDEDDMALPDEMEIVLNKDLEQQIAHAMHSRFLLQLTSVLFREVSMVSGSNHGLDDKEVAAIGAVCAFLHVAFNTLPVDRMMTVLAFRTELVRVLWNFMKQCHENKKWPSLPEQLSYLPGDVPGWLLPLAVFCPVYKYMLMLVGNEEFYEQEKPLSLKDVRCLIVILRQALWQLLWVNPTAHSNSVKLVKNTSAYNGNPVESIKQRVSLVASELLSQLQDWNNRRQFAPPSDFHADGVDDSFISQAIIDGTKANDIMNRAPFLVPFTSRVKIFNSQLLAIRQRQGSHGVFTRNRFRIRRDHILEDAYNQMSALSEEDLRGLIRVSFINEFGVEEAGIDGGGIFKDFMENITRAAFDVQYGLFKETSDHLLYPNPGSGMTHEQHLQFFHFLGTLLAKAMFEGILVDIPFATFFLSKLKQKYNYLNDLPSLDPELYRHLIFLKRYQGDISDLELYFVIVNNEYGEQTEEELLPGGRNQRVTNDNVIPFTHLVSNYRLNYQIRLQSSHFMRGFQQLIKKEWIDMFNEHELQLLISGSLDSLDIDDLRSHTNYAGGYHSEHYVIEMFWEVMKGFSLENQKKFLKFVTGCSRGPLLGFKYLEPLFCIQRAGGTASEEALDRLPTSATCMNLLKLPPYRSKEQLATKLLYSINADAGFDLS

SEQ ID NO: 10102 - protein, 1034 aa, Vitis vinifera
MFFSGDSSTRKRVDLGGRSSKERDRQKLLEQTRLERNRRWWLRQQNSAALRIQKCFRGRKAVEAEHAKVREQFFTTYGRHCQNVDRHSFGPDSEFLRQLLFFFDARNVGDFSALVETCRLLQNFVRDSGDAVNLFAGMDYSSKNALVDYRVKQLAYACIQAVHQNRNQFKGQLLMTSDEPSSPTILLLEAVVMLLDSKLPWVCKIVGHLLQRNTYSLLREIVLTAKESVETYSTGRVPSLECLLTILISHVGQNHCICPIIDPRWSFSSQILTIPFLWALFPYLKEVFMRRGLSEHYIHQMALCVQNHTNVLPDDISADFPGYACLLGNILETASVFFSQPDCSLDMAIDIAAVMTFLLQALPPMKSSNRESKENSSGGEDEMAVGDEIMEKVVSRDLEQQISNAIDPRFLLQLTNALFGGISLINHLCEEGPDDREVAAIGAACAFLHVTFNILPLERIMTVLAYRTELVPLLWKFIKRCHENQKWSSLSEQLAYLSGDMPGWQLPLAVFCPVYKHMLTIVDNEEFYEQEKPLSLSDIRCLIVILRQALWQLLWVNPAMPPNLMKPAPEVTSHRGHPIEFTQQRVSIVTAELLSQLQDWNNRRQFAPPSYFHADAVNEYFISQAVIENTRAYTILKQAPFLVPFTSRVKIFTSQLAAARQRDGSHSVFTRNRFRIRRDHILEDAFNQLSVLSEDDLRGLIRISFVNEFGVEEAGIDGGGIFKDFMENITRAAFDVQYGLFKETADHLLYPNPGSGMIHEQHLQFFHFLGTVLGKAMFEGILVDIPFATFFLSKLKQKHNYLNDLPSLDPELYRHLIFLKHFEGDLSELELYFVIVNNEYGEQTEEELLPGGKNIRVTNENVITFIHLIANHRLNFQIRQQSTHFLRGFQQLIQRDWIEMFDEHELQLLISGSLDGLDVDDLRSNTNYAGGYHSEHYVIETFWEVLKSFTLENQMKFLKFVTGCSRGPLLGFKYLEPLFCIQRAAGSASEEALDRLPTSATCMNLLKLPPYRSKEQMATKLLYAINADAGFDLS

SEQ ID NO: 10103 - protein, 1067 aa, Ricinus communis
MFFSGDPTTRKRVDLGGRSSKERDRQKLLEQTRLERNRRLWLRQQNASAIKIQKCFRGRKAVEIERSKVRDQFYQTYGKHCQNVDWHCFGPDSEFLRQLFFFFNAQNSGDFAVLVETCQRLLQFVRDGGDIISLFGGIDYSTNRALVDYRVKQLSFCCIQAVYQNREQLKNQLLMTLWESSEPVAVLLEVVVLLIDQKLPWACKIVGYLFQRNAFNLCREIVLVAKENMKACNFTGKLSSLERMLSLIISHIGQKPCICPHIDPQCSFISQILTIPFLWRLFPSLKEVFATRGLSEHYIHQMALCVGGNANVLPNDVSVEYPGYACLLGNMLETAGVSLSQPECSFDMAINFAAVATFLLETLPPIVSSSRESKESSALDEDDGIPDDMEIVMNRDLEQQITNAIDSRFLLQLTNVLFGGLSVLSGSEYGLEEKEIMAVGAACAFLHVTFNTLPLERIMTVLAYRTDLVRVLWNFMKQCHEKQKWSSLPEQLSHLPADAPGWLLPLVVFCPVYKHMLTIVDNEEFYEQEKPLSLKDIRCLIVILRQALWQLLWVNMNPTAHNSAVKPITNIPAYKRNPVESVKQRVSVVASELLSQLQDWNNRRQFTPPSDFHADGVDDFFISQAVIEGTKANDIMKRAPFLVPFTSRVKIFNSQLLAARQRHGSNSVFTRNRFRIRRDRILEDAYNQMSTLSEEDLRGLIRVTFVNEFGVEEAGIDGGGIFKDFMENITRAAFDVQYGLFKETADHLLYPNPGSGMIHEQHLQFFHFLGTLLAKAMFEGILVDIPFATFFLSKLKQKFNYLNDLPSLDPELYRHLIFLKHYQGDISNLELYFVIVNNEYGEQTEEELLPGGRNLRVSNENVITFIHLVSNHRLNFQIRQQSSHFLRGFQQLIQKDWIDMFNEHELQLLISGSLESLDVDDLRHHTHYAGGYHSEHYVIEIFWEVLKSFSLENQKKFLKFVTGCSRGPLLGFKYLEPLFCIQRAAGSASEEALDRLPTSATCMNLLKLPPYRRLCLDITKWGKNQSSYLVMAIIIPVLMSFYDCQVLCRRRDLWKPRVKADQNQVLL

SEQ ID NO: 10104 - protein, 263 aa, Glycine max
MESDAGENLFGTFSSSTTSITASSSSSPTSSTTTSSNSCTKHDSKISPPQNQNTPNSKKRQRSDDNENKHHPSYRGVRMRAWGKWVSEIREPRKKSRIWLGTYPTAEMAARAHDVAALAVKGHSAFLNFPNLAQDLPRPTTTSPKDIQAAAAKAATTTFFDDEIVNHCQAEKAEQNHGEQQASPSTLCMMDNSTEAEQIQAEQASSTQESSSSHSTADEETLFDLPDLFPDGNSGLFSYSSCWHLCAVDSGFRLEEQFLWENF

SEQ ID NO: 10105 - protein, 618 aa, Glycine max
MSGFDFSKYKTCSNPTQNKQTRQRRRLLSSRLCFSPFAFAFRVAAGRKSVSLRREFCKYGSTKGFDHHTNGSFGVEVGGSRNHHFACSGETRFHVEKEEGEICVEHELAPVVPPPEKRRKFSPIIWDLAEKEERVSSKSGILQIAALSPPCPFLSSSPGANGVDCGDVMEEPLTDSGSYPHDLEEDKDVQGWTITKSRWACDVRPSPRGADDEQKHGKVSSSPEIGEFHGGGTSESTITRSSGSSGRDHYLGASSDDTDSEKDFLMDSMVNVEEQSDDGDSPSDSDECGGLMHVLRNINMLQSCRSVCEFEMIKKINEGTYGVVYKARDKKTGELVALKKVKMNIERDGFPMSSLREINILLSFNHPSIVNVKEVVVDDFDGTFMVMEHMEYDLKGLMEVKKHPFSMSEIKSLVRQLLEGVKYLHDNWVIHRDLKSSNILLNHDGELKICDFGLSRQYGSPLKPYTPVVVTLWYRAPELLLGAKEYSTAIDMWSVGCIMAELIAKEPLFRGKSELEQLDKIFRTLGTPDEKIWPGLSKLPGAKANFVKQLFNTLRKKFPAASFIGLPVLSELGFDLLQQLLTYDPEKRITAEDALLHDWFHEAPLPKSDFKPIFPSWQ

SEQ ID NO: 10106 - protein, 1012 aa, Glycine max; identical to SEQ ID NO: 10099

SEQ ID NO: 10107 - protein, 1026 aa, Glycine max; identical to SEQ ID NO: 10096

SEQ ID NO: 10108 - protein, 1029 aa, Arabidopsis lyrata subsp. lyrata
MFFSGDPSTRKRVDLGGRSTKERDARKLLEQTRMERNRRLLQKQQNSAALKIQKFFRGRRSMAIERSKVRHDFCETYGNNCQNVDRHCFEPGSSFLRQFLFFFKAQNSGDFVILVETCRLLQSFVDSSGDIVSLFSGLDYSSKHNLVDFRVKKLAFTCIEAIHQNRNRLRDQLLVTPEEASISTAILMEAVSLLLDPKLPWVCKIVSYLHKENVFKLVREMVTTAKESSRGQTMTGSILSLERVLTLIVPHIGREPCCCPVVDPRCSFSSMILTIPLIWKLFPNLKVVFANPSLSQHYIHQMASCIQKDTCVLPMETSPEFPGYACLLGNTLDTANVVLSQPECSLDMAIDIALVATFLLETLPPVKSSEKESRQSSSDEDDMLIDDVPELVLNRALEHQITNAIDSRFLLQLTNVLFHQVSLGTQSYDEDKEALAIGTASSFLYAAFNTLPLERIMTILAYRTELVAVLWNYMKRCHENQKWSSMPKLLAYLPGDAPGWLLPLVVFCPVYKHMLMIVDNEEFYEREKPLSLQDIRLLIIILKQALWQLLWVNPLTQPNTGKSVSNDLSKKNPVELIQNRVGVVVSELLSQLQDWNNRQQFTSSSDFQADTVNEYFISQAIVEGTRANYILMQAPFLIPFTSRVKIFTTQLATARQSHGSQGIFARNRFRIRRDHILEDAYNQMSALSEDDLRGSIRVTFVNELGVEEAGIDGGGIFKDFMEKITRAAFDVQYGLFKETADHMLYPNPGSGMIHDQHLQFFHFLGSLLAKAMFEGILVDIPFATFFLSKLKQKYNYLNDLPSLDPELYRHLIFLKRYKGDISDLELYFVILNNEYGERTEEELLPGGQDMRVTNENVITFIHLVSNHRLNFQIRQQSSHFLRGFQQLIPKEWIDMFNEHELQVLISGSVDSLDIDDLRNNTNYAGGYHAGHYVIDMFWEVMKSFSTENQKKFLKFVTGCSRGPLLGFKYLEPAFCIQRAAGSASNESVDRLPTSATCMNLLKLPPYQSKELLETKLMYAISAEAGFDLS

SEQ ID NO: 10109 - protein, 1015 aa, Arabidopsis thaliana
MFFSGDPSTRKRVDLGGRSTKERDARKLLEQTRMERNRRLLQKQQNSAALKIQKFFRGRRSMAIERSKVRHDFCETYGNNCQNVDRHCFEPGSSFLRQFLFFFKAQNSGDFVILVETCRLLQSFVDSSGDIVSLFSGLDYSSEHNLVDFRVKKLAFTCIEAIHQNRNRLRDQLLVTPEEASISTAILMEAVSLLLDPKLPWVCKIVSYLQKRKVFKLVREMVTTAKESPRGKTMTGNILSLERVLILIVPHIGREPCCCTVVDPRWSFSSMILTIPLIWKLFPNLKVVFANPSLSQHYIHQMASCIQKDTCVLPMETSPEFPGYACLLGNTLDTANVVLSQPECSLDMAIDIALVATFFLETLPPVKSSEGESRQGLVLNKALEQQITNAIDSRFLLQLTNVLFRQVSLGMQSYDEDKEALAIGTASSFLYAAFNTLPLERIMTILAYRTELVAVLWNYMKRCHENQKWSSMPKLLAYLPGDAPGWLLPLVVFCPVYKHMLMIVDNEEFYEREKPLSLQDIRLLIIILKQALWQLLWVNPLTQPNTGKSVSNDLSKKNPIELIQNRMGIVVSELLSQLQDWNNRKQFTSSSDFQADSVNEYFISQAIMEGTRANYILMQAPFLIPFTSRVKIFTTQLATARQSHGSQGIFARNRFRIRRDHILEDAYNQMSALSEDDLRSSIRVTFVNELGVEEAGIDGGGIFKDFMEKITRAAFDVQYGLFKETADHMLYPNPGSGMIHEQHLQFFHFLGSLLAKAMFEGILVDIPFATFFLSKLKQKYNYLNDLPSLDPELYRHLIFLKRYKGDISDLELYFVILNNEYGERTEEELLPGGQDMRVTNENVITFIHLVSNHRLNFQIRQQSSHFLRGFQQLIPKEWIDMFNEHELQVLISGSVDSLDIDDLRNNTNYAGGYHAGHYVIDMFWEVMKSFSTENQKKFLKFVTGCSRGPLLGFKYLEPAFCIQRAAGSASNESVDRLPTSATCMNLLKLPPYQSKELLETKLMYAISAEAGFDLS

SEQ ID NO: 10110 - protein, 477 aa, Glycine max
MEPSSISPPPAPPATAVPFPAEPNDHLPPPIPEPPSNHPPYAEMIYTAIEALKEKDGSSKRAIAKYIEQVYTQLPPNHSDLLTQHLNHLKSRGLLQMVKKSYALPRSVPVSVPGPAPTQGTSAVPAAVVAITTTPRPRGRPRKAQNPVQNSPLPQDTVRGEGSAECRAGRGCAWRGRPPGSGKKPGRPPKATTTDVSASAGPKRRPGRPPKNQSQPTLIPFAPAVSAASVDTEHVAASAETAPVDADAALGPRARGRPKKYADEMIAAGRGRGRGRGRGGGGRGRGRGRGELPAQPRKPGARPVGRPKKGSTSASTSQNAANEDLRRKLEHFQSKVKESLAVLKPHFNHESPVTAIAAIQELEVLGTMDLNVPLRDETLPHQVELPPPQPPVQQQQQPPQQQLQQPPQQPPQQHLAPQQLPPQPPIFQQTYPPFHLPQFHHHQPSLQFQQQQQQPPQPPPQLFQHQAQPPSHQQFHP

SEQ ID NO: 10111 - protein, 487 aa, Glycine max
MASVFSACSGSAVLFHSRNSFSSKGSFLHLKRPLSANCVASLGTEVSVSPAVDTFWQWLKEEGVVSGKTPVKPGVVPEGLGLVALKDISRNEVVLQVPKRLWINPDAVAASEIGKVCSGLKPWLAVALFLIRERSRSDSLWKHYFSILPKETDSTIYWSEEELSELQGTQLLNTTRSVKQYVQNEFRRLEEEIIIPNKKLFPSSITLDDFFWAFGILRSRAFSRLRNENLVVIPLADLINHSARVTTDDHAYEIKGAAGLFSWDYLFSLRSPLSLKAGDQVYIQYDLNKSNAELALDYGFIEPNTDRNAYTLTLQISESDPFFGDKLDIAESNGFGETAYFDIFYNRPLPPGLLPYLRLVALGGTDAFLLESIFRNSIWGHLELPVSRDNEELICRVVRETCKTALAGYHTTIEEDQKLKEAKLDSRHAIAVGIREGEKNLLQQIDEIFKEKELELAQLEYYQERRLKDLGLCGENGDILGDLGKFF

SEQ ID NO: 10112 - protein, 487 aa, Glycine max
MASVFSACSGSAVLFYSRNSFPSKGSFIHLKRPLSANCVASLGTEVSVSPAVDTFWQWLKEEGVVSAKTPVKPSVVPEGLGLVALKDISRNEVVLQVPKRLWINPDAVAASEIGKVCIGLKPWLAVALFLIRERSRSNSLWKHYFSVLPKETDSTIYWSEEELSELQGTQLLNTTRSVKQYVENEYRRLEEEIILPNKKLFPSPLTLDDFFWAFGILRSRAFSRLRNENLVVIPFADFINHSARVTTEDHAYEIKGAAGLFSWDYLFSLRSPLSLKAGDQVYIQYDLNKSNAELALDYGFIEPNADRNAYTLTLQISESDPFFGDKLDIAESNGFGETAYFDIFYSRPLPPGLLPYLRLVALGGTDAFLLESIFRNSIWGHLELPVSRDNEELICRVVRETCKTALAGYHTTIEEDQKLKEAKLDSRHAIAVGIREGEKQLLQQIDETFKEKELELDQLEYYQERRLKDLGLCGENGDILGDLGKFF

SEQ ID NO: 10113 - protein, 489 aa, Ribulose-bisphosphate carboxylase
MATIFSGGSVSPFLFHTNKGTSFTPKAPILHLKRSFSAKSVASVGTEPSLSPAVQTFWKWLQEEGVITAKTPVKASVVTEGLGLVALKDISRNDVILQVPKRLWINPDAVAASEIGRVCSELKPWLSVILFLIRERSREDSVWKHYFGILPQETDSTIYWSEEELQELQGSQLLKTTVSVKEYVKNECLKLEQEIILPNKRLFPDPVTLDDFFWAFGILRSRAFSRLRNENLVVVPMADLINHSAGVTTEDHAYEVKGAAGLFSWDYLFSLKSPLSVKAGEQVYIQYDLNKSNAELALDYGFIEPNENRHAYTLTLEISESDPFFDDKLDVAESNGFAQTAYFDIFYNRTLPPGLLPYLRLVALGGTDAFLLESLFRDTIWGHLELSVSRDNEELLCKAVREACKSALAGYHTTIEQDRELKEGNLDSRLAIAVGIREGEKMVLQQIDGIFEQKELELDQLEYYQERRLKDLGLCGENGDILGDLGKFF

SEQ ID NO: 10114 - protein, 444 aa, Pisum sativum
MTEPSLSPAVQTFWKWLQEEGVITAKTPVKASVVTEGLGLVALKDISRNDVILQVPKRLWINPDAVAASEIGRVCSELKPWLSVILFLIRERSREDSVWKHYFGILPQETDSTIYWSEEELQELQGSQLLKTTVSVKEYVKNECLKLEQEIILPNKRLFPDPVTLDDFFWAFGILRSRAFSRLRNENLVVVPMADLINHSAGVTTEDHAYEVKGAAGLFSWDYLFSLKSPLSVKAGEQVYIQYDLNKSNAELALDYGFIEPNENRHAYTLTLEISESDPFFDDKLDVAESNGFAQTAYFDIFYNRTLPPGLLPYLRLVALGGTDAFLLESLFRDTIWGHLELSVSRDNEELLCKAVREACKSALAGYHTTIEQDRELKEGNLDSRLAIAVGIREGEKMVLQQIDGIFEQKELELDQLEYYQERRLKDLGLCGENGDILENLYFQ

SEQ ID NO: 10115 - protein, 440 aa, Pisum sativum
SLSPAVQTFWKWLQEEGVITAKTPVKASVVTEGLGLVALKDISRNDVILQVPKRLWINPDAVAASEIGRVCSELKPWLSVILFLIRERSREDSVWKHYFGILPQETDSTIYWSEEELQELQGSQLLKTTVSVKEYVKNECLKLEQEIILPNKRLFPDPVTLDDFFWAFGILRSRAFSRLRNENLVVVPMADLINHSAGVTTEDHAYEVKGAAGLFSWDYLFSLKSPLSVKAGEQVYIQYDLNKSNAELALDYGFIEPNENRHAYTLTLEISESDPFFDDKLDVAESNGFAQTAYFDIFYNRTLPPGLLPYLRLVALGGTDAFLLESLFRDTIWGHLELSVSRDNEELLCKAVREACKSALAGYHTTIEQDRELKEGNLDSRLAIAVGIREGEKMVLQQIDGIFEQKELELDQLEYYQERRLKDLGLCGENGDILENLYFQ

SEQ ID NO: 10116 - protein, 438 aa, Medicago truncatula
MARMRGGGEEGDRDPTKQQQHSGLVRLVQQLVTLLLVFAAGVVIGLTTTSHIHYFNTHNNNNNYLHFISQQPSASSSDVFNLDTIHTLQQQQPNNNNNNCNCNCTIIEPPSPPPPPPPPPPPPPSEEEDLLESFLHPSNITHTFSDHQLFWRASLVPKKYHYPYARVPKLAFMYLTRGPLPLLPLWERFFQGHSHLFNIYIHAPPGYILNVSDSSPFYRRNIPSQAVSWGTVTLADAERRLLANALLDFSNERFVLLSESCIPVYNFPTVYRYLIDSAHSFVESYDDPSRYGRGRYSRNMLPDIQLKHWRKGSQWFELNRALAVYIVSDTQYFSLFRKYCKPACYPDEHYLPTFLNMFHGSLNSNRTVTWVDWSMLGPHPATYGRDNITVGFIQAIRNNGSLCPYNSDMTSICYLFARKFDPSALEPLLDLSSEVMNF

SEQ ID NO: 10117 - protein, 438 aa, Medicago truncatula; identical to SEQ ID NO: 10116

SEQ ID NO: 10118 - protein, 438 aa, Medicago truncatula; identical to SEQ ID NO: 10116

SEQ ID NO: 10119 - protein, 438 aa, Medicago truncatula; identical to SEQ ID NO: 10116

SEQ ID NO: 10120 - protein, 233 aa, Glycine max
MRCSHANALFRALKPKPRNSSLPLSSMAINKGNSNKAYDALLLDAGGTLLQLAKPVEEIYATIGSKYGVTVDPAMIKQGFKRAFAAPWPEKLRYQGDGRPFWKLVVSEATGCGDEDYFEEVYEYYAKGDAWHLPDGAFETITFLKDAGVKMAVVSNFDNRLRKLLKDLNVLNLFDAVIISSEVGYEKPDPRIFQAALDEVNVEACKALHIGDDQKADKLGANAVGIDCCSYGV

SEQ ID NO: 10121 - protein, 258 aa, Vitis vinifera
MEACVARCSDGVFFRCLNRFNFRRSFKPMASIHAASDGGRWFNRAYDGLLLDAGGTLLQLAKPVESTYADIGRKYGLTASSAEIKQGFRRAFAAPWPEKLRYQGDGRPFWKLVVSEATGCANNDYFEEVYEYYANGDAWHLPTGASETMFLLKDAGVKLAVVSNFDTRLRKLLKDLNVLDLFDAVIISSEVGYEKPDAKIFKAALDQIGVEAGKAVHVGDDQEADKVGASAVGIDCWLWGTDVKTFSDIQKQILISEH

SEQ ID NO: 10122 - protein, 254 aa, Populus trichocarpa
MEACFAKCSHGNALFKALKPLKLKLSSSSSMPIHSAESVKKAYDALLLDAGGTLLQLTRPVEETYASIGRKYGLTASSADIKQGFKRAFAAPWPEKLRYQGDGRPFWKLVVSEATGSTNNDYFEEVYKYYANGEAWYLPDGAYEALYLLKDAGVKVVVVSNFDTRLRKLLKDLNVIELFDSLIISSEVGYEKPDPKIFEAALVEASVEAGKAVHVGDDLKADKQGANAIGIDCWLWGADVKTFSDIKNRILIHY

SEQ ID NO: 10123 - protein, 920 aa, Glycine max
MAETAVSLAGQHALPKILEAVKMLRDLPNEVRDITDELESFQDFINDADKVAEAEEDDGRRHRIKERVMRLREAAFRMEDVIDEYNISCEDKQPDDPRCAALQCEAVDFIKTQILRLQSAYKIQDVKLLVRAERDGFQRHFPLEKRSTSSRGNQDVTWQTLRRAPLFIEEDEVVGLDNDRATLKYWLTNGREQRTVISVVGIAGVGKTTLAKQVYDQVRNNFECHALITVSQSFSAVGLLTHMLNELCKEKNEDPPKDVSTIESLTKEVRNRLRNKRYVVLFDDVWNETFWDHIESAVIDNKNGSRILITTRDEKVAEYCRKSSFVEVHNLEKPLTEEESLKLFCKKAFQYSSDGDCPEELKDISLEIVRKCKDLPLAIVAIGGLLSQKDESAPEWGQFSRDLSLDLERNSELNSITKILGLSYDDLPINLRSCLLYFGMYPEDYEVKSDRLIRQWITEGFVKHETGKSLEEVGQPYLSGLVHRSLVQVSSLRIDGKVKRCRVHDLIHDMILRKVKDTGFCQYIDGRDQSVSSNIVRRLTIATHDFSGSTRSSPIRSILIMTGKDENLSQDLVNKFPTNYMLLKVLDFEGSAFSYVPENLGNLCHLKYLSFRYTWIASLPKSIGKLLNLETLDIRGTGVSEMPEEISKLKKLRHLLAYSRCSIQWKDIGGMTSLQEIPPVIIDDDGVVIREVGKLKQLRELSVNDFEGKHKETLCSLINEMPLLEKLLIDAADWSEVIDLYITSPMSTLRKLVLFGKLTRFPNWISQFPNLVQLRLRGSRLTNDALQSLNNMPRLLFLVLRDNAYEGETLHFQRGWFQRLKQLFLQSLDKLKSILIDRGALCSVEEIVLRDLSQLKTVPSGIQHLEKLKDLYIDDMPTEFEQRIAPDGGEDHWIIQDVPHVRIWSEDAEEPLHIFGRSHH

SEQ ID NO: 10124 - protein, 223 aa, Lotus japonicus
MGRGKIEIKRIENTTNRQVTFCKRRNGLLKKAYELSVLCDAEVALIVFSSRGRLYEYSNNNIRSTIERYKKACSDHSSTSTTTEINAQYYQQESAKLRQQIQMLQNSNRHLMGDALSTLTVKELKQLENRLERGITRIRSKKHEMLLAEIEYFQKREIELENENLCLRTKITDVERIQQVNMVSGQELNAIQALASRNFFNPPMIEDGTSYPQQPDKKILHLG

SEQ ID NO: 10125 - protein, 222 aa, Glycine max
MGRGKIEIKRIENTTNRQVTFCKRRNGLLKKAYELSVLCDAEVALIVFSSRGRLYEYSNNNIRSTIERYKKACSDHSSASTTTEINAQYYQQESAKLRQQIQMLQNSNRHLMGDALSTLTVKELKQLENRLERGITRIRSKKHEMLLAEIEYFQKREIELENENLCLRTKITDVERIQQVNMVSGPELNAIQALASRNFFNPNMLEGGTVYPHSDKKILHLG

SEQ ID NO: 10126 - protein, 223 aa, Gossypium hirsutum
MGRGKIEIKRIENTTNRQVTFCKRRNGLLKKAYELSVLCDAEVALIVFSSRGRLYEYSNNNIRSTIDRYKKACSDTSNTNTVTEINAQYYQQESAKLRQQIQMLQNSNRHLMGDSLSSLTVKELKQVENRLERGITRIRSKKHEMLLAEIEFLQKREIELENESVCLRTKIAEIERLQQANMVTGPELNAIQALASRNFFSPNVIEHPSAYSHPSDKKILHLG

SEQ ID NO: 10127 - protein, 221 aa, Prunus dulcis
MGRGKIEIKRIENTTNRQVTFCKRRNGLLKKAYELSILCDAEVALIVFSSRGRLYEYSNNNIRNTIEGYKKACSDSSGSTSITEINAQYYQQESAKLRQQIQMLQNSNRHLMGDALSTLSVKELKQLENRLERGINRIRSKKHEMLLAEIEYLQKKEIELENENVCLRTKISEVERLQQANMVGPELNAIQALASRNFFSQNMMEGGATYPQQDKKILHLG

SEQ ID NO: 10128 - protein, 219 aa, Carica papaya
MGRGKIEIKRIENTTNRQVTFCKRRNGLLKKAYELSVLCDAEVALIVFSSRGRLYEYSNNNIRSTIDRYKKACSDSSATTSVTEINAQYYQQESAKLRQQIQMLQNSNRHLMGDSLSALSVKELKQLENRLERGITRIRSKKHEMLLAEIEYLQKREIELENESVCLRTKIAEVERSLQVNMVTGPELNAIQALASRNFFIENETTYSHGPDKKILHLG

SEQ ID NO: 10129 - protein, 224 aa, Gossypium hirsutum
MGRGKIEIKRIENTTNRQVTFCKRRNGLLKKAYELSVLCDAEVALIVFSTRGRLYEYSNNNIRSTIERYKKACSGTSNTNTVTEINAQYYQQESAKLRQQIQMLQNSSRHLMGDSLSSLTVKELKQLENRLERGITRIRSKKHEMLLAEIEYFQKREVELENESVCLRAKIAEIERVEEANMVTGAELNAIQALASRNFFTPNVIERGTPTPYSHHDKKILHLG

SEQ ID NO: 10130 - protein, 222 aa, Prunus serrulata var. lannesiana
MGRGKIEIKRIENTTNRQVTFCKRRNGLLKKAYELSILCDAEVALIVFSSRGRLYEYSNNNSIRNTIERYKKACSDSSGSTSITEINAQYYQQESAKLRQQIQMLQNSNRHLMGDALSTLSVKELKQLENRLERGINRIRSKKHEMLLAEIEYLQKKEIELENENVCLRTKISEVERLQQANMVGPELNAIQALASRNFFSQNMMEGGATYPQQDKKILHLG

SEQ ID NO: 10131 - protein, 227 aa, Momordica charantia
MGRGKIEIKRIENTTNRQVTFCKRRNGLLKKAYELSVLCDAEVALIVFSSRGRLYEYSNNSIKTTIGRYKKACSDSSATSSVTELNTQYYQQESAKLRQQIQMLQNSNSNLVRHLMGDSLSALTVKELKQLENRLERGITRIRSKKHEMLLAEIEYLQKREIELENENVCIRTKIAEVERLQQANMVSGQELNAIQALASRNFFTPNMMEGGAVTFSHQDKKMLHLG

SEQ ID NO: 10132 - protein, 225 aa, Cucumis sativus
MGRGKIEIKRIENTTNRQVTFCKRRNGLLKKAYELSVLCDAEVALIVFSSRGRLYEYSNNSIKTTIERYKKACSDSSATSSVTELNTQYYQQESAKLRQQIQMLQNSNRHLMGDSLSALTVKELKQLENRLERGITRIRSKKHEMLLAEIEYLQKREIELENENVCIRTKIAEVERVQQANMVSGQELNAIQALANSRNFFSPNIMEPAGPVSYSHQDKKMLHLG

SEQ ID NO: 10133 - protein, 222 aa, Prunus persica
MGGGKIEIKRIENTTNRQVTFCKRRNGLLKKAYELSILCDAEVALIVFSSRGRLYEYSNNNSIRNTIERYKKACSDSSGSTSITEINAQYYQQESAKLRQQIQMLQNSNRHLMGDALSTLSVKELKQLENRLERGINRIRSKKHEMLLAEIEYLQKKEIELENENVCLRTKISEVERLQQANMVGPELNAIQALASRNFFSQNMMEGGATYPQQDKKILHLG

SEQ ID NO: 10134 - protein, 226 aa, Phaseolus vulgaris
MLQCLEGFKPLFASILRCCDLDIYNQPRGLEDPELLARETVFSVSEIEALYELFKKISSAVIDDGLINKEEFQLALFKTNKKESLFADRVFDLFDTKHNGILGFEEFARALSVFHPNAPIDDKIEFSFQLYDLKQQGFIERQEVKQMVVATLAESGMNLSDDVIESIIDKTFEEADTKHDGKIDKEEWRNLVLRHPSLLKNMTLQYLKDITTTFPSFVFHSQVDDT

SEQ ID NO: 10135 - protein, 226 aa, Glycine max
MLQCLEGLKPLFASILRCCDLDIYNQPRGLEDPELLARETVFSVSEIEALYELFKKISSAVIDDGLINKEEFQLALFKTNKKESLFADRVFDLFDTKHNGILGFEEFARALSVFHPNAPIDDKIEFSFQLYDLKQQGFIERQEVKQMVVATLAESGMNLSDDVIESIIDKTFEEADTKHDGKIDKEEWRNLVLRHPSLLKNMTLQYLKDITTTFPSFVFHSQVDDT

SEQ ID NO: 10136 - protein, 226 aa, Glycine max
MLRCLEGLKPLFASILRCCDLDIYNQPRGLEDPELLARETVFSVSEIEALYELFKKISSAVIDDGLINKEEFQLALFKTNKKESLFADRVFDLFDTKHNGILGFEEFARALSVFHPNAPTDDKIEFSFQLYDLKQQGFIERQEVKQMVVATLAESGMNPSDDVIESIIGKTFEEADTKHDGKIDKEEWRNLVLRHPSLLKNMTLQYLKDITTTFPSFVFHSQVDDT

SEQ ID NO: 10137 - protein, 225 aa, Pisum sativum
MLQCLEGFKSLLASVLRCCDIDINQPRGLEDPELLARETVFSVSEIEALYELFKKISSAVIDDGLINKEEFQLALFKTNKKESLFADRVFDLFDTKHNGILGFEEFARALSVFHPNAPIDDKIEFSFQLYDLKQQGFIERQEVKQMVVATLAESGMNLSDDVIESIIDKTFEEADTKHDGKIDKEEWRNLVLRHPSLLKNMTLQYLKDITTTFPSFVFHSQVDDT

SEQ ID NO: 10138 - protein, 226 aa, Vitis vinifera
MLQCLEGFKHLIASLLRCCDLDLYNQARGLQDPEVLARETVFSVSEIEALYELFKKISSAVIDDGLINKEEFQLALFKTNKKESLFADRVFDLFDTKHNGILGFEEFARALSVFHPNAPIDDKIEFSFQLYDLKQQGFIERQEVKQMVVATLAESGMNLSDDVIESIIDKTFEEADTKHDGKIDKEEWRSLVLRHPSLLKNMTLQYLKDITTTFPSFVFHSQVDDT

SEQ ID NO: 10139 - protein, 226 aa, Gossypium hirsutum
MLQCVAGVKRLFASVLQCCDIDLYKQSRGLNDPELLARETVFSVSEIEALYELFKKISSAVIDDGLINKEEFQLALFKTNKKESLFADRVFDLFDTKHNGILGFEEFARALSVFHPNAPIDDKIKFSFQLYDLKQQGFIERQEVKQMVVATLAESGMNLSDDVIESIIDKTFEEADTKHDGRIDKEEWRSLVLRHPSLLKNMTLQYLKDITTTFPSFVFHSQVDDT

SEQ ID NO: 10140 - protein, 226 aa, Gossypium hirsutum
MLQCVAGVKRLFASVLQCCDIDLYKQSRGLNDPELLARETVFSVSEIEALYELFKKISSAVIDDGLINKEEFQLALFKTNKKESLFADRVFDLFDTKHNGILGFEEFARALSVFHPNAPIDDKIKFSFQLYDLKQQGFIERQEVKQMVVATLAESGMNLSDDVIESIIDKTFEEADTKHDGRIDKEEWRSLVIRHPSLLKNMTLQYLKDITTTFPSFVFHSQVDDT

SEQ ID NO: 10141 - protein, 226 aa, Medicago truncatula
MLQCIEGIKHLFAPLLQCCDIDLYKQTTGLEDPEILARETVFSVSEIEALYELFKKISSAVIDDGLINKEEFQLALFKTNKKESLFADRVFDLFDTKHNGILGFEEFARALSVFHPNAPIDEKIEFSFQLYDLKQQGFIERQEVKQMVVATLAESGMNLSDDVIESIIDKTFEEADTKHDGKIDKEEWRNLVLRHPSLLKNMTLQYLRDITTTFPSFVFHSQVDDT

SEQ ID NO: 10142 - protein, 223 aa, Ricinus communis
MLQCIEGFITSLLRCCDLDLYNQSRGLEDPERLARETVFSVSEIEALYELFKKISSAVIDDGLINKEEFQLALFKTNKKESLFADRVFDLFDTKHNGILGFEEFARALSVFHPNAPIDDKIEFSFQLYDLKQQGFIERQEVKQMVVATLAESGMNLSDDVIESIIDKTFEEADTKHDGKIDKEEWRSLVLRHPSLLKNMTLQYLKDITTTFPSFVFHSQVDDT

SEQ ID NO: 10143 - protein, 226 aa, Gossypium hirsutum
MLQCLDGLKHLFASVLHCCDIDLCKQSRGLEDPELLARETVFSVSEIEALYELFKKISSAVIDDGLINKEEFQLALFKTNKKESLFADRVFDLFDTKHNGILGFEEFARALSVFHPNAPIDNKIDFSFQLYDLKQQGFIERQEVKQMVVATLAESGMNLSDDVIESIIDKTFEEADTKHDGRIDKEEWRSLVLRHPSLLKNMTLQYLKDITTTFPSFVFHSQVDDT

SEQ ID NO: 10144 - protein, 174 aa, Vitis vinifera
MAIRCINDICSSARASWSLISIAVAHRLGPVPVGETSIFIAISSVHRADALDACKFVIDEIKASVPIWKKEVYANGEVWKENSEFLERRSELGNAGLQEGRTCCSRKVKVETQERKSCCGAKVKVEGELKFLERRSELGNAGLQEGGTCCSRKVKVEAQERKGCCGAKVKVDVE

SEQ ID NO: 10145 - protein, 184 aa, Vitis vinifera
MGLWEAFLNWLRSLFFKQEMELSLIGLQNAGKTSLVNVVATGGYSEDMIPTVGFNMRKVTKGNVTIKLWDLGGQPRFRTMWERYCRAVSAIVYVVDAADPDNIGISKSELHDLLSKPSLNGIPLLVLGNKIDKPGALSKHALTEEMGLKSITDREVCCFMISCKNSTNIDSVIDWLVKHSKSKS

SEQ ID NO: 10146 - protein, 184 aa, Ricinus communis
MGLWEAFLNWLRSLFFKQEMELSLIGLQNAGKTSLVNVVATGGYSEDMIPTVGFNMRKVTKGNVTIKLWDLGGQPRFRSMWERYCRAVSAIVYVVDAADFDNLSVSKSELHDLLSKPSLNGIPLLVLGNKIDKPGALSKEAFTEQMGLKSITDREVCCFMISCKNSTNIDTVIDWLVKHSKSKN

SEQ ID NO: 10147 - protein, 184 aa, Glycine max
MGLWEAFLNWLRSLFFKQEMELSLIGLQNAGKTSLVNVVATGGYSEDMIPTVGFNMRKVTKGNVTIKLWDLGGQPRFRSMWERYCRAVSAIVYVVDAADPDNISISRSELHDLLSKPSLSGIPLLVLGNKIDKAEALSKQALTDQMDLKSITDREVCCFMISCKNSTNIDSVIDWLVKHSKSKS

SEQ ID NO: 10148 - protein, 184 aa, Arabidopsis lyrata subsp. lyrata
MGLWEAFLNWLRSLFFKQEMELSLIGLQNAGKTSLVNVVATGGYSEDMIPTVGFNMRKVTKGNVTIKLWDLGGQPRFRSMWERYCRAVSAIVYVVDAADPDNLSVSKSELHDLLSKTSLNGIPLLVLGNKIDKPGALSKEALTGEMGLTSLTDREVCCFMISCKNSTNIDQVIDWLVKHSKSKN

SEQ ID NO: 10149 - protein, 184 aa, Glycine max
MGLWESFLNWLRSLFFKQEMELSLIGLQNAGKTSLVNVIATGGYSEDMIPTVGFNMRKVTKGNVTIKLWDLGRQPRFRSMWERYCRAVSAIVYVVDAADPDNLSISKSELHDLLSKPSLSGIPLLVLGNKIDKPGVLSKEALTDQMDLKSITDREVCCFMISCKNSTNIDSVIDWLVKHSKSKS

SEQ ID NO: 10150 - protein, 184 aa, Glycine max
MGLWEAFLNWLRSLFFKQEMELSLIGLQNAGKTSLVNVVATGGYSEDMIPTVRFNMRKVTKGNVTIKLWDLGGQPRFRSMWERYCRAVSAIVYVVDAADPDNLSISRSELHDLLSKPSLGGIPLLVLGNKIDKAGALSKQALTDQMDLKSITDREVCCFMISCKNSTNIDSVIDWLVKHSKSKS

SEQ ID NO: 10151 - protein, 184 aa, Arabidopsis thaliana
MGLLEAFLNWLRSLFFKQEMELSLIGLQNAGKTSLVNVVATGGYSEDMIPTVGFNMRKVTKGNVTIKLWDLGGQPRFRSMWERYCRAVSAIVYVVDAADPDNLSVSKSELHDLLSKTSLNGIPLLVLGNKIDKPGALSKEALTDEMGLTSLTDREVCCFMISCKNSTNIDQVIDWLVKHSKSKN

SEQ ID NO: 10152 - protein, 184 aa, Glycine max
MGLWEAFLNWLRSLFFKQEMELSLIGLQNAGKTSLVNVVATGGYSEDMIPTVGFNMRKVTKGNVTIKLWDLGGQPRFRSMWERYCRAVSAIVYVVDAADPDNISISRSELHDLLSKPSLSGIPLLVLGNKIDKAEALSKQALTDQMDLKSITDREVRCFMISCKNSTNIDSVIDWLVKHSKSKS

SEQ ID NO: 10153 - protein, 184 aa, Arabidopsis lyrata subsp. lyrata
MGLWDALLNWLRSLFFKQEMELSLIGLQNAGKTSLVNVVATGGYSEDMIPTVGFNMRKVTKGSVTIKLWDLGGQPRFRSMWERYCRSVSAIVYVVDAADPDNLSVSKSELHDLLSKTSLSGIPLLVLGNKIDKPGALSKEALTEEMGLKSLTDREVCCFMISCKNSTNIDQVIDWLVKHSKSSS

SEQ ID NO: 10154 - protein, 184 aa, Arabidopsis thaliana
MGLWDALLNWLRSLFFKQEMELSLIGLQNAGKTSLVNVVATGGYSEDMIPTVGFNMRKVTKGSVTIKLWDLGGQPRFRSMWERYCRSVSAIVYVVDAADPDNLSVSKSELHDLLSKTSLNGIPLLVLGNKIDKPGALSKEALTDEMGLKSLTDREVCCFMISCKNSTNIDQVIDWLVKHSKSSN

SEQ ID NO: 10155 - protein, 279 aa, Glycine max
MTMKTVKVSNVSLGATEQDIKEFFSFSGDIEYVELRSHDERSQIAYITFKDSQGAETALLLSGATIVDMPVTITRDPDYQLPPAALASSVRETQTPGGADSALRKAEDVVSGMLAKGFILGKDAVNKAKTFDEKHQLSSTASAKVASFDQKIGLSEKISAGATVVSDRVREVDQKFQVSEKTKSAFAAAEQTVSNAGSALMKNRYVLTGASWVTGAFSKVFKAAGEVGQKTKEKVEGAEEHQKRKVEDQYAQVLSESPKAAEASEQKSSKPAPAQGLIL

SEQ ID NO: 10156 - protein, 280 aa, Glycine max
MTIKTVKVSNVSLGATEQDIKEFFSFSGDIEYVELQSHDERSQIAFITFKDSQGAETAVLLSGATIVDMPVTISLDPDYQLPPAALASPVRETRTPGGGADSAFRKAEDVVSGMLAKGFILGKDAVNKAKTFDEKHQLSSTASAKVASFDQKIGLSEKISAGATVVGDRVREVDQKFQVSEKTKSAFAAAEQTVSNAGSAIMKNRYVLTGASWVTGAFSKVFKAAGEVGQKTKEKVESAEEQQKRKVEDQYAQVLSESPKAAEASEQKSSKPAPAQGLIL

SEQ ID NO: 10157 - protein, 282 aa, Medicago truncatula
MSIKTVKVGNVSLGATERDIQEFFSFSGDIAYVELRSHDERSQTAYVTFKDSQGAETAVLLSGATIVDLSVNITLDPDYQLPPEALVSPVSESKTPGGADSALRKAEDVVTSMAAKGFILGKDAVNKAKTFDEKLQLSSKASATVASVDQKLGLSDKIGAGASVVSDKVRGVDQKFLVSEKTKSAFAAAEQTVSTAGSAIMKNRYVLTGASWVTGAFNRVSKAAVEVGQKTKEKVENAEQQEKRQVEDQYAQVLSEPSKAAAAASEQQSSKPGPAPAQGLIL

SEQ ID NO: 10158 - protein, 280 aa, Populus trichocarpa
MSVKTVKVSNVSLGASERDLKEFFSFSGDIEYVEMKSDNERSQIAYVTFKDSQGADTAVLLSGATIVDLSVTVALDPDYQLPPAALAELSATGNKAPGDESALRKAEDVVSGMLAKGFILGKDAINKAKGFDEKHQLTSTASAKVVSFDKKIGLTEKISAGTTVVGDKVREVDQKFQVSEKTKSAFAVAEQKVSSAGSAIMSNRYVFTGAAWVTGAFNKVAKAAGDVGQKAKEKAGMAEEEQKRKMVDDFAQVHLSESPKASSASDQKPSKPPPAQGLIL

SEQ ID NO: 10159 - protein, 275 aa, Ricinus communis
MRVRTVKVSNVSLGATERDLREFFSFSGDIEYVEVRRDDEKSQIAYVTYKDSQGAETAVLLSGATIVDLSVSITLDPDYQLPPAVTQNKTPGGAESALRKAEDVVTSMLAKGFILGKDAVNKAKTFDDKHQLTSTASAKVVSLDKKIGLTDKISAGTTIVSDKVREVDQKFQVSEKTKTAFAAAEQKVSSAGVAIMKNRYVFTGASWVTGAFNKVAKAAGEVGQKAKEKVGMAEDEQKRKMVDDFAQVHLSESPKASSEGEHLPFKPAPVQGLIL

SEQ ID NO: 10160 - protein, 267 aa, Populus trichocarpa
LQVKTVKVSNVSLGASERDLKEFFSFSGDIEYVEMKSDNERSQIAYVTFKDSQGADTAVLLSGATIVDLSVTVALDPDYQLPPAALAELSATGNKAPGDESALRKAEDVVSGMLAKGFILGKDAINKAKGFDEKHQLTSTASAKVVSFDKKIGLTEKISAGTTVVGDKVREVDQKFQVSEKTKSAFAVAEQKVSSAGSAIMSNRYVFTGAAWVTGAFNKVAKAAGDVGQKAKEKAGMAEEEQKRKMVDDFAQVHLSESPKASGASDQ

SEQ ID NO: 10161 - protein, 282 aa, Vitis vinifera
MPITTVKVSNVSLGATEQDIKEFFSFSGDIECVEMQSDNERSQIAYVTFKDMQGAETAILLSGATIVDMSVTITPAPDYQLPPAAASAPPLPKENKTPGRAESAFRKTEDVVSGMLAKGYILGKDAVNKAKSFDEKHQLTSTATSKVVSFDKKIGFTEKISAGTSVVNEKVREVDHKFQVSDKTKSAFAAAEQKVSSAGSAIMKNRYVFTGASWVTGAFNKVAKAAEEVGQKAKEKVGKSEDEQKRRVVEDFAQVHLSDSPKASASNEQHPYKPAPPQGLIL

SEQ ID NO: 10162 - protein, 277 aa, Vitis vinifera
MAISTVKVSNVSLGASEQDIKEFFSFSGEIEYVEMQSENERSQVAYVTFKDTQGAETAVLLSGATIVDMSVIIAPAPDYKLPAAASVQPRATENTNVGAGESPLQKAEDVVSGMLAKGFILGKDALNKAKSFDERHQFTSTASAKVVSLDQKIGLTDKISMGTTLVKDKVGEMDQKFQVSEKTKTAFAAAEQTVSNAGSAIMKNRYVLTGASWVTGAFNKVAKAAGEVGQKAKEKVAEEEQGRNVGQGYSQIHESESPKAATSEQPSKPAPAQGLIL

SEQ ID NO: 10163 - protein, 276 aa, Populus trichocarpa
MQLAMSVKTVKVSNVSLGASEQDLKEFFSFSGDIEYVEMKSENEQSQIAYVSFKDSQGADTAVLLSGATIVDLPVTVTLDPDYQLPPAALAALATENKAPSDESALHKAEDVVTGMLAKGFILGKDAINKAKSFDEKHQLTSTASAKVASLDKKIGLTEKISASTTVVGDKVREVDQKFQVSEKTKLALAAAEQKVSSAGSAIMSNRYVFTGAAWVTGTFNKVAKAAKEKVGMSEEEQKRKMVDDYAQVHLSESPKASGESEQQPSKPPPAQGLIL

SEQ ID NO: 10164 - protein, 279 aa, Glycine max; identical to SEQ ID NO: 10155

SEQ ID NO: 10165 - protein, 587 aa, Pisum sativum
MASTNALSSTSILRSPTNQAQTSLSKKVKQHGRVNFRQKPNRFVVKAAAKDIAFDQHSRSAMQAGIDKLADAVGLTLGPRGRNVVLDEFGSPKVVNDGVTIARAIELPDPMENAGAALIREVASKTNDSAGDGTTTASILAREIIKLGLLNVTSGANPVSIKKGIDKTVAALVEELEKLARPVKGGDDIKAVATISAGNDELIGKMIAEAIDKVGPDGVLSIESSNSFETTVEVEEGMEIDRGYISPQFVTNPEKSIVEFENARVLITDQKISAIKDIIPLLEKTTQLRAPLLIISEDITGEALATLVVNKLRGILNVAAIKAPGFGERRKALLQDIAILTGAEFQASDLGLLVENTTIEQLGLARKVTISKDSTTIIADAASKDELQSRVAQLKKELSETDSIYDSEKLAERIAKLSGGVAVIKVGAATETELEDRKLRIEDAKNATFAAIEEGIVPGGGTALVHLSGYVPAIKEKLEDADERLGADIVQKALVAPAALIAQNAGIEGEVVVEKIKNGEWEVGYNAMTDTYENLVESGVIDPAKVTRCALQNAASVAGMVLTTQAIVVEKPKPKAAVAAAPQGLTI

SEQ ID NO: 10166 - protein, 588 aa, Trifolium pratense
MASTNALSSTSILRSPTNNQAQTSLSKKAKQHGRVNYRQNPNRFMVKAAAKDIAFDQHSRRAMQAGIDKLADAVGLTLGPRGRNVVLDEFGSPKVVNDGVTIARAIELPDPMENAGAALIREVASKTNDSAGDGTTTASILAREIIKLGLLSVTSGANPVSIKKGIDKTVAGLIEELEKLARPVKGGDDIKAVASISAGNDELIGKMIAEAIDKVGPDGVLSIESSSSFETTVEVEEGMEIDRGYISPQFVTNLEKSIVEFENARVLITDQKISAIKDIIPLLEKTTQLRAPLFIIAEDITGEALATLVVNKLRGILNVAAIKAPGFGERRKALLQDIAILTGAEYQASDLGLLVENTSIEQLGLARKVTISKDSTTIIADAASKDELQSRVAQLKKELSETDSVYDSEKLAERIAKLSGGVAVIKVGAATETELEDRKLRIEDAKNATFAAIEEGIVPGGGTALVHLSAYVPAIKEKLEDADERLGADIVQKALVAPASLIAQNAGIEGEVVVEKIRNGEWEVGYNAMTDTYENLIESGVIDPAKVTRCALQNAASVAGMVLTTQAIVVEKPKPRAPVPGAPQGLTV

SEQ ID NO: 10167 - protein, 588 aa, Trifolium pratense
MASTNALSSTSILRSPTNNQAQTSLSKKAKQHGRVNYRQNPNRFMVKAAAKDIAFDQHSRRAMQAGIDKLADAVGLTLGPRGRNVVLDEFGSPKVVNDGVTIARAIELPDPMENAGAALIREVASKTNDSAGDGTTTASILAREIIKLGLLSVTSGANPVSIKKGIDKTVAGLIEELEKLARPVKGGDDIKAVASISAGNDELIGKMIAEAIGKVGPDGVLSIESSSSFETTVEVEEGMEIDRGYISPQFVTNLEKSIVEFENARVLITDQKISAIKDIIPLLEKTTQLRAPLFIIAEDITGEALATLVVNKLRGILNVAAIKAPGFGERRKALLQDIAILTGAEYQASDLGLLVENTSIEQLGLARKVTISKDSTTIIADAASKDELQSRVAQLKKELSETDSVYDSEKLAERIAKLSGGVAVIKVGAATETELEDRKLRIEDAKNATFAAIEEGIVPGGGTALVHLSAYVPAIKEKLEDADERLGADIVQKALVAPASLIAQNAGIEGEVVVEKIRNGEWEVGYNAMTDTYENLIESGVIDPAKVTRCALQNAASVAGMVLTTQAIVVEKPKPRAPVPGAPQGLTV

SEQ ID NO: 10168 - protein, 588 aa, Trifolium pratense
MASTNALSSTSILRSPTNNQAQTSLSKKAKQHGRVNYRQNPNRFMVKAAAKDIAFDQHSRRAMQAGIDKLADAVGLTLGPRGRNVVLDEFGSPKVVNDGVTIARAIELPDPMENAGAALIREVASKTNDSAGDGTTTASILAREIIKLGLLSVTSGANPVSIKKGIDKTVAGLIEELEKLARPVKGGDDIKAVASISAGNDELIGKMIAEAIGKVGPDGVLSIESSSSFETTVEVEEGMEIDRGYISPQFVTNLEKSIVEFENARVLITDQKISAIKDIIPLLEKTTQLRAPLFIIAEDITGEALATLVVNKLRGILNVAAIKAPGFGERRKALLQDIAILTGAEYQASDLGLLVENTSIEQLGLARKVTISKDSTTIIADAASKDELQSRVAQLKKELSETDSVYDSEKLAERIAKLSGGVAVIKVGAATETELEDRKLRIEDAKNATFAAIEEGIVPGGGTALVHLSAYVPAIKEKLEDADERLGADIVQKALVAPASLIAQNAGIEGEVVVEKIRNGEWEVGYNAMTDTYENLIESGVIDPAKVTRCALQNAASVAGMVLTTQATVVEKPKPRAPVPGAPQGLTV

SEQ ID NO: 10169 - protein, 578 aa, Trifolium pratense
SILRSPTNNQAQTSLSKKAKQHGRVNYRQNPNRFMVKAAAKDIAFDQHSRRAMQAGIDKLADAVGLTLGPRGRNVVLDEFGSPKVVNDGVTIARAIELPDPMENAGAALIREVASKTNDSAGDGTTTASILAREIIKLGLLSVTSGANPVSIKKGIDKTVAGLIEELEKLARPVKGGDDIKAVASISAGNDELIGKMIAEAIGKVGPDGVLSIESSSSFETTVEVEEGMEIDRGYISPQFVTNLEKSIVEFENARVLITDQKISAIKDIIPLLEKTTQLRAPLFIIAEDITGEALATLVVNKLRGILNVAAIKAPGFGERRKALLQDIAILTGAEYQASDLGLLVENTSIEQLGLARKVTISKDSTTIIADAASKDELQSRVAQLKKELSETDSVYDSEKLAERIAKLSGGVAVIKVGAATETELEDRKLRIEDAKNATFAAIEEGIVPGGGTALVHLSAYVPAIKEKLEDADERLGADIVQKALVAPASLIAQNAGIEGEVVVEKIRNGEWEVGYNAMTDTYENLIESGVIDPAKVTRCALQNAASVAGMVLTTQAIVVEKPKPRAPVPGAPQGLTV

SEQ ID NO: 10170 - protein, 587 aa, Medicago truncatula
MASTNALSSTSILRSPTNQAQTSLSRKANQHGRVNYRQKVNRFVVKASAKDIAFDQDSRRAMQAGIDKLADAVGLTLGPRGRNVVLDEFGSPKVVNDGVTIARAIELPDAMENAGAALIREVASKTNDSAGDGTTTASILAREIIKLGLLSVTSGANPVSIKKGIDKTVAALVEELEKLARPVKGGDDIKAVASISAGNDELIGTMIAEAIGKVGPDGVLSIESSSSFETTVEVEEGMEIDRGYISPQFVTNLEKSIVEFENARVLITDQKISAIKDIIPLLEKTTQLRAPLLIIAEDITGEALATLVVNKLRGILNVAAIKAPGFGERRKALLQDIAILTGAEFQASDLGLLVESTPIEQLGLARKVTISKDSTTIIADAASKDELQSRVAQLKKELFETDSVYDSEKLAERIAKLSGGVAVIKVGAATETELEDRKLRIEDAKNATFAAIEEGIAPGGGTALVHLFAYVPAIKEKLEDADERLGADIVQKALVAPASLIAQNAGIEGEVVVEKIRSGEWEVGYNAMTDTYENLIEFGVIDPAKVTRRALQNAASVAGMVLTTQAIVVEKPKPRAAAAAAPQGLTV

SEQ ID NO: 10171 - protein, 584 aa, Glycine max
  misc_feature (196)..(196): Xaa can be any naturally occurring amino acid
MASTNALSSASILRSPNRQSLTRRANHNGRVNYRKPNNRFSVKASAKEIAFDQHSRSAMQAGIDKLADAVGLTLGPRGRNVVLDEFGSPKVVNDGVTIARAIELPDPMENAGAALIREVASKTNDSAGDGTTTASVLAREIIKLGLLSVTSGANPVSLKRGIDKTVQGLVEELEKKARPVKGGDDIKAVASISAGXDELIGQMIAEAIDKVGPDGVLSIESSSSFETTVEVEEGMEIDRGYISPQFVTNPEKLIVEFENARVLITDQKISAIKDIIPLLEKTTQLRAPLLIIAEDVTGEALATLVVNKLRGILNVAAIKAPGLCERRKALLQDIAILTGAEFQASDLGLLVENTSVEQLGLARKITISKDSTTIIADAATKDELQARVAQLKKELSQTDSVYDTEKLAERIAKLSGGVAVIKVGAATETELEDRKLRIEDAKNATFAAIEEGIVPGGGTALVHLSTHVPAIKDKLEDADERLGADIVQKALIAPAALIAQNAGIEGEVVVEKIKSGEWEVGYNAMADRYENLVEAGVIDPAKVTRCALQNAASVAGMVLTTQAIVVEKPKPKAPVAGAPQGLTV

SEQ ID NO: 10172 - protein, 586 aa, Populus trichocarpa
MATSNALSTASILCSPKQGGLRRKGNQQHNSRLNFGQSTRRFAVRANAKDIAFDQDSRAALQSGIDKLADAVGLTLGPRGRNVVLDEFGSPKVVNDGVTIARAIELPDPMENAGAALIREVASKTNDSAGDGTTTASVLAREIIKLGLLSVTSGANPVSIKKGIDKTVQGLVEELEKRARPVKGRDDIKAVATISAGNDELIGTMIADAIDKVGPDGVLSIESSSSFETTVEVEEGMEIDRGYISPQFVTNPEKLICVFENARVLVTDQKISAIKDIIPLLEKTTQLRSPLLIIAEDVTGEALATLVVNKLRGILNVSAIKAPGFGERRKAMLQDIAILTGAEFQASDLGLSIENTSIEQLGLARKVTISKDSTTIIADAASKDELQARIAQLKKELSETDSVYDSEKLAERIAKLSGGVAVIKVGAATETELEDRKLRIEDAKNATFAAIEEGIVPGGGAALVHLSTHVPAIKEKIKDADERLGADIVQKALVAPASLIAQNAGIEGEVVVEKLKESEWEMGYNAMTDKYENLVEAGVIDPAKVTRCALQNSASVAGMVLTTQAIVVEKPKPRTPAAASPQGLTV

SEQ ID NO: 10173 - protein, 581 aa, Canavalia lineata
MASTNALSSASILRSPNHQSLSRRANQNGRVNYRQPNHRFAVKASAKEIAFDQSSRAAIQAGIDKLADAVGLTLGPRGRNVVLDEFGSPKVVNDGVTIARAIELPDAMENAGAALIREVASKTNDSAGDGTTTASVLAREIIKLGLLSVTSGANPVSLKRGIDKTVQGLVEELEKRARPVKGGDDIKAVASISAGNDELIGKMIAEAIDKVGPDGVLSIESSSSFETTVEVEEGIEIDRGYISSFVTNLEKSIVEFENARVLVTDQKISAIKDIIPLLEKTTQLRAPLIIIAEDVTGEALATLVVNKLRGILNVAAIKAPSFGERRKAVLQDIAILTGAEFQASDLGLLVENTSIEQLGLARKVTISKDSTTIIADAASKDELQARVAQLKKELAETDAVYDSVKLAERITKLSGGVAVIKVGAATETELEDRKLRIEDAKNATFAIEVGIVLVDTALLHLSTHVPAIKDKLEDADERLGADIVQKALIAPASLIAQNAGIEGEVVVEKVKNGEWEVGYNAMTDRYENLVEAGVIDPAKVTRCALQNAASVAGMVLTTQAIVVEKPKPKAPTAAAPQGLTI

SEQ ID NO: 10174 - protein, 587 aa, Populus trichocarpa
MATSNALSTASILCSPKQGGLRRRGNQQNNSRLNYGLSSRRFSVRANAKDIAFDQKSRAALQSGIDKLADAVGLTLGPRGRNVVLDEFGSPKVVNDGVTIARAIELPDPMENAGAALIREVASKTNDSAGDGTTTASVLAREIIKLGLLSVTSGANPVSIKRGIDKTVQGLVEELEKKARPVKGRDDIKAVASISAGNDELIGTMIADAIDKVGPDGVLSIESSSSFETVVEVEEGMEIDRGYISPQFVTNPEKLICEFENARVLITDQKITAIKDIIPLLEKTTQLRAPLLIIAEDVTGEALATLVVNKLRGVLNVAAIKAPGFGERRKAMLQDIAILTGAEFQASDLGLSIENTSIEQLGLARKVTISKDSTTIIADAASKDELQARIAQLKKELSETDSVYDSEKLAERIAKLSGGVAVIKVGAATETELEDRKLRIEDAKNATFAAIEEGIVPGGGAALVHLSTCVPAIKDKIEDADERLGADIVQKALVSPASLIAQNAGIEGEVVVEKLKASEWEIGYNAMTDKYENLMEAGVIDPAKVTRCALQNSASVAGMVLTTQAIVVEKPKPKTPAAAATQGQYAV

SEQ ID NO: 10175 - protein, 147 aa, Glycine max
MEKIAAKSRSSQAKVVGSIISITGAFVLTLYKGHSIIKAHSHDLSIPLQHPFSFLKSGDADWVIAGILLTAECLIGSLCYIVQADVLKVFPDEVTIVLLQRDFHSHVYTCSFICSAKRKCLERACVSSIILTPPNCFFYCHGCHLPW

SEQ ID NO: 10176 - protein, 461 aa, Trifolium pratense
HEAAGDGTTTASILAREIIKLGLLSVTSGANPVSIKKGIDKTVAGLIEELEKLARPVKGGDDIKAVASISAGNDELIGKMIAEAIGKVGPDGVLSIESSSSFETTVEVEEGMEIDRGYISPQFVTNLEKSIVEFENARVLITDQKISAIKDIIPLLEKTTQLRAPLFIIAEDITGEALATLVVNKLRGILNVAAIKAPGFGERRKALLQDIAILTGAEYQASDLGLLVENTSIEQLGLARKVTISKDSTTIIADAASKDELQSRVAQLKKELSETDSVYDSEKLAERIAKLSGGVAVIKVGAATETELEDRKLRIEDAKNATFAAIEEGIVPGGGTALVHLSAYVPAIKEKLEDADERLGADIVQKALVAPASLIAQNAGIEGEVVVEKIRNGEWEVGYNAMTDTYENLIESGVIDPAKVTRCALQNAASVAGMVLTTQAIVVEKPKPRAPVPGAPQGLTV

SEQ ID NO: 10177 - protein, 587 aa, Pisum sativum; identical to SEQ ID NO: 10165

SEQ ID NO: 10178 - protein, 147 aa, Glycine max; identical to SEQ ID NO: 10175

SEQ ID NO: 10179 - protein, 587 aa, Pisum sativum; identical to SEQ ID NO: 10165

SEQ ID NO: 10180 - protein, 588 aa, Trifolium pratense; identical to SEQ ID NO: 10166

SEQ ID NO: 10181 - protein, 588 aa, Trifolium pratense; identical to SEQ ID NO: 10167

SEQ ID NO: 10182 - protein, 588 aa, Trifolium pratense; identical to SEQ ID NO: 10168

SEQ ID NO: 10183 - protein, 578 aa, Trifolium pratense; identical to SEQ ID NO: 10169

SEQ ID NO: 10184 - protein, 587 aa, Medicago truncatula; identical to SEQ ID NO: 10170

SEQ ID NO: 10185 - protein, 584 aa, Glycine max; identical to SEQ ID NO: 10171
  misc_feature (196)..(196): Xaa can be any naturally occurring amino acid

SEQ ID NO: 10186 - protein, 586 aa, Populus trichocarpa; identical to SEQ ID NO: 10172

SEQ ID NO: 10187 - protein, 581 aa, Canavalia lineata; identical to SEQ ID NO: 10173

SEQ ID NO: 10188 - protein, 587 aa, Populus trichocarpa; identical to SEQ ID NO: 10174

SEQ ID NO: 10189 - protein, 306 aa, Glycine max
MSVQKDQDKFFLSISQGEKKPFDFLRVLYDGCIAGGAAGVVVETALYPIDTIKTRLQVARDGGKIVLKGLYSGLAGNIVGVLPASAIFIGVYEPTKQQLLKSLPENLSAVAHFAAGAIGGIASSVVRVPTEVVKQRMQIGQFKSAPDAVRLIVANEGFKGLFAGYGSFLLRDLPFDAIELCIYEQLRIGYKLAAKRDPNDPENAMLGAVAGAVTGAVTTPLDVVKTRLMVQGSQNHYKGISDCVRTIVKEEGSHALFKGIGPRVLWIGIGGSIFFCVLEKTKKILAQKWHSKAETQNRVSSRQGLS

SEQ ID NO: 10190 - protein, 326 aa, Nicotiana benthamiana
MGPFALALDTKNSFAASSSASDASGRKMDNLQMVPKKFFASVNSGEEKPFDFLRILFEGVIAGGTAGVVVETALYPIDTIKTRLQAARGGGQIALKGLYSGLAGNLAGVLPASAIFVGVYEPAKQKLLKMLPENLSAVAHLTAGALGGLAASFVRVPTEVIKQRMQTRQFASAPDAVRLIVSKEGFKGLYAGYGSFLLRDLPFDAIQFCIYEQLRIGYKLAAKRDLNDPENAVIGAFAGALTGAITTPLDVIKTRLMVQGSANQYKGIIDCVRTIVTEEGAPALLKGIGPRVLWIGIGGSIFFGVLERTKRYLAQNRPDNAASKQD

SEQ ID NO: 10191 - protein, 326 aa, Capsicum annuum
MGPFALALDTKNSFVASSSASDASGRKMDSLQMLPKKFFASINNEEEKPFDFLRILFEGVIAGGTAGVVVETALYPIDTIKTRLQAARGGGQIVLKGLYSGLAGNLAGVLPASAIFVGVYEPAKQKLLKMFPENLSAVAHLSAGALGGIAASFVRVPTEVIKQRMQTRQFASPPDAVRLIVSKEGFKGLYAGYRSFLLRDLPFDAIQFCIYEQLRIGYKLAAKRELNDPENAVIGAFAGALTGAITTPLDVIKTRLMIQGSANQYKGIVDCVKTIVAEEGPPALLKGIGPRVLWIGIGGSIFFGVLERTKRFLAQNLPDNAASKQV

SEQ ID NO: 10192 - protein, 321 aa, Populus trichocarpa
MGPLTLAVDTKTSSKPHLDAPILKMQKTKPFASINAQEDSPFDFLRILFEGVIAGGTAGVVVETALYPIDTIKTRLQAARGGGKIMLKGLYSGLAGNLAGVLPASALFVGVYEPTKQKLLKTFPENLSAVAHLTAGAVGGIAASLIRVPTEVVKQRMQTGQFTSAPDAVRLIVSKEGFKGFYAGYGSFLLRDLPFDAIQFCIYEQLRIGYRVAAQRELNDPENAAIGAFAGALTGAITTPLDVIKTRLMVQGSANQYKGIVDCVSTVVREEGPTALLKGIGPRVLWIGIGGSIFFGVLERTKRLLAQRRPISDQQPNPKQD

SEQ ID NO: 10193 - protein, 327 aa, Vitis vinifera
MGPFTLAIDAKKSSLAVSDSSNRKVQNAQLGKKKFFASISTGEEKEFNFLRVLLEGIVAGGTAGVVVETALYPIDTIKTRLQAVRGGGKIVWNGLYSGLAGNLAGVLPASAIFVGVYEPTKQKLLQIFPENLTAVAHLTAGAIGGLAASLVRVPTEVVKQRMQTGQFASAPDAVRMIVSKEGFKGLYAGYRSFLLRDLPFDAIQFCIYEQMRIGYKLAAKRDLNDPENALIGAFAGALTGAITTPLDVIKTRLMVQGPANQYNGIIDCVQTIVREEGPPALLKGIGPRVLWIGIGGSIFFGVLERTKRALAQRRPSPNQHSDSPKQD

SEQ ID NO: 10194 - protein, 325 aa, Ricinus communis
MGPFTLAIDTKTSSKLPSDTAVRKVQSSSQLETRKAFASMSVKDDKPFDFLRTLFEGVIAGGTAGVVVETALYPIDTIKTRLQAAHGGGKIVLKGLYSGLAGNLAGVLPASALFVGVYEPTKQKLLQMFPENLSAVAHLTAGAIGGVAASLIRVPTEVVKQRMQTGQFTSAPDAVRLIISKEGFKGMYAGYGSFLLRDLPFDAIQFCIYEQLRIGYKAAARRELNDPENAVIGAFAGALTGAITTPLDVIKTRLMVQGSANQYTGIFDCVQTVVREEGPTALLKGIGPRVLWIGIGGSIFFGVLESTKRYLVQKRPTLKQHLKED

SEQ ID NO: 10195 - protein, 338 aa, Vitis vinifera
MGHPMPAVSAKSTPTFPPDVLKCSSQREQKKSFKEDKPFSFLHVFWEGLVAGGIAGVVVEAALYPIDTIKTRLQAAHGGGKIVLKGLYSGLAGNLAGVLPASAIFVGVYEPTKQKLLKTIPENLSAFAHLTAGAVGGAASSLVRVPTEVVKQRMQTGQFASATDAVQLIVAKEGFKGLYAGYGSFLLRDLPFDALQFCIYEQLRIGYKLAAQRDLNDPENAMIGAFSGAITGAITTPLDVIKTRLMVQGSANQYKGIFDCVRTVIREEGTPALFKGIGPRVLWIGIGGSIFFVILERTKQVVAQTHTRTEKKTWSRFLLKAIFWVLLCLDYTWNQYEY

SEQ ID NO: 10196 - protein, 366 aa, Vitis vinifera
MKIRKKEREKKIHASFPINPLLHLKPDWNFSLFWSCWVSMGPFTLAIDAKKSSLAVSDSSNRKVQNAQLGKKKFFASISTGEEKEFNFLRVLLEGIVAGGTAGVVVETALYPIDTIKTRLQAVRGGGKIVWNGLYSGLAGNLAGVLPASAIFVGVYEPTKQKLLQIFPENLTAVAHLTAGAIGGLAASLVRVPTEVVKQRMQTGQFASAPDAVRMIVSKEGFKGLYAGYRSFLLRDLPFDAIQFCIYEQMRIGYKLAAKRDLNDPENALIGAFAGALTGAITTPLDVIKTRLMVQGPANQYNGIIDCVQTIVREEGPPALLKGIGPRVLWIGIGGSIFFGVLERTKRALAQRRPSPNQHSDSPKQD

SEQ ID NO: 10197 - protein, 147 aa, Glycine max; identical to SEQ ID NO: 10175

SEQ ID NO: 10198 - protein, 461 aa, Trifolium pratense; identical to SEQ ID NO: 10176

SEQ ID NO: 10199 - protein, 587 aa, Pisum sativum; identical to SEQ ID NO: 10165

SEQ ID NO: 10200 - protein, 302 aa, Glycine max
MSNISMVEAKLPPGFRFHPRDEELVCDYLMKKVQHNDSLLLIDVDLNKCEPWDIPETACVGGKEWYFYTQRDRKYATGLRTNRATASGYWKATGKDRPILRKGTHVGMRKTLVFYQGRAPKGRKTEWVMHEFRIEGPHGPPKISSSKEDWVLCRVFYKNSEVLAKPSMGSCYEDTGSSTLPALMDSYISFDQTQTHADEFEQVPCFSIFSQNQTNPIFNHMTTMEPKFPLNHATTAYGGAPNLGYCLDPLSCDRKMLKAVLNQITKMERNPLNQSLKGSPSLGEGSSESYLSEVGMPHVWNY

SEQ ID NO: 10201 - protein, 302 aa, Glycine max
MSNISMVEAKLPPGFRFHPRDEELVCDYLMKKVQHNDSLLLIDVDLNKCEPWDIPETACVGGKEWYFYTQRDRKYATGLRTNRATASGYWKATGKDRPILRKGTHVGMRKTLVFYQGRAPKGRKTEWVMHEFRIEGPHGPPKISSSKEDWVLCRVFYKNSEVLAKPSMGSCYEDTGSSTLPALMDSYISFDQTQTHADEFEQVPCFSIFSQNQTNPIFNHMTTMEPKFPLNHATTTYGGAPNLGYCLDPLSCDRKMLKAVLNQITKMERNPLNQSLKGSPSLGEGSSESYLSEVGMPHVWNY

SEQ ID NO: 10202 - protein, 303 aa, Glycine max
MSNISMVEAKLPPGFRFHPRDEELVCDYLMKKVAHNDSLLMINVDLNKCEPWDIPETACVGGKEWYFYTQRDRKYATGLRTNRATASGYWKATGKDRSILRKGTLVGMRKTLVFYQGRAPKGNKTEWVMHEFRIEGPHGPPKISSSKEDWVLCRVFYKNREVSAKPRMGSCYEDTGSSSLPALMDSYISFDQTQTHADEFEQVPCFSIFSQNQTSPIFNHMATMEPKLPANHATNAYGGAPNLGYCLDPLSCDRKMLKAVLNQITKMERNPLNQSLKGSPSLGEGSSESYLSEVGMPHMWNNY

SEQ ID NO: 10203 - protein, 299 aa, Phaseolus vulgaris
MSNISMVEAKLPPGFRFHPRDEELVCDYLMKKLTHNDSLLMIDVDLNKCEPWDIPETACVGGKDWYFYTQRDRKYATGLRTNRATASGYWKATGKDRPILRKGTLVGMRKTLVFYQGRAPKGRKTEWVMHEFRIEGPHGPPKVSSSKEDWVLCRVFYKSREVSAKPSMGSCYEDTGSSSLPALMDSYISFDQTQAHADEFEQVPCFSIFSQNQANPIFNHMTTMEPKLPATTYGGAPNLGYCLDPLSCDRKVLKAVLSQITKMERNPLNQSLKGSTSFGEGSSESYLSEVGMPHMWNNY

SEQ ID NO: 10204 - protein, 306 aa, Medicago truncatula
MSNISMVEAKLPPGFRFHPRDEELVCDYLMKKVTHSDSFLMIDVDLNKCEPWDIPEAACVGGKEWYFYTQRDRKYATGLRTNRATASGYWKATGKDRAILRKGTLVGMRKTLVFYQGRAPKGRKTEWVMHEFRIEGPHGPPKISSSKEDWVLCRVFYKNREVATKPPSMGSCYDDTGSSSLPALMDSYISFDQAQFHTDEYEQVPCFSMFSQNQTNPIYNNITTNMEPKLPLANNNNASTFGGAPYSLDPLSCDRKVLKAVLSQLSKMERNPINDQNLKGSSPSLGEGSSESYLSEVGMPHMWNNF

SEQ ID NO: 10205 - protein, 316 aa, Ricinus communis
MSNISMVEAKLPPGFRFHPRDEELVCDYLMKKITHSDSLLLIEVDLNKSEPWDIPETACVGGKEWYFYSQRDRKYATGVRTNRATASGYWKATGKDRPVLRKGTLVGMRKTLVFYQGRAPKGRKSDWVMHEFRLEGPLGPPQIPQQKEDWVLCRVFYKNREVAAKPSMGSCYDDTGSSSLPPLMDSFITFDQTQPNLDEYYDEQVSCFSIFNQNQNNLIFPHINQTDSNIHTKSSTPSAFGQLIPMTTTTTTTTNTTSYPNLETLSCDKKVFKAVLNQLTKMENNPGSMHGSPSLGEGSSESYLSEVGMSNIWNHY

SEQ ID NO: 10206 - protein, 302 aa, Populus trichocarpa
MSNISFVEAKLPPGFRFHPRDEELVCDYLMKKASHCDSLLMIEVDLNKCEPWDIPETACVGGKEWYFYSQRDRKYATGLRTNRATASGYWKATGKDRHILRKGTLVGMRKTLVFYQGRAPKGKKTDWVMHEFRLEGPLGQPKTSSEKEDWVLCRVFYKNTREVVAKPSIRSCYDDTGSSSLPALMDSYITFDQTQPNLDEHEQVPCFSIFSQIQTNQNFPYITQMEVPNLPTKGTGPFGQVPMNITTHSDAFSCDTKVLKAVLNHFNMMESNANIKGSPSLGEGSSESYLSDVGMPNLWNHY

SEQ ID NO: 10207 - protein, 304 aa, Populus trichocarpa
MSNISFVEAKLPPGFRFHPRDEELVCDYLMNKASQCCDSLLMIEVDLNKCEPWDIPAARVGGKEWYFYSQRDRKYATGLRTNRATASGYWKATGKDRHVLRKGTLVGMRKTLVFYQGRAPKGKRTDWVMHEFRLEGPLGPPKISSDKEDWVLCRVFYKSNREVVAKPSMESCNNDTGSSSLPALLDSYITYEQTQPNLDEHEQVPCFSIFSQNQTSQNLLAPYTTQMEAPNAPAKCTSPFGKVPMDITTPLDSFSCDTKVLKTVLNNLTKMESYGNLKGSPSLGEGSSESYISEVGMSSLWNHY

SEQ ID NO: 10208 - protein, 299 aa, Phaseolus vulgaris; identical to SEQ ID NO: 10203

SEQ ID NO: 10209 - protein, 299 aa, Phaseolus vulgaris; identical to SEQ ID NO: 10203

SEQ ID NO: 10210 - protein, 303 aa, Glycine max; identical to SEQ ID NO: 10202

SEQ ID NO: 10211 - protein, 302 aa, Glycine max; identical to SEQ ID NO: 10200

SEQ ID NO: 10212 - protein, 926 aa, Glycine max
MASRFWTQGGSDSEEEESDYDEEVDTTVGEASGQAVTSRYLQDNASDSDDSDGQKRVVRSAKDKRFEEMASTVDQMKNAMKINDWVSLQESFDKINKQLEKVMRVTESERVPNLYIKALVMLEDFLAQALANKDAKKKMSSSNAKALNSMKQKLKKNNKQYEDLINKCRENPESEEEKEEEESDEEYDSDGEIIDPDQLQKPEAKSDSEASQYEDEKPDAGEGPWDQKLSKKDRLLDRQFMKNPSEITWDAVNKKFKEVVAARGRKGTGRFEQVEQLTFLTKVAKTPAQKLEILFSVVSAQFDVNPGLNGHMPINVWKKCVQNMLIILDILVQYPNIMVDDSVEPDENETQKGAEHNGTIRVWGNLVAFLERIDVEFFKSLQCIDPHTRDYVERLRDEPTFLVLAQNVQEYLERVGNFKAASKVALRRVELIYYKPQEVYDAMRKLTELTEDGDNGGEASEKEFEESRIPTAFVVTPEVVTRKPTFPENSRTLMDILVSMIYKYGDERTKARAMLCDIYHHALLDEFSIARDLLLMSHLQDSVQHMDISTQILFNRAMSQLGLCAFRVGLISEAHGCLSELYSGGRVKELLAQGVSQSRYHEKTPEQERLERRRQMPYHMHINLELLEAVHLVSAMLLEVPNMAANVHDAKRKVISKTFRRLLEVSEKQTFTGPPENVRDHVMAATRILRKGDFQKAFDIIVSLDVWKFVRNRDTVLEMLKDKIKEEALRTYLFTFSSSYESLSLDQLTKFFDLSVSRTHSIVSRMMINEELHASWDQPTGCILFQDVEHSRLQALVFQLTEKLSVLAESNEKATEARVGGGGLDLPLRRRDGQDYAAAAAAGSGTASTGGRWQDLSPSQPRQGSGRAGYGGRPMTLGQAAGSGYSRGRGRGSYGGSGRTSQRGSALRGPQGDGPARMVSLKGVRA

SEQ ID NO: 10213 - protein, 925 aa, Glycine max
MASRFWTQGGSDSEEEESDYDEEVDTTVGESGSQAVTSRYLQDNASDSDDSDGQKRIVRSAKDKRFEEMASTVDQMKNAMKINDWVSLQESFDKINKQLEKVMRVTESEKVPNLYIKALVMLEDFLAQALANKDAKKKMSSSNAKALNSMKQKLKKNNKQYEDLINKCRENPESEEEKEEESEEEYDSDGEIIDPDQLQKPEAKSDSEASQYEDEKPDAGEGPWDQKLSKKDRLLDRQFMKNPSEITWDAVNKKFKEVVAARGRKGTGRFEQVEQLTFLTKVAKTPAQKLEILFSVVSAQFDVNPGLNGHVPINVWKKCVQNMLIILDILVQYPNIVADDLVEPDENETQKGPEHNGTIRVWGNLVAFLERIDVEFFKSLQCIDPHTRDYVERLRDEPTFLVLAQNVQEYLERVGNFKAASKVALRRVELIYYKPQEVYDAMRKLTELTEDGDNGGEASEKEFEESRIPTAFVVTPEVVARKPTFPENSRTLMDVLVSMIYKYGDERTKARAMLCDIYHHALLDEFSTARDLLLMSHLQDSVQHMDISTQILFNRAMSQLGLCAFRVGLISEAHGCLSELYSGGRVKELLAQGVSQSRYHEKTPEQERLERRRQMPYHMHINLELLEAVHLVSAMLLEVPNMAANVHDAKRKVISKTFRRLLEVSEKQTFTGPPENVRDHVMAATRVLNKGDFQKAFDIIVSLDVWKFVRNRDTVLEMLKDKIKEEALRTYLFTFSSSYESLSLDQLTKFFDLSVCRTHSIVSRMMINEELHASWDQPTGCILFQDVEHSRLQALAFQLTEKLSVLAESNEKAAEARVGGGGLDLPLRRRDGQDYAAAAAAGSGTASSGGRWQDLSLSQPRQGSGRAGYGGRPMALGQAAGSGYSRGRGRGSYGGSGRTAQRGSALRGPQGDGSTRMVSLKGVRA

SEQ ID NO: 10214 - protein, 926 aa, Glycine max
MASRFWTQGGSDSEEEESDYGEEDEHSAGEQAPNQDVTSKYFVDNASDSDDSDGQKRVVRSAKDKRFEEMVSTVDQMKNAIKINDWVSLQESFDKINKQLEKVMRVTESEKVPNLYIKALVMLDDFLVQALANKDAKKKMSSSNAKALNSMKQKLKKNNKQYEELITKCRENPESEEEKEEEESEDEYESDDIEPEQLPEAKSDSEASQYDNEKQDAGDGPWDQKLSKKDRLLDKQFMKDPSEITWDTVNKKFKEVVAARGRKGTGRFEQVEQLTFLTKVAKTAAQKLEILFSVVSAQFDVNPGLNGHMPINVWKKCVQNMLVILDILVQHPNIVVDDSVEPDENETQKGVDYNGPIRVWGNLVAFLERIDVEFFKSLQCIDPHTRDYVERLRDEPLFLVLAQNVQEYLERVGNFKAASKVALRRVELIYYKPQEVYVAMKKLTELTEDGDNGVEASEEKGFEESRIPTAFVATPEVVARKPTFPENSRTIMDVLVSLIYKYGDERTKARAMLCDIYHHALLDEFSIARDLLLMSHLQDSVQHMDISTQILFNRAMSQLGLCAFRVGLISEAHGCLSELYSGGRVKELLAQGVSQSRYHEKTPEQERLERRRQMPYHMHINLELLETVHLVSAMLLEVPNMAANVHDAKRKLISKTFRRLLEVSDRQTFTGPPENVRDHVMAATRFLSKGDFQKAFDIIVSLDVWKFVRNRDTVLEMLKDKIKEEALRTYLFTFSSSYESLSLDQLTKFFDLPVSCTHSIVSRMMINEELHASWDQPTGCILFQDVEHSRLQALAFQLTEKLSILAESNERATEARIGGGGLDLPLRRRDGQDYAAAAAGSGTASSGGRWQDLSLSQPRQSSGRAGYVGGGGRPMALGQGSGYSRDRSGRGSGAGYQSGRYQGGSALRGPHGDVSTRMVSLKGVRA

SEQ ID NO: 10215 - protein, 984 aa, Medicago truncatula
MCIICIRPLRVEVKTLKKSFNVPGFFSIQDNRTRGFLLPIVLLLSFSSQMTSRFFYQGGDHSDTDDEPTDIDDEPSDTEPAPTDPNGKSKYYVDGNADDSDDDDGQKRVVKSAKDKRFDEMASTVDQIKNAIKINDWVSLQESFDKINKQLEKVMRVIESQKIPNLYIKALVMLEDFLAQASANKDAKKKMSPSNAKAFNSMKQKLKKNNKQYEDLIIKCRESPESEGEKDDDDDDSDDYDSDDEIIEPDQLRKPEPISDSETSELGNDRPGDDGDAPWDQKLSKKDRLLEKMFMKKPSEITWDTVNKKFKEILEARGRKGTGRFEQVEQLTFLTKVAKTPAQKLQILFSVVSAQFDVNPGLSGHMPINVWKKCVQNMLVILDILVQHPNIKVDDSVELDENETKKGDDYDGPIHVWGNLVAFLEKIDAEFFKSLQCIDPHTREYVERLRDEPQFVVLAQNVQEYLESIGDFKASSKVALKRVELIYYKPHEVYEATRKLAEMTVEGDNGEMSEESKGFEDTRIPAPFVVTPELVARKPTFPENSRTLMDVLVSLIYKYGDERTKARAMLCDIYHHALLDEFTVARDLLLMSHLQENVHHMDISTQILFNRAMSQLGLCAFRVGLVSEAHGCLSELYSGGRVKELLAQGVSQSRYHEKTPEQERLERRRQMPYHMHINLELLESVHLTSAMLLEVPNMAANVHDAKRKIISKNFRRLLEVSEKQTFTGPPETVRDHVMAATRVLINGDFQKAFDIIASLEVWKFVKNRDTVLEMLKDKIKEEALRTYLFTFSSSYDSLSVDQLTNFFDLSLPRVHSIVSRMMINEELHASWDQPTGCIIFRNVEHSRVQALAFQLTEKLSILAESNERATEARLGGGGLDLPPRRRDGQDYAAAAAGGGSGTSSGGRWQDLSYSQTRQGSGRTGYGGGRALSFSQAGGSGGYSRGRGTGGGGYQNSGRTQGGSTLRGPHGDTSTRMVSLRGVRA

SEQ ID NO: 10216 - protein, 935 aa, Medicago truncatula
MTSRFFYQGGDHSDTDDEPTDIDDEPSDTEPAPTDPNGKSKYYVDGNADDSDDDDGQKRVVKSAKDKRFDEMASTVDQIKNAIKINDWVSLQESFDKINKQLEKVMRVIESQKIPNLYIKALVMLEDFLAQASANKDAKKKMSPSNAKAFNSMKQKLKKNNKQYEDLIIKCRESPESEGEKDDDDDDSDDYDSDDEIIEPDQLRKPEPISDSETSELGNDRPGDDGDAPWDQKLSKKDRLLEKMFMKKPSEITWDTVNKKFKEILEARGRKGTGRFEQVEQLTFLTKVAKTPAQKLQILFSVVSAQFDVNPGLSGHMPINVWKKCVQNMLVILDILVQHPNIKVDDSVELDENETKKGDDYDGPIHVWGNLVAFLEKIDAEFFKSLQCIDPHTREYVERLRDEPQFVVLAQNVQEYLESIGDFKASSKVALKRVELIYYKPHEVYEATRKLAEMTVEGDNGEMSEESKGFEDTRIPAPFVVTPELVARKPTFPENSRTLMDVLVSLIYKYGDERTKARAMLCDIYHHALLDEFTVARDLLLMSHLQENVHHMDISTQILFNRAMSQLGLCAFRVGLVSEAHGCLSELYSGGRVKELLAQGVSQSRYHEKTPEQERLERRRQMPYHMHINLELLESVHLTSAMLLEVPNMAANVHDAKRKIISKNFRRLLEVSEKQTFTGPPETVRDHVMAATRVLINGDFQKAFDIIASLEVWKFVKNRDTVLEMLKDKIKEEALRTYLFTFSSSYDSLSVDQLTNFFDLSLPRVHSIVSRMMINEELHASWDQPTGCIIFRNVEHSRVQALAFQLTEKLSILAESNERATEARLGGGGLDLPPRRRDGQDYAAAAAGGGSGTSSGGRWQDLSYSQTRQGSGRTGYGGGRALSFSQAGGSGGYSRGRGTGGGGYQNSGRTQGGSTLRGPHGDTSTRMVSLRGVRA

SEQ ID NO: 10217 - protein, 936 aa, Medicago truncatula
MASRFWTQGNSDSDDDEPTDIDEPSSDTEPVDEPTNNTANRYIAGIHPDDSDDDDGQKRVVKSAKDKRFDEMASTVDQIKNAIKINDWVSLQETFDKINKQLDKVMRVIESQKIPNLYIKALVMLEDFLAQASSNKDAKKKMSPTNAKAFNSMKQKLKKNNKQYEDLIIKFRETPQSEEEKFEDDEDSDQYGSDDDEIIEPDQLKKPEPVSDSETSELGNDRPGDDDDAPWDQKLRKKDRLLEKMFMKKPSEITWDTVNNKFKEILEARGRKGTGRFEQVEQFTFLTKVAKTPAQKLQILFSVVSAQFDVNPGLSGHMPINVWKKCVQNMLVILDILVQHPNIKVDDSVELDENESKKGDDYDGPIHVWGNLVAFLEKIDAEFFKSLQCIDPHTREYVERLRDEPLFVVLAQNVQEYLESIGDFKASSKVALKRVELIYYKPHEVYEATRKLAELTVDGDNGEEVSEESKGFVDTRIIAPFVVTPELVARKPTFPENSRTLMDVLVSLIYKYGDERTKARAMLCDIYHHALLDEFAVARDLLLMSHLQENVHHMDISTQILFNRAMSQLGLCAFRVGLVSEAHGCLSELYSGGRVKELLAQGVSQNRYHEKTPEQERLERRRQMPYHMHINLELLESVHLTSAMLLEVPNMAANVHDAKRKIISKNFRRLLEVSEKQTFTGPPETVRDHVMAATRVLINGDFQKAFDIIASLEVWKFVKNRDTVLEMLKDKIKEEALRTYLFTFSSSYDSLSVDQLTNFFDLSLPRAHSIVSRMMINEELHASWDQPTGCIIFRNVELSRVQALAFQLTEKLSILAESNERASEARLGGGGLDLPPRRRDGQDYAAAAAGGGGGTSSGGRWQDLSYSQTRQGSGRAGYGGRALSFNQAGGSGGYSRGRGMGGGGYQNSSRTQGGSALRGPHGDVSTRMVSLRGVRA

SEQ ID NO: 10218 - protein, 946 aa, Vitis vinifera
MSSRFWTAQGDSDTEEEESDYEDGVERGGAAGESAPHAGSRYLQANASDSDDSDGQKRVVRSAKDKRFEEMSATVDQMKNAMKINDWVSLQESFDKINKQLEKVMRVTESDKVPTLYIKALVMLEDFLSQALANKDAKKKMSSSNAKALNSMKQKLKKNNKQYEDLINKYREHPESEEEGDEDEEMEEDEDSGSEFEEDPSKIAMRSDSEEDEEDGEDREDSAAEAGGGWEKKMSKKDKLMDKQFMKDPSEITWDTVNKKFKEIVAVRGRKGTGRIEQVEQLTFLTRVAKTPAQKLEILFSVVSAQFDVNPSLSGHMPINVWKKCVQNMLVILDILVQHSNILVDDVVEPEENETQKGADYKGTIRVWGNLVAFLERIDVEFFKSLQCIDPHTREYVERLRDEPLFLVLAQNVQDYLERVGDFKAASKVALRRVELIYYKPQEVYDAMKNLAEQTEDTENGESEAGEEPRVEESRGPPAFVVTPEVVPRKPTFPENSRTLMDILVSLIYNHGDERTKARAMLCDIYHHAILDEFSTARDLLLMSHLQDNVQHMDISTQILFNRAMAQLGLCAFRVGLIAEGHGCLSELYSGGRVKELLAQGVSQSRYHEKTPEQERIERRRQMPYHMHINLELLEGVHLICAMLLEVPNMAANTHDAKRKVISKTFRRLLEVSERQTFTGPPENVRDHVMAATRALSKGDFQKAFDVIKSLDFWKLLRNREDVLEMLRAKIKEEALRTYLFTYSLSYNTLSLDQLTKMFDLSETLTHSIISKMMVMEELHASWDQPTRCIVFHDVEHTRLQALSFQLTDKLTILAENNERAYEAKIGGGGLDLPLRRRDGQDYAGAASVGGKWQDNFSFSQGRQGGVRTGYGVGGRPLGPGSSAGTFSRDRGGQSRGTGGYSGGYQSTRYQDAAYGRTAYQTSSAVRGSQMDTSTRMVSLNRGVRA

SEQ ID NO: 10219 - protein, 935 aa, Medicago truncatula
MTSRFFYQGGDQSDTDDEPTDIDDEPSDTEPAPTDPNGKSKYLAGGNADDSDDDDGQKRVVKSAKDKRFDEMASTVDQIKNAIKINDWVSLQESFDKINKQLEKVMRVIESQKIPNLYIKALVMLEDFLAQASANKDAKKKMSPSNAKAFNSMKQKLKKNNKQYEDLIIKCRESPESEGEKDEDDEDSDEYESDDEMIEPDQLRKPEPVSDSETSELGNDRPGDDGDAPWDQKLSKKDRLLEKMFMKKPSEITWDTVNKKFKEILEARGRKGTGRFEQVEQLTFLTKVAKTPAQKLQILFSVVSAQFDVNPGLSGHMPISVWKKCVQNMLVILDILVQHPNIKVDDSVELDENETKKGDDYNGPINVWGNLVAFLEKIDAEFFKSLQCIDPHTREYVERLRDEPQFVVLAQNVQEYLESIGDFKASSKVALKRVELIYYKPHEVYEATRKLAEMTVEGDNGEMSEEPKGFEDTRIPAPFVVTLELVARKPTFPENSRTLMDVLVSLIYKYGDERTKARAMLCDIYHHALLDEFAVARDLLLMSHLQENVHHMDISTQILFNRAMSQLGLCAFRAGLVSEAHGCLSELYSGGRVKELLAQGVSQSRYHEKTPEQERLERRRQMPYHMHINLELLESVHLTSAMLLEVPNMAANVHDAKRKIISKNFRRLLEVSEKQTFTGPPETVRDHVMAATRVLINGDFQKAFDIIASLDVWKFVKNRDAVLEMLKDKIKEEALRTYLFTFSSSYDSLSVVQLTNFFDLSLPRVHSIVSRMMVNEELHASWDQPTGCIIFRNVEHSRVQALAFQLTEKLSILAESNERATEARLGGGGLDLPPRRRDGQDYAAAAAGGGSGTSSGGRWQDLSYSQTRQGSGRTGYGGGRALSFSQAGGSGGYSRGRGTGGGGYQNSGRTQGGSALRGPHGDTSTRMVSLRGVRA

SEQ ID NO: 10220 - protein, 1087 aa, Medicago truncatula
MVCSRWTKPQHGVIKCNVDRALFNNNSLMGYGMCFRDSMGQFLFGKSNWLHYRVTTMEAEAIGLLEAIKTAIEKGMHYVEFETDCKPVADALSLPTAPHNELDLIANNSDYVVSFVPRQANKVAHSIARASLSNPSGWEKKKSGVLQHPSSRQDKTITQEGGDQSDTDDEPTDIDDEPSDTEPAPTDPNGKSKYLAGGNADDSDDDDGQKRVVKSAKDKRFDEMASTVDQIKNAIKINDWVSLQESFDKINKQLEKVMRVIESQKIPNLYIKALVMLEDVLAQASANKDAKKKMSPSNAKAFNSMKQKLKKNNKQYEDLIIKCRESPESEGEKDEDDEDSDEYESDDEMIEPDQLRKPEPVSDSETSELGNDRPGDDGDAPWDQKLSKKDRLLEKMFMKKPSEITWDTVNKKFKEILEARGRKGTGRFEQVEQLTFLTKVAKTPAQKLQILFSVVSAQFDVNPGLSGHMPISVWKKCVQNMLVILDILVQHPNIKVDDSVELDENETKKGDDYNGPINVWGNLVAFLEKIDAEFFKSLQCIDPHTREYVERLRDEPQFVVLAQNVQEYLESIGDFKASSKVALKRVELIYYKPHEVYEATRKLAEMTVEGDNGEMSEEPKGFEDTRIPAPFVVTLELVARKPTFPENSRTLMDVLVSLIYKYGDERTKARAMLCDIYHHALLDEFAVARDLLLMSHLQENVHHMDISTQILFNRAMSQLGLCAFRAGLVSEAHGCLSELYSGGRVKELLAQGVSQSRYHEKTPEQERLERRRQMPYHMHINLELLESVHLTSAMLLEVPNMAANVHDAKRKIISKNFRRLLEVSEKQTFTGPPETVRDHVMAATRVLINGDFQKAFDIIASLDVWKFVKNRDAVLEMLKDKIKEEALRTYLFTFSSSYDSLSVVQLTNFFDLSLPRVHSIVSRMMVNEELHASWDQPTGCIIFRNVEHSRVQALAFQLTEKLSILAESNERATEARLGGGGLDLPPRRRDGQDYAAAAAGGGSGTSSGGRWQDLSYSQTRQGSGRTGYGGGRALSFSQAGGSGGYSRGRGTGGGGYQNSGRTQGGSALRGPHGDTSTRMVSLRGVRA

SEQ ID NO: 10221 - protein, 1047 aa, Vitis vinifera
  misc_feature (950)..(950): Xaa can be any naturally occurring amino acid
  misc_feature (994)..(994): Xaa can be any naturally occurring amino acid
MSSRFWTAQGDSDTEEEESDYEDGVERGGAAGESAPHAGSRYLQANASDSDDSDGQKRVVRSAKDKRFEEMSATVDQMKNAMKINDWVSLQESFDKINKQLEKVMRVTESDKVPTLYIKALVMLEDFLSQALANKDAKKKMSSSNAKALNSMKQKLKKNNKQYEDLINKYREHPESEEEGDEDEEMEEDEDSGSEFEEDPSKIAMRSDSEEDEEDGEDREDSAAEAGGGWEKKMSKKDKLMDKQFMKDPSEITWDTVNKKFKEIVAVRGRKGTGRIEQVEQLTFLTRVAKTPAQKLEILFSVVSAQFDVNPSLEWAHANKFQHSNILVDDVVEPEENETQKGADYKGTIRVWGNLVAFLERIDVEFFKSLQCIDPHTREYVERLRDEPLFLVLAQNVQDYLERVGDFKAASKVALRRVELIYYKPQEVYDAMKNLAEQTEDTENGESEAGEEPRVEESRGPPAFVVTPEVVPRKPTFPENSRTLMDILVSLIYNHGDERTKARAMLCDIYHHAILDEFSTARDLLLMSHLQDNVQHMDISTQILFNRAMAQLGLCAFRVGLIAEGHGCLSELYSGGRVKELLAQGVSQSRYHEKTPEQLCGKKELDMFLAALVERIERRRQMPYHMHINLELLEGVHLICAMLLEVPNMAANTHDAKRKVISKTFRRLLEVSERQTFTGPPENVRDHVMAATRALSKGDFQKAFDVIKSLDFWKLLRNREDVLEMLRAKIKEEALRTYLFTYSLSYNTLSLDQLTKMFDLSETLTHSIISKMMVMEELHASWDQPTRCIVFHDVEHTRLQALSFQLTDKLTILAENNERAYEAKIGGGGLDLPLRRRDGQDYAGAASVGGKWQDNFSFSQGRQGGVRTGYGVGGRPLGPGSSAGTFSRDRGGQSRGTGGYSGGYQSTRYQDAAYGRTAYQTSSAVRGSQMDTSTRMSLLLTFALNKWNQXILPCYIIRLGVAWTMFLLSASTGICATESEVSVFFSLTVLGTVXSNGPSFDSRFLTADVKDLTFLASASSLGDDNCHNTSKDIHSSLDVTKQLVSGY

SEQ ID NO: 10222 - protein, 846 aa, Glycine max
MAESFLFSIAESLLSKLASQAYEEASRVLGLYDHLKNLKDTLSLVQAVLLDADQKQEKNHELREWLRQLKRVFFDAENVLDEFECQTLQNQVIKAHGTTKDKMAQQIKDISMRLDKVAADRHKFGLQPIDVDTRVVHRREMREMTYSHVNDSDVIGREQDKGEIIELLMQQNPNDDHKSLSVIPIVGMGGLGKTTLAKFVFNDKGINKCFPLKMWVCVSDDFDLKQLIIKIINSADDSVFLADAPDRQKNLNKMDLEQLQNQLRNKLADQKFLLVLDDVWNEDRVKWVGLRNLIHVGAAAGSKILVTTRSHSIASMMGTASSHILQGLSLEDSWSLFVRWAFNEGEEENYPQLINIGREIVKKCRGVPLAVRTLGSLLFSKFEANQWEDARDNEIWNLPQKKDDILPALKLSYDLMPSYLRQCFALFSLYPKDYNFTSYGVIHLWGALGFLASPKKNRAQDDIAIQYLWELFSRSLLQDFVSHGTYYTFHIHDLVHDLALFVAKDDCLLVNSHIQSIPENIQHLSFVEKDFHGKSLTTKAVGVRTIIYPGAGAEANFEANKYLRILHLTHSTFETLPPFIGKLKHLRCLNLRKNKKIKRLPDSICKLQNLQFLFLKGCTELETLPKGLRKLISLYHFEITTKQAVLPENEIANLSYLQYLTIAYCDNVESLFSGIEFPVLKLLSVWCCKRLKSLPLDSKHFPALETLHVIKCDKLELFKGHGDQNFNLKLKEVTFVIMPQLEILPHWVQGCANTLLSLHLSYCLNLEVLPDWLPMLTNLRELNIDFCLKLRSLPDGMHRLTALEHLRIKDCDELCIKYKPQVGECWDQISHIKQITIDEQKIWKKR

SEQ ID NO: 10223 - protein, 324 aa, Glycine max
MGSLPHVVEDCMGFLQLYSDGSIFRSNGIEFKVSPIQDNSITYKDYLFDKRFNLSLRFYKPQQQHIALSNKKVPIVIFLHGGGFCFGSRTWPHIHNCCMRLASGLQAAVVSPDYRLAPEHRLPAAVDDAVEAVRWLQRQGLSLREDAWLSGGVDFDRVFVVGDSSGGNIAHHLAVRLGSGSREMDPVRVRGYVLFAPFFGGEVRTKSEEGPPEHMLSLELLDRFWRLSMPVGKSRDHPLANPFGPGSPNLEQEKLDPILVIVGGNELLKDRAKNYATRLKELDKDIKYVEFEGCEHGFFTHDSFSSEVAEEVIQILKRFMLANF

SEQ ID NO: 10224 - protein, 324 aa, Glycine max
MGSLPHVVEDCMGFLQLYSDGSIFRSNDIEFKVSPIQDNSITYKDYLFDKRFNLSLRFYKPQHVAPIDNNKKLPIVMFLHGGGFCFGSRTWPHIHNCCMRLASGLQAVVVSPDYRLAPEHRLPAAVDDAVEAVRWLQRQGLSLKEDAWLSGGVDFDCVFVVGDSSGGNIAHHLAVRLGSGSREMDPVRVRGYVLFAPFFGGEVRTKSEEGPPEHMLNLELLDRFWRLSMPVGESRDHPLANPFGPGSPNLEQVKLDPILVIVGGNELLKDRAKNYATRLKKLDKDIKYVEFEGCEHGFFTHDSFSSEVTEEVIQILKGFMLANF

SEQ ID NO: 10225 - protein, 332 aa, Glycine max
MAFPPHVVEDCMGLLKLLSDGTVLRSNINFQEQPQPTQHDNLVQFKDFVFLKKFNLHLRFYKPKFEDNDDDDNENNNKKLLPVVMFLHGGGFCFGSRAWPHMHSCCVRLATSLRAAVVAPDYRLAPEHRLPAAVDDGVEAVRWLQRQKGHHGGDEWVTRGVDFDRVFILGDSSGGNIAHHLAVQLGPGSREMDPVRVRGYVLLGPFFGGVVRTRSEVGPPEQMLTLELLDRFWRLSIPIGETRDHPLANPFGPNSPNLGHVKLDPILVIVGGNELLKDRAADYATRLREQGKNIEYVEFEGKEHGFLTHDSHSEAAEELVQIIKRFMLENSN

SEQ ID NO: 10226 - protein, 332 aa, Glycine max
MAFPPHVVEDCMGLLTLLSDGTVLRSNINFQEQPQPTQHDNLVQFKDFLFHKKFNLHLRLYKPKFDDNINNDDDKNNNNKSLPVVMFLHGGGFCFGSRVWPHIHSCCVRLATSLHAAVVTPDYRLAPEHRLPAAVDDGVEALRWLQRQGHHGGDEWVTRGVDFDRAFILGDSSGGNIAHHLAVQLGPGSREMDPVRVRGYVLLGPFFSGVVRTRSEVGPPEQMLTLELLDRFWRLSIPIGETRDHPLANPFGANSPNLGHVKLDPILVIVGGNELLKDRAVDYATRLKELGKNIEYIEFKGKEHGFLTHDSHSEAAEEVVQIIKRFMLENSH

SEQ ID NO: 10227 - protein, 378 aa, Glycine max
MPIFSATLGSFTSISSSFLSQSHLSPFVKTPCQWQHHYHTAKVLVSASGNTQIDQNPDSGLLQRPTPPDPLDDARQARRSSDWKAAKTYQDSKVIYNGRVEGFNSGGLLVRFYSVMGFLPFPQLSPVHASKEPEKSIQEIAQGLIGSIMSVKVILADEDNKKLIFSEKEAAWSKYSKQVNVGDIFEVRVGYVEDYGAFVHLRFPDGLYHLTGLIHVSEVSWDLIQDVRDILKVGDEVRAKVVGIDWGKSRINLSIRQLEEDPLLETLDKVIPQDGSADPDSMSGGDSGSIEPLPGLETILEELLQEDGIYDVRISRQGFEKRVVSQDLQLWLSNAPPTNQRFTLLARAGRQVQEIHLTTSLDQEGIRRALQRVLERVP

SEQ ID NO: 10228 - protein, 383 aa, Glycine max
MPIFSASLGSFTSISFLSTSQSQSQSHLSPFKLTVKTPWQWQHHHYLTSKVLVSASGNTQIPNTELLQRPTPPDPLDDVRQARRSSDWKAAKTYQDSKLIYNGRVEGFNSGGLLVRFYSIMGFLPFPQLSPVHASKEPEKSIQEIAQGLIGSIMSVKVILADEDNKKLIFSEKEAAWSKFSKQVNVGDIFEVRVGYVEDYGAFVHLRFPDGLYRLTGLIHVSEVSWDLIQDVRDILKVGDEVRVKVVGIDWGKSRINLSIRQLEEDPLLETLDKVIPQDGSADPDSMSGGDSGSIEPLPGLETILEELLQEDGIYDVRISRQGFEKRVVSQDLQLWLCNAPPTNQRFTLLARAGRQVQEIHLTTSLDQEGIKKALQRVLERVP

SEQ ID NO: 10229 - protein, 399 aa, Medicago truncatula
MAIFSATLGSFGAISFLSSSQSQQHDPSSSSIVNPFNFPKCPHKLPPPCQWHPHYRHHNPKIMVSSSSSSNNTHIDEFDSGLLQRPSAPDSYDALRQARRSSDWKAANAYRDSGLIYNGRVEGFNAGGLLVRFYSIMGFLPYPQLSPVHSCQEPDQTIKERARELIGAILSVKVIIVDEEKRKLVLSEKEASWFKHSKHINIGDLFEGRVGSVEDYGAFVHLRFPDGLYHLTGLIHISEVSWDLVQDVRDFLREGEEVRVKVISIDTVKMRLTLSIKQLEEDPLLETLDKVIRQDGSGVPNSISSTTSSPIDPLPGLDTILEELLQEDGINEARISRQGFEKRVVSQDLQLWLSNAPPMDQRFTLLARAGRQVQEIHLKTSLDQEGIKKAIQRVLERVP

SEQ ID NO: 10230 - protein, 844 aa, Populus trichocarpa; identical to SEQ ID NO: 9880

SEQ ID NO: 10231 - protein, 845 aa, Vitis vinifera; identical to SEQ ID NO: 9878

SEQ ID NO: 10232 - protein, 843 aa, Populus trichocarpa; identical to SEQ ID NO: 9881

SEQ ID NO: 10233 - protein, 849 aa, Vitis vinifera; identical to SEQ ID NO: 9879

SEQ ID NO: 10234 - protein, 846 aa, Glycine max; identical to SEQ ID NO: 9882

SEQ ID NO: 10235 - protein, 846 aa, Glycine max; identical to SEQ ID NO: 9883

SEQ ID NO: 10236 - protein, 843 aa, Nicotiana sylvestris; identical to SEQ ID NO: 9884

SEQ ID NO: 10237 - protein, 849 aa, Glycine max; identical to SEQ ID NO: 9885

SEQ ID NO: 10238 - protein, 853 aa, Glycine max; identical to SEQ ID NO: 9886

SEQ ID NO: 10239 - protein, 783 aa, Malus x domestica; identical to SEQ ID NO: 9887

SEQ ID NO: 10240 - protein, 836 aa, Medicago truncatula; identical to SEQ ID NO: 9873

SEQ ID NO: 10241 - protein, 838 aa, Glycine max; identical to SEQ ID NO: 9869

SEQ ID NO: 10242 - protein, 838 aa, Glycine max; identical to SEQ ID NO: 9870

SEQ ID NO: 10243 - protein, 837 aa, Vitis vinifera; identical to SEQ ID NO: 9875

SEQ ID NO: 10244 - protein, 835 aa, Vitis vinifera; identical to SEQ ID NO: 9876

SEQ ID NO: 10245 - protein, 839 aa, Ricinus communis; identical to SEQ ID NO: 9874

SEQ ID NO: 10246 - protein, 841 aa, Glycine max; identical to SEQ ID NO: 9871

SEQ ID NO: 10247 - protein, 854 aa, Vitis vinifera; identical to SEQ ID NO: 9902

SEQ ID NO: 10248 - protein, 838 aa, Malus x domestica; identical to SEQ ID NO: 9872

SEQ ID NO: 10249 - protein, 837 aa, Populus trichocarpa; identical to SEQ ID NO: 9903

SEQ ID NO: 10250 - protein, 844 aa, Vitis vinifera; identical to SEQ ID NO: 9889

SEQ ID NO: 10251 - protein, 842 aa, Vitis vinifera; identical to SEQ ID NO: 9890

SEQ ID NO: 10252 - protein, 842 aa, Ricinus communis; identical to SEQ ID NO: 9891

SEQ ID NO: 10253 - protein, 842 aa, Glycine max; identical to SEQ ID NO: 9892

SEQ ID NO: 10254 - protein, 845 aa, Glycine max; identical to SEQ ID NO: 9893

SEQ ID NO: 10255 - protein, 845 aa, Malus x domestica; identical to SEQ ID NO: 9894

SEQ ID NO: 10256 - protein, 844 aa, Glycine max; identical to SEQ ID NO: 9895

SEQ ID NO: 10257 - protein, 855 aa, Populus trichocarpa; identical to SEQ ID NO: 9896

SEQ ID NO: 10258 - protein, 841 aa, Lotus japonicus; identical to SEQ ID NO: 9897

SEQ ID NO: 10259 - protein, 836 aa, Gossypium barbadense; identical to SEQ ID NO: 9898
  misc_feature (666)..(666): Xaa can be any naturally occurring amino acid

SEQ ID NO: 10260 - protein, 834 aa, Medicago truncatula; identical to SEQ ID NO: 9905

SEQ ID NO: 10261 - protein, 844 aa, Glycine max; identical to SEQ ID NO: 9906

SEQ ID NO: 10262 - protein, 845 aa, Glycine max; identical to SEQ ID NO: 9907

SEQ ID NO: 10263 - protein, 844 aa, Malus x domestica; identical to SEQ ID NO: 9908

SEQ ID NO: 10264 - protein, 841 aa, Malus x domestica; identical to SEQ ID NO: 9909

SEQ ID NO: 10265 - protein, 839 aa, Vitis vinifera; identical to SEQ ID NO: 9910

SEQ ID NO: 10266 - protein, 841 aa, Vitis vinifera; identical to SEQ ID NO: 9911

SEQ ID NO: 10267 - protein, 829 aa, Citrus trifoliata; identical to SEQ ID NO: 9912

SEQ ID NO: 10268 - protein, 828 aa, Populus trichocarpa; identical to SEQ ID NO: 9913

SEQ ID NO: 10269 - protein, 823 aa, Populus trichocarpa; identical to SEQ ID NO: 9914

SEQ ID NO: 10270 - protein, 231 aa, Antirrhinum majus; identical to SEQ ID NO: 9888

SEQ ID NO: 10271 - protein, 838 aa, Glycine max; identical to SEQ ID NO: 9870

SEQ ID NO: 10272 - protein, 843 aa, Glycine max; identical to SEQ ID NO: 9877

SEQ ID NO: 10273 - protein, 832 aa, Medicago truncatula; identical to SEQ ID NO: 9868

SEQ ID NO: 10274 - protein, 836 aa, Medicago truncatula; identical to SEQ ID NO: 9873

SEQ ID NO: 10275 - protein, 853 aa, Glycine max; identical to SEQ ID NO: 9886

SEQ ID NO: 10276 - protein, 844 aa, Populus trichocarpa; identical to SEQ ID NO: 9880

SEQ ID NO: 10277 - protein, 823 aa, Medicago truncatula; identical to SEQ ID NO: 9918

SEQ ID NO: 10278 - protein, 844 aa, Glycine max; identical to SEQ ID NO: 9906

SEQ ID NO: 10279 - protein, 834 aa, Medicago truncatula; identical to SEQ ID NO: 9905

SEQ ID NO: 10280 - protein, 841 aa, Glycine max; identical to SEQ ID NO: 9871

SEQ ID NO: 10281 - protein, 356 aa, Phaseolus vulgaris
MSSISDLVNLNLSDSTERVIAEYIWVGGSGMDMRSKARTLSGPVKDPSKLPKWNYDGSSTGQAPGQDSEVILYPQTIFRDPFRRGNNILVMCDAYTPAGEPIPTNKRHNAAKIFSNPEVVAEEPWYGIEQEYTLLQKDVQWPVGWPLGGFPGPQGPYYCGIGANKAFGRDIVDSHYKACLYAGINISGINGEVMPGQWEFQVGPSVGISAADELWVARYILERITEIAGVVLSFDPKPIQGDWNGAGAHTNYSTKSMRNDGGYEVIKKAITKLEKRHKEHIAAYGEGNERRLTGKHETADMNTFIWGVANRGASIRVGRDTEKAGKGYFEDRRPASNMDPYVVTSMIAETTLLWKP

SEQ ID NO: 10282 - protein, 356 aa, Glycine max
MSLLSDLINLNLSDITDKVIAEYIWVGGSGMDMRSKARTLSGPVKDPSKLPKWNYDGSSTGQAPGQDSEVILYPQAIFKDPFRRGSNILVMCDAYTPAGEPIPTNKRNNAAKIFGHPDVAAEEPWYGLEQEYTLLQKDVQWPLGWPLGGFPGPQGPYYCGTGANKAFGRDIVDSHYKACIYAGINISGINGEVMPGQWEFQVGPSIGISAADELWVARYILERITEIAGVVLSFDPKPIQGDWNGAGAHTNYSTKSMRNDGGYEVIKKAIAKLEKRHKEHIAAYGEGNERRLTGRHETADMNTFVWGVANRGASIRVGRDTEKAGKGYFEDRRPASNMDPYVVTSMIAETTILWKP

SEQ ID NO: 10283 - protein, 356 aa, Glycine max
MSLLSDLINLNLSDITDKVIAEYIWVGGSGMDMRSKARTLSGLVNDPSKLPKWNYDGSSTGQAPGQDSEVILYPQAIFRDPFRRGNNILVMCDAYTPAGEPIPTNKRNKAAKIFSNPDVAAEEPWYGLEQEYTLLQKDVQWPLGWPLGGFPGPQGPYYCGTGANKAFGRDIVDSHYKACIYAGINISGINGEVMPGQWEFQVGPSVGISAADELWVARYILERITEIAGVVLSFDPKPIQGDWNGAGAHTNYSTKLMRNDGGYEIIKKAIAKLEKRHKEHIAAYGEGNERRLTGRHETADMNTFLWGVANRGASIRVGRDTEKAGKGYFEDRRPASNMDPYVVTSMIAETTILWKP

SEQ ID NO: 10284 - protein, 356 aa, Glycine max
MSLLSDLINLNLSDITDKVIAEYIWVGGSGMDMRSKARTLSGLVNDPSKLPKWNYDGSSTGQAPGQDSEVILYPQAIFRDPFRRGNNILVMCDAYTPAGEPIPTNKRNKAAKIFSNPDVAAEEPWYGLEQEYTLLQKDVQWPLGWPLGGFPGPQGPYYCGTGANKAFGRDIVDSHYKACIYAGINISGINGEVMPGQWEFQVGPSVGISAADELWVARYILERITEIAGVVLSFDPKPIQGDWNGAGAHTNYSTKLMRNDGGYEIIKKAIAKLEKRHKEHIAAYGEGNERRLTGRHEMADMNTFLWGVANRGAFIRVGRDTEKAGKGYFEDRRPAFNMDPYVVTSMIAETTILWKP

SEQ ID NO: 10285 - protein, 375 aa, Glycine max
MSLLSDLINLNLSDITDKVIAEYIWVGGSGMDMRSKARTLSGLVNDPSKLPKWNYDGSSTGQAPGQDSEVILYPQAIFRDPFRRGNNILLNLFPWCSHFISFNCNLFQVMCDAYTPAGEPIPTNKRNKAAKIFSNPDVAAEEPWYGLEQEYTLLQKDVQWPLGWPLGGFPGPQGPYYCGTGANKAFGRDIVDSHYKACIYAGINISGINGEVMPGQWEFQVGPSVGISAADELWVARYILERITEIAGVVLSFDPKPIQGDWNGAGAHTNYSTKLMRNDGGYEIIKKAIAKLEKRHKEHIAAYGEGNERRLTGRHETADMNTFLWGVANRGASIRVGRDTEKAGKGYFEDRRPASNMDPYVVTSMIAETTILWKP

SEQ ID NO: 10286 - protein, 356 aa, Hevea brasiliensis
MSLLSDLINLNLSDTTDKIIAEYIWIGGSGMDMRSKARTLSGPVSDPSKLPKWNYDGSSTGQAPGEDSEVILYPQAIFKDPFRRGNNILVMCDAYTPAGEPIPTNKRHAAAKIFSHPDVVAEEPWYGIEQEYTLLQRDVKWPIGWPLGGYPGPQGPYYCSIGADKSFGRDVVDSHYKSCLYAGINISGINGEVMPGQWEFQVGPAVGISAGDELWVARYILERITEIAGVVLSFDPKPIQGDWNGAGAHTNYSTKSMRHDGGYEVIKKAIEKLGLRHKEHIAAYGEGNERRLTGRHETADINTFLWGVANRGASIRVGRDTEKQGKGYFEDRRPASNMDPYVVTSMIAETTILWKP

SEQ ID NO: 10287 - protein, 356 aa, Vigna aconitifolia
MSLLSDLINLNLSDTTEKIIAEYIWIGGSGLDLRSKARTLPGPVSDPSKLPKWNYDGSSTGQAPGEDSEVIIYPQAIFKDPFRRGNNILVMCDAYTPAGEPIPTNKRHNAAKIFSHPDVVAEEPWYGIEQEYTLLQKDVNWPLGWPVGGFPGPQGPYYCGAGADKAFGRDIVDAHYKACLYAGINISGINGEVMPGQWEFQVGPAVGISAGDELWVARYILERITEIAGVVLSFDPKPIKGDWNGAGAHTNYSTKTMRNDGGYEVIKSAIEKLGKRHKEHIAAYGEGNERRLTGRHETADINTFLWGVANRGASIRVGRDTEKAGKGYFEDRRPASNMDPYVVTSMIADTTILWKP

SEQ ID NO: 10288 - protein, 356 aa, Gossypium herbaceum
MSLLTDLVNLNLSDCTDKIIAEYIWIGGSGMDLRSKARTLSGPVSDPSKLPKWNYDGSSTGQAPGEDSEVILYPQAIFKDPFRRGNNILVMCDAYTPAGEPIPTNKRCNAAKIFSHPDVAAEEPWYGIEQEYTLLQKDVKWPIGWPLGGYPGPQGPYYCGVGVDKAYGRDIVDSHYKACLYAGINISGINGEVMPGQWEFQVGPAVGISAGDELWVARYILERITEIAGVVLSFDPKPIQGDWNGAGAHTNYSTKSMRSDGGYEVIKKAIAKLGLRHKEHIAAYGEGNERRLTGRHETADINTFLWGVANRGASIRVGRDTEKAGKGYFEDRRPASNMDPYVVTSMIAETTILWKP

SEQ ID NO: 10289 - protein, 356 aa, Phaseolus vulgaris
MSLLSDLINLNLSDTTEKVIAEYIWIGGSGLDLRSKARTLPGPVKNPSELPKWNYDGSSTGQAPGQDSEVIIYPQAIFKDPFRRGNNILVICDAYTPAGEPIPTNKRHNAAKIFSNPDVVAEEPWYGIEQEYTLLQKEVNWPVGWPVGGFPGPQGPYYCGVGADKAFGRDIVDAHYKACVYAGINISGINGEVMPGQWEFQVGPAVGISAGDELWVARYILERITEVAGVVLSFDPKPIKGDWNGAGAHTNYSTKTMRNDGGYEEIKSAIQKLGKRHKEHIAAYGEGNERRLTGRHETADINTFLWGVANRGASIRVGRDTEKAGKGYFEDRRPASNMDPYVVTSMIADTTILWKP

SEQ ID NO: 10290 - protein, 356 aa, Gossypium hirsutum
MSLLTDLVNLNLSDCTDKIIAEYIWIGGSGMDLRSKARTLSGPVSDPSKLPKWNYDGSSTGQAPGEDSEVILYPQAIFKDPFRRGNNILVMCDAYTPAGEPIPTNKRCNAAKIFSHPDVAAEEPWYGIEQEYTLLQKDVKWPIGWPLGGYPGPQGPYYCGVGVDKAYGRDIVDSHYKACLYAGINISGINGEVMPGQWEFQVGPAVGISAGDELWVARYILERITEIAGVVLSFDPKPIQGDWNGAGAHTNYSTKSMRSDGGYEVIKKAIAKLGLRHKEHIAAYGEGNERRLTGRHETADINTFLWGVANRGASIRVGRDIEKAGKGYFEDRRPASNMDPYVVTSMIAETTILWKP

SEQ ID NO: 10291 - protein, 845 aa, Vitis vinifera; identical to SEQ ID NO: 9878

SEQ ID NO: 10292 - protein, 849 aa, Glycine max; identical to SEQ ID NO: 9885

SEQ ID NO: 10293 - protein, 383 aa, Glycine max; identical to SEQ ID NO: 10228

SEQ ID NO: 10294 - protein, 843 aa, Glycine max; identical to SEQ ID NO: 9877

SEQ ID NO: 10295 - protein, 845 aa, Glycine max; identical to SEQ ID NO: 9893

SEQ ID NO: 10296 - protein, 844 aa, Vitis vinifera; identical to SEQ ID NO: 9889

SEQ ID NO: 10297 - protein, 835 aa, Zinnia violacea; identical to SEQ ID NO: 9927

SEQ ID NO: 10298 - protein, 844 aa, Glycine max; identical to SEQ ID NO: 9895

SEQ ID NO: 10299 - protein, 844 aa, Populus trichocarpa; identical to SEQ ID NO: 9880

SEQ ID NO: 10300 - protein, 845 aa, Vitis vinifera; identical to SEQ ID NO: 9878

SEQ ID NO: 10301 - protein, 843 aa, Populus trichocarpa; identical to SEQ ID NO: 9881

SEQ ID NO: 10302 - protein, 849 aa, Vitis vinifera; identical to SEQ ID NO: 9879

SEQ ID NO: 10303 - protein, 846 aa, Glycine max; identical to SEQ ID NO: 9882

SEQ ID NO: 10304 - protein, 846 aa, Glycine max; identical to SEQ ID NO: 9883

SEQ ID NO: 10305 - protein, 843 aa, Nicotiana sylvestris; identical to SEQ ID NO: 9884

SEQ ID NO: 10306 - protein, 849 aa, Glycine max; identical to SEQ ID NO: 9885

SEQ ID NO: 10307 - protein, 853 aa, Glycine max; identical to SEQ ID NO: 9886

SEQ ID NO: 10308 - protein, 783 aa, Malus x domestica; identical to SEQ ID NO: 9887

SEQ ID NO: 10309 - protein, 836 aa, Medicago truncatula; identical to SEQ ID NO: 9873

SEQ ID NO: 10310 - protein, 838 aa, Glycine max; identical to SEQ ID NO: 9869

SEQ ID NO: 10311 - protein, 838 aa, Glycine max; identical to SEQ ID NO: 9870

SEQ ID NO: 10312 - protein, 837 aa, Vitis vinifera; identical to SEQ ID NO: 9875

SEQ ID NO: 10313 - protein, 835 aa, Vitis vinifera; identical to SEQ ID NO: 9876

SEQ ID NO: 10314 - protein, 839 aa, Ricinus communis; identical to SEQ ID NO: 9874

SEQ ID NO: 10315 - protein, 841 aa, Glycine max; identical to SEQ ID NO: 9871

SEQ ID NO: 10316 - protein, 854 aa, Vitis vinifera; identical to SEQ ID NO: 9902

SEQ ID NO: 10317 - protein, 838 aa, Malus x domestica; identical to SEQ ID NO: 9872

SEQ ID NO: 10318 - protein, 837 aa, Populus trichocarpa; identical to SEQ ID NO: 9903

SEQ ID NO: 10319 - protein, 844 aa, Vitis vinifera; identical to SEQ ID NO: 9889

SEQ ID NO: 10320 - protein, 842 aa, Vitis vinifera; identical to SEQ ID NO: 9890

SEQ ID NO: 10321 - protein, 842 aa, Ricinus communis; identical to SEQ ID NO: 9891

SEQ ID NO: 10322 - protein, 842 aa, Glycine max; identical to SEQ ID NO: 9892

SEQ ID NO: 10323 - protein, 845 aa, Glycine max; identical to SEQ ID NO: 9893

SEQ ID NO: 10324 - protein, 845 aa, Malus x domestica; identical to SEQ ID NO: 9894

SEQ ID NO: 10325 - protein, 844 aa, Glycine max; identical to SEQ ID NO: 9895

SEQ ID NO: 10326 - protein, 855 aa, Populus trichocarpa; identical to SEQ ID NO: 9896

SEQ ID NO: 10327 - protein, 841 aa, Lotus japonicus; identical to SEQ ID NO: 9897

SEQ ID NO: 10328 - protein, 836 aa, Gossypium barbadense; identical to SEQ ID NO: 9898
  misc_feature (666)..(666): Xaa can be any naturally occurring amino acid

SEQ ID NO: 10329 - protein, 834 aa, Medicago truncatula; identical to SEQ ID NO: 9905

SEQ ID NO: 10330 - protein, 844 aa, Glycine max; identical to SEQ ID NO: 9906

SEQ ID NO: 10331 - protein, 845 aa, Glycine max; identical to SEQ ID NO: 9907

SEQ ID NO: 10332 - protein, 844 aa, Malus x domestica; identical to SEQ ID NO: 9908

SEQ ID NO: 10333 - protein, 841 aa, Malus x domestica; identical to SEQ ID NO: 9909

SEQ ID NO: 10334 - protein, 839 aa, Vitis vinifera; identical to SEQ ID NO: 9910

SEQ ID NO: 10335 - protein, 841 aa, Vitis vinifera; identical to SEQ ID NO: 9911

SEQ ID NO: 10336 - protein, 829 aa, Citrus trifoliata; identical to SEQ ID NO: 9912

SEQ ID NO: 10337 - protein, 828 aa, Populus trichocarpa; identical to SEQ ID NO: 9913

SEQ ID NO: 10338 - protein, 823 aa, Populus trichocarpa; identical to SEQ ID NO: 9914

SEQ ID NO: 10339 - protein, 231 aa, Antirrhinum majus; identical to SEQ ID NO: 9888

SEQ ID NO: 10340 - protein, 838 aa, Glycine max; identical to SEQ ID NO: 9870

SEQ ID NO: 10341 - protein, 843 aa, Glycine max; identical to SEQ ID NO: 9877

SEQ ID NO: 10342 - protein, 832 aa, Medicago truncatula; identical to SEQ ID NO: 9868

SEQ ID NO: 10343 - protein, 836 aa, Medicago truncatula; identical to SEQ ID NO: 9873

SEQ ID NO: 10344 - protein, 853 aa, Glycine max; identical to SEQ ID NO: 9886

SEQ ID NO: 10345 - protein, 823 aa, Medicago truncatula; identical to SEQ ID NO: 9918

SEQ ID NO: 10346 - protein, 844 aa, Glycine max; identical to SEQ ID NO: 9906

SEQ ID NO: 10347 - protein, 834 aa, Medicago truncatula; identical to SEQ ID NO: 9905

SEQ ID NO: 10348 - protein, 841 aa, Glycine max; identical to SEQ ID NO: 9871

SEQ ID NO: 10349 - protein, 849 aa, Glycine max; identical to SEQ ID NO: 9885

SEQ ID NO: 10350 - protein, 845 aa, Vitis vinifera; identical to SEQ ID NO: 9878

SEQ ID NO: 10351 - protein, 410 aa, Glycine max
MAIWGLLLGAESKTHVGDAEVLKELKQGLEPGSVKPGSCVSSWDFTLDPCDNLFGDKFTCGFRCDVVVSGLSRVTELALDQAGYSGSLSFTWNLPYLQTLDLSNNYFSGQIPYSFSNLTRLSRLSLSSNSFSGEIPSSLGTLSNLQELYLDNNNLRGTIPQSFDNLANLKRLELQSNKLNTRLPNLGSLRNLKFLYLSDNSVTGTLPASLPVSLVQISLRNNNLSGVLVGESFKSLTRLQVVDFSSNQLSSAVPSVFFQLPSLQQLTLSFNEFTNLEAPYKGTESQSGLVAVDLSNNRLKGFLPSFMAVMPKLSSLSLENNEFTGRIPTQFGVKTVFPEKGVSSFGRLLLGGNYLLGGIPRPLLALKRDSANVSLVDNCLYRCPHSFFFCQGGQQKSLAQCNRFSPASTP

SEQ ID NO: 10352 - protein, 422 aa, Glycine max
MGTLCFPLFAIIAIFWGVLLGAASKTHVGDAEVLKELKQGLDPASVKPGSCVSSWDFTVDPCDNLFGEKFTCGFRCDVVVSGLSRVTELTLDQAGYSGSLSSFTWNLPYLQTLDLSNNYFSGQIPYSFSNLTRLSRLSLSFNSFSGEIPSSLGTLSDLQELYLDNNNLRGAIPESFNHLANLKRLELQSNKLNTHLPNLESLRNLKFLYLSDNFIAGALSASLPVSLVQISIRNNNLSGVLLGESFKSLRRLQVVDFSSNQLSGSVPSVFFELPSLQQLTLSFNKFTNLEAPFKGVESQSGLIAVDLSNNRLRGFLPSFMAVMPKLSSLSLENNEFTGRIPTQFGVKTVFPEKGVSSFGRLLLGGNYLLGGIPRPLLALKRDSANVSLVGNCLYRCPHSFFFCQGGQQKSLAQCNRFSPPST

SEQ ID NO: 10353 - protein, 843 aa, Glycine max; identical to SEQ ID NO: 9877

SEQ ID NO: 10354 - protein, 845 aa, Glycine max; identical to SEQ ID NO: 9893

SEQ ID NO: 10355 - protein, 844 aa, Vitis vinifera; identical to SEQ ID NO: 9889

SEQ ID NO: 10356 - protein, 835 aa, Zinnia violacea; identical to SEQ ID NO: 9927

SEQ ID NO: 10357 - protein, 844 aa, Glycine max; identical to SEQ ID NO: 9895

SEQ ID NO: 10358 - protein, 691 aa, Glycine max
MEMYDVSETRNADAYLIEGTDLNLHLTSPNIQQFQAMFNDGAPEFVADQNLYYPAATNYGYYCTGFESPGEWEDHHRIFGVDGPDIQYTGAQNESFPYVYYTPSYGFAQSPYNPYNPYIPGAMIGVDGSFGGAEQYYSLPNYQNTISSPAYIPVVQPDNFPNSSVDSSFDTSASVSRPDGKGLKHKFNSASGSFTRNSSKSLSNPTSSLARISEGPRDNTGVKKDLTSGRGFLNMASSPARSIDASTHAVDISNGNVLSHSNQLKIASPLSSGFSDYGSNANGQSVVAKLRPKVHVGKGLSEVNGSSDVLGEQNRGPRISNYKSKFPLAVKAYANKGDDNTQENIIISTDQYNREDFPVNYENAKFFVIKSYSEDDVHKSIKYNVWSSTPHGNKKLQSTHEDAKRIASGNFGSCPIFLFFSVNASGQFCGVAEMIGPVDFNKDMDFWQQDKWSGSFPVKWHIIKDVPNANFRHIILENNENKPVTNSRDTQEIMYSKGLEMLKIFKNHNLKTSLLDDFMYYENRQKIMQEEKAKLLIRSFKNPLVLPTLEPPRKLNFVIDIPPVGDEKNAKMDDEVDSLKQISSAGHIVSSSEITSTTSVDEKAEKGSVDKEDIASVLKIGSVTITPKQVETKPSGISVANKEPLDVITVGSMQIRVNGFAESSGFLKIGTIPLDPRTLQLDGGSRVKNGS

SEQ ID NO: 10359 - protein, 753 aa, Glycine max
MKTIVVPCIVLGFVGVLSECSRRPFLHSLPSPIPSYDGVSCQPCIELFSFSSFSFSGSSSGMEMYDVSQTRNADAYLIEGTDLNSHLTSPNIQQFQAMFNDGAPEFVVDQNLYYPAATNYGYYCTGFESPGEWEDHHRIFGVDGPDIQYTGAQNESFPYIYYTPSYGFAQSPYNPYNPYIPGAMIGVDGSFGGAEQYYSLPNYQNPISSHAYIPLVQPDNFPNSSVDSLFDTRASVSRPDGKGLKPKFNSASVSFTRNSSKSLSNPTSSLPRISEGPRDYTGVKKDMTSGRGFLNMASSPARSIDASTHPVDTISNGNVLSHHNQLKIASSLSSGFSDYGSNANGQSVVAKLRPKVHIGKGLSDVNGSSDVLGEQNRGPRISNCKSKFPLAVKAYTNIGDGNTQENIIISTDQYNREDFPVNYENAKFFVIKSYSEDDVHKSIKYNVWSSTPHGNKKLQSAHEDAKRIASGKFGSCPIFLFFSVNASGQFCGVAEMIGPVDFNKDMDFWQQDKWSGSFPVKWYIIKDVSNANFRHIILENNENKPVTNSRDTQEIMYSKGLEMLKIFKNHHLKTSLLDDFIYYENRQKIMLEEKTKLLIRSFENPLMLPTLEPPRKLNFVVDIPPVSVEKKAKMDDEFDSLKQTSSAGHIVSSSEVTSTASVDEKAEKGSVEKEDIASVLKIGSVTITPKQVETKPSGISVANKEPLDVITVGSMQVKVNGFAESSGLLKIGSIPLDPRTLQLDGGTRVKNGS

SEQ ID NO: 10360 - protein, 651 aa, Medicago truncatula
MFNEGAPEFVVDQSMYYPAPTNYGFYCTGFESPGEWEDHHRIFGVDGPDIQYTGAQDESFPYVYYTPNYGFAQSPYNPYNPYIPGAMIGVDGSFGGEQQYYSLPNYQNPISSPTYIPLVQPDNFHHSSVDSLYDNSASVNRLDGRGSKHKFNSASAAFTRNSSKPSSNQTSSFLRVPEGPRANALAKKDSTNGSVPNSGFLNFASSPSHLARSADVSFQSVDTFSNGNVLPHRNQFKVAAPLSNGFSDYGSNANGQSAIAKLRPKVHVAPIDVNRSGVLLGEQNRGPRISRPKHHLPIKAYTAKSGDANTQENIIYTDQYNREDFPIDNEIAKFFVIKSYSEDDVHKSIKYNVWSSTPHGNKKLQSAYEDARRKATGKSGGCPIFLFFSVNASGQFCGVAEMVGPVDFNKDMDFWQQDKWSGSFPVKWHIIKDVPNGNFRHIILENNEFKPVTNSRDTQEIMYRKGLEMLKIFKNYTLKTSLLDDFIYYENRQKVMQEEKTKFLMKGFVSIPVLAPPRKLDNVFEIHPASDEKNSKTDELGSVKHTSVSTAAHNVNSSDVTSTTSVDEKVENDAVDKQDISSVLKIGSVTITPRQVETKPSNTEPIDVVTVGSMQVRVNGFSESSGVLKVGSIPLDPRSLQAGKGTTYIKT

SEQ ID NO: 10361 - protein, 785 aa, Glycine max; identical to SEQ ID NO: 10005

SEQ ID NO: 10362 - protein, 735 aa, Vitis vinifera; identical to SEQ ID NO: 10006

SEQ ID NO: 10363 - protein, 698 aa, Oryza sativa Japonica Group; identical to SEQ ID NO: 10007

SEQ ID NO: 10364 - protein, 536 aa, Glycine max
MEVSVIGSSQANLGASELASREVGFCNLKNNLRALNDRVSFGRNNIRWEKAGISFTLRALQTEPVREEKKPSGIGTRSKMANGLRLFVGLPLDAVSYACNSINHARAISAGLKALKLLGVEGVELPIWWGIVEKDAMGQYDWSGYLAIAEMVQKVGLKLHVSLCFHGSKKPNIPLPKWVSQIGESQPSIFFTDRSGQHYKECLSMAVDNLPVLDGKTPVQVYQSFCESFKSSFSPFMGSTITSISMGLGPDGELRYPSHHWLPSNGKTQGAGEFQCYDQNMLSFLKQHAEASGNPLWGLGGPHDAPIYDQPPYNGFFNDGASWESTYGDFFLSWYSNQLIAHGDCLLSLASSTFGDSGVAIYGKIPLMHSWYGTRSHPSELTAGFYNTVNRDGYGPVAQMFARNSCKIILPGMDLSDANQPKENHSSPELLLAQIMEACKKHEVQVSGQNSSESGVPGGFEQIKKNLSGDNVLDLFTYHRMGASFFSPEHFPLFTEFVRSLKQPELHSDDLPAEEEVGAESAVVMSRDSTVSMQAA

SEQ ID NO: 10365 - DNA, 2098 bp, Glycine max
gagaagtgagggagagatgcagtagtagtagtgggtggtaacagagaagaaaatagggggtttggtttggtgagttacccaagagaaaggatgaagagggaacgcgagcagcttggttccatcgcagggacctcaagctgcggttattcaagcggaaaatcgaatctttgggaggaagaaggaggcatggacgagcttcttgcggtggtgggttacaaggttaggtcatcggacatggcggaagtggcgcagaagcttgagcgtctcgaagaagccatgggaaatgtccaagatgacctcccggagatttcaaacgacgtcgttcattacaacccttccgacatctccaactggctcgaaaccatgctttctaattttgaccctctcccctccgaagagccggaaaaggactccgcctcgtcggactacgatcttaaggctattccggggaaagcaatttatggagctagcgacgcgctaccaaaccctaagcgcgtgaaagccgacgagtcaaggcgcgcggtggtggtcgttgactcgcaggagaacgggatccgcctcgtgcacagcctcatggcgtgcgcggaggccgtggagaacaacaacctcgccgtggcggaggcgctggtgaagcagatcggcttcctcgctgtgtcgcaggttggagctatgaggaaagtcgcaatctacttcgccgaagcgctcgcgaggcgaatctacagagtcttccctctgcaacactctctctccgattctcttcagattcacttctacgaaacctgtccatacctcaagttcgcacacttcaccgcgaaccaggttatcctcgaagcgttccaaggaaagaaccgcgttcacgtgattgatttcggtatcaaccaggggatgcagtggccggcgctgatgcaagccctagcggttcgcaccggcggtcctccggttttccgactcaccggaatcgggccgccggcggcggacaactccgaccacctccaggaggtagggtggaagctcgcgcagctggcggaggagatcaacgtgcagttcgagtaccgtggcttcgtcgcgaacagcctcgccgatctcgacgcctccatgctcgatctccgggaaggcgaagccgtcgctgtgaactctgtcttcgagtttcacaagctcctcgcccgccccggcgcggtggagaaagtactctccgtcgtacggcagattcggccggagattgtcaccgtcgtcgagcaagaagcgaaccacaacagactgagttttgtcgaccggttcacggagtcactgcactattattcaaccctattcgactcgctggagggttcgcctgtgaaccctaacgataaggccatgtcggaggtttacttagggaagcaaatctgcaacgtggtggcgtgcgagggaatggaccgcgtggaaaggcacgagacgctgaaccagtggcggaaccggttcgtttcgaccggattttcttcggttcacttgggttcgaacgcgtacaagcaggccagcatgttgctcgcgctttttgcgggtggggatgggtatagggtggaagagaacaatggttgtctcatgttgggatggcacactaggcccttgattgccacctccgcgtggcaactcgctgcaactcgctgagtcgactcgccgattcctcaaccagctttttttttttgttttaattttattataatttctattcatgcccaccgaaaaaaaaaagggaacttgtggggatgagagggcagtgtgtaaatgtgctatgctgagctgtgagcactgattgcattagactgagacccaccattgtctattttcctgtcccaacttatgtctctctctctccaacccttaatttacctattttgcgtttgcctgaggattttcagattttgattttctcctctttttttgtaaaccttgaattttactttgctttcttttgggttgggatgggtggaatctcttgtaatttttcagggttggaaaatcaaaaggcttaatgtgtatttattttattatggtttaattaatatattagtagtattatgtagcttactggtgagtggtgatatactaataaattagaatc

SEQ ID NO: 10366 - DNA, 2678 bp, Glycine max
attggggttcgagctcggtcacgagcgttttccccttttcgttttgtgaaatatttttattctgaggacattaaaaaaagaagaagaaagtattgtacttatagtatataataattggttgatatttgggggcgagtgatgtgcgaagtgagggagatgcagtagaatagtaatagtggtaacaaaaggcaacagagaacagaagagaaaggaaaagagagggtttggtgagttacccaagagaaaggatgaagagagagcgccagcagcttggttccaacgcaggaacctcaagctgcggttattcaagcggaaaatcgaatctttgggaggaagaaggaggcatggacgagcttcttgcagtggtgggttacaaggtgaggtcatcggacatggcggaagtggcgcagaagctggagcgtcttgaggaagccatgggaaatgtccaagatgacctcacggacctttcaaacgacgccgttcattacaacccttccgacatctccaactggctccaaaccatgctttccaattttgaccctctcccctccgaggagcccgagaaggactccgcctcgtcggactacgatctcaaggctattccggggaaagcaatctatggaggtggtagtgacgcgctaccaaaccctaagcgcgtgagaaccgacgagtcaacgcgcgcggtggtggtcgttgacttgcaggagaacgggatccgcctcgtgcacagcctcatggcgtgcgcggaggcggtggagaacaacaacctcgccgtggcggaggcgctggtgaaacagatcggcttcctcgccttgtcacaggtcggagctatgaggaaagtcgcaacctacttcgccgaagcgctcgcgaggcgaatctacagagtcttccctcagcagcactccctctcggattctctacagattcacttctacgaaacttgtccttaccttaagttcgcgcacttcaccgcaaaccaggcgattctcgaagcgtttcaagggaaaaatcgcgttcacgtgattgatttcggaatcaaccaggggatgcagtggccggcactgatgcaagcccttgcgcttcgcaacgacggccctccggttttccggctaaccggaatcggaccgccggcggcggacaactccgaccacctccaggaggtagggtggaagctcgcgcagctggcggagaggatccacgtgcagttcgagtaccgcggcttcgtcgcaaacagcctcgccgatctcgacgcctccatgctggatctccgagaagacgagtccgtggcggtgaactccgtcttcgagtttcacaagctcctcgcccgccccggcgcggtggagaaagtcctctccgtcgttcggcagattcggcctgagatcctcaccgtcgtcgagcaagaagcgaaccacaacggactgagttttgtcgaccggttcaccgagtcactgcactattattcaactctattcgactcgctggagggttcgcctgtgaacccgaacgacaaggccatgtcggaggtttacttagggaagcaaatctgcaacgtggtggcgtgcgagggaatggaccgcgtggaaaggcacgagacgctgaaccagtggcggaaccggttcggttcgaccgggttttctccggttcacttgggttcgaacgcgtacaagcaggccagcatgttgctatcgcttttcgggggtggggatgggtatagagtggaagagaacaatgggtgtctcatgttgggatggcacactaggcccttgattgccacctccgtgtggcaactcgctacaaaatcggtggttgctgctcactgagtcgactcgccgattcctcagccagctttttctttttattttttgttttaaattaatttctaatcatgcccaccgaaaaaaaggaaaaaaaaaagaaaagaaggggaacttgaggggggattgagaggtcagtgtgtaattgtgctatgctgagctgtgagcactgattgcatgagcctgagacccaccattgtctattttcctgccccaacttatgtctctctccaacccttaatttacttattttgcatttgccgcatttgtaaaccttgattttattttacttggctttctttggggatgggttgggtggaaatctcttgtaatttttcagggttgggaaatcaaaaagcttaatgtgtatttatttattatggtttaattaatatattagttgtattatgtagcttgctggtgatataataaattagaatatatttttagtgtttccttttatttgaattaagtgatttcttgatgaatgggattggtatgagccatcattgtcaaattaagaatgatggtagccctcttgtctgggccatggagccggctttgatagaattggtatgaagacaagtaaccaaaatggagaatccgcggctagttgcattgcattagcacggataaagcaccttaccttatgtggcatacatttcaagagttgagtgatacacagcatcaaagtggatggaactgttactgcaaaacgcatgtattttgcataacaaaattactgcaatctcagtctcagtcgagtcccccttttgtgtcagacagagctctgtcatcagaaagtgaaaattttaaattaaattaaattataattaaaaaaaaggatcacccactttaatgtcc

SEQ ID NO: 10367 - DNA, 2067 bp, Glycine max
gagatgcagtagaatagtaatagtggtaacaaaaggcaacagagaacagaagagaaaggaaaagagagggtttggtgagttacccaagagaaggatgaagagagagcgccagcagcttggttccaacgcaggaacctcaagctgcggttattcaagcggaaaatcgaatctttgggaggaagaaggaggcatggacgagcttcttgcagtggtgggttacaaggtgaggtcatcggacatggcggaagtggcgcagaagctggagcgtcttgaggaagccatgggaaatgtccaagatgacctcacggacctttcaaacgacgccgttcattacaacccttccgacatctccaactggctccaaaccatgctttccaattttgaccctctcccctccgaggagcccgagaaggactccgcctcgtcggactacgatctcaaggctattccggggaaagcaatctatggaggtggtagtgacgcgctaccaaaccctaagcgcgtgagaaccgacgagtcaacgcgcgcggtggtggtcgttgacttgcaggagaacgggatccgcctcgtgcacagcctcatggcgtgcgcggaggcggtggagaacaacaacctcgccgtggcggaggcgctggtgaaacagatcggcttcctcgccttgtcacaggtcggagctatgaggaaagtcgcaacctacttcgccgaagcgctcgcgaggcgaatctacagagtcttccctcagcagcactccctctcggattctctacagattcacttctacgaaacttgtccttaccttaagttcgcgcacttcaccgcaaaccaggcgattctcgaagcgtttcaagggaaaaatcgcgttcacgtgattgatttcggaatcaaccaggggatgcagtggccggcactgatgcaagcccttgcgcttcgcaacgacggccctccggttttccggctaaccggaatcggaccgccggcggcggacaactccgaccacctccaggaggtagggtggaagctcgcgcagctggcggagaggatccacgtgcagttcgagtaccgcggcttcgtcgcaaacagcctcgccgatctcgacgcctccatgctggatctccgagaagacgagtccgtggcggtgaactccgtcttcgagtttcacaagctcctcgcccgccccggcgcggtggagaaagtcctctccgtcgttcggcagattcggcctgagatcctcaccgtcgtcgagcaagaagcgaaccacaacggactgagttttgtcgaccggttcaccgagtcactgcactattattcaactctattcgactcgctggagggttcgcctgtgaacccgaacgacaaggccatgtcggaggtttacttagggaagcaaatctgcaacgtggtggcgtgcgagggaatggaccgcgtggaaaggcacgagacgctgaaccagtggcggaaccggttcggttcgaccgggttttctccggttcacttgggttcgaacgcgtacaagcaggccagcatgttgctatcgcttttcgggggtggggatgggtatagagtggaagagaacaatgggtgtctcatgttgggatggccccctaggcccttgattgccacctccgtgtggcaactcgctacaaaatcggtggttgctgctcactgagtcgactcgccgattcctcagccagctttttctttttattttttgttttaaattaatttctaatcatgccccccgaaaaaaaggaaaaaaaaaagaaaagaaggggaacttgaggggggattgagaggtcagtgtgtaattgtgctatgctgagctgtgagcactgattgcatgagcctgagacccaccattgtctattttcctgccccaacttatgtctctctccaacccttaatttacttattttgcatttgccgcatttgtaaaccttgattttattttacttggctttctttggggatgggttgggtggaaatctcttgtaatttttcagggttgggaaatccaaaagcttaatgtgtatttatttattatggtttaattaatatattagttgtatt

SEQ ID NO: 10368 - DNA, 2090 bp, Phaseolus vulgaris
  misc_feature (1846)..(1846): n is a, c, g, or t
gtgcgtgtgtgatgtgtgaagtgaaggagatacagttatagcagtgagcagagaatagaagaagaaaaagtgtttagggatgaagagggggcgccaaaaccttgcttccaccgcaggcacctcaagcagcggctactccaccggaaaatcgaacctctgggaggacgaaggaggcatggacgagcttctcgctgtggtcggctacaaggtcagatcctccgacatggcggaggtggcgcagaagctggagcgtcttgaagaagctatgggaaacgttcaagacggtctcaaggagctttcagacgacgctgtacactacaacccctccgacatctccaactggctccaaaccatgctctccaatttcgattcccttactccagaagaaccggacaagggctacgatctcaaggctattccggggaaagcaatttacgacggaggtgtaggcaccgcgccaaaccctaagcgtctcaaatccgccgagtcaacgcaggcgtttgtggttgttgactcccaggagaacgggatccgcctcgtgcacagcctcatggcgtgcgcggaggccgtcgagaacaacaacctcgccgtggcggaggcgctggtgaagcagatcggattcctcgcggtgtcgcaggtgggaagtatgcggaaagtcgccacgtacttcgcggaagcgctcgcgaggcgaatctaccgcgttttccctctccagcagtcgctctcggactctctccagattcacttctacgcctgtccttacatcaagttcgctcacttcaccgcgaaccaggctattctggaagccttccaagggaagagccgcgtgcacgtcatagatttcggaatcaaccaggggatgcagtggccggcactgttgcaggctctcgcgcttcgtcccggcggccctcccgctttccgcctcaccggaatcggacctccggcagcggataactccgaccacctgcaggaagttggatggaagcttgcacagttggcggagatgatcaacgtgcggtttgagtaccgtggctttgtcgccaacagtctcgcggatctcgacgcgtccatgctcgacctccgagatgacgagcccgtggcggttaactccgtcttcgagtttcacaagctcctcgcgcgccctggtgccatcgagaaggtcctctccgttgtgcggcagattcggccggagattctgactgtggtggaacaagaatcgaatcataacggactgagttttcgcgaccgcttcactgagtcgctacactattattccactttgttcgactcgctggagggttcccctgtgaatccacaggacaaggcgatgtcggaggtatacctgggaaagcaaatctgtaatgtggtggcctgcgagggaacagaccgcgtggaacggcacgagacgctgaaccagtggcggagccggttcagttcgaccgggttttctccggttcatttgggttccaacgcgtttaagcaggctagcatgttgctagcacttttcgccggtggggatgggtatagggtggaggagaacagtgggtgtctcatgctggggtggcacacaagggccttgattgccacgtccgcctggcaactcgctgaaaaaccggtggttgcggtctgagtccggtccgagtccggtatgagtcaactcgccgattcgctcaaagcttttttattttcttttctttcaaattaatttttcaattcattcctacaaacaaaaaagtggaaacttgtggggatgagggggcagtgtgtaaatgtgctatgctgagctgtgagcactgattgcatgagacagagacccaccattgtccattttcctgtcccaactcangtctctctctctctctctctctcctactcttcacttaccttttttgcctttacctttgccttagggtttattatattttctctcctttttttaggaaaccttgctttttttctttctacttggtggctggaatctcttgtaatttgtcaggttgaatcgaaaagcttaatgtgtattatttgtttatggtttcatctgtgtaatatttaaattttttgaagtagatggagcagggatgttggtg

SEQ ID NO: 10369 - DNA, 1802 bp, Pisum sativum
aaaaaaagcagagaaagaaaagagaaagtcacaaattacaatcagaaaacagaatatagaacttgtgtgtgagtgagagagagaagtgtaagaagatgaagagagagcataaccaagaacacgaagatgcgagtatgactggtaaatcggagatttgttgggaagacgacggtggtatggatgagcttttagcggtggttggttacaaggtgaaatcatcagacatggctgaagttgctcaaaagcttgaacaacttgaacaagctatgggtaattttcaagatcaagatgaagccaccatcgctcaacacctctcaaacgacaccgttcattacaatcctgctgatatttctaactggcttcaaactatgctttccaattttgactctcaacctaatccctctgtttcctcttcctccgataacgaccttaacgccattcccggtaaagctatctacgccaacactgattcacagacagaggagtctcttccctctcggaaacgagtcaaacgagtaggttcttcttcttccaccgagtcaactcgtcccgttgttatggttgttgaaacgcaggagaaagggattattcttgttcatactttaatggcttgcgctgaagctgttgaacagaataatcgacctgtggcggaagctcttgtgaaacagatcggaaacctagcggtgtcgcaagaaggtgctatgagaaaagtggctacctatttcgcaataggtttggcacgaagaatctacgatgtgtttccacagcattctgtctccgattcgcttcagatccatttctatgaaacttgtccttacctgaagttcgctcacttcactgcgaatcaagctattcttgaagcttttcaaggaaaatcgcgtgttcatgttattgatttttctatcaatcaagggatgcagtggccggcgcttatgcaggcacttgccttgcgtcctggcggtcctcctgcttttcgtctcaccggaatcggtcctccggcgtcggataactccgaccatctccaacaggttggttggaggcttgctcagtttgcgcagacgattcatgttcagtttgagtaccgtggttttgttgctaacagtcttgctgatcttgatgcttccatgcttgaactccggtcaccggagactgagtccgtcgcagttaactctgttttcgagcttcataaactcaacgcgcgccctggtgcgcttgagaaggtgttttctgttatccgtcagattcggccggagattgtcaccgtcgtggagcaagaagcaaatcacaacggaccggcttttctcgaccggtttactgagtcgcttcactattactcgacgctgtttgactcgctggagagttcattggttgaaccgcaggataaggctatgtcagaggtttacctcgggaagcaaatctgcaacgtggtggcgtgtgaaggaacggaccgagtcgagcgtcacgaaacactgaaccagtggaggaaccggttcggttcagctgggttttctccggttcatttgggatccaacgcgttcaagcaagcgagtatgttgttggcacttttcgcaggtggggatggttacaaggtggaagagaatgatggttgtctcatgttaggatggcacaccaggccattgattgcaacctctgcttggaaactcgccgccaactcaatggtggtttcacactgagtcaactcgcgcgttttgcacacttgcacaccccaccccttttttttggaagtaaaaaagaaaaaaaattaattaattcatacccaccaaaaaaggaaagaaaaaaaa

SEQ ID NO: 10370 - DNA, 2267 bp, Vitis vinifera
agccccctttgggttccgagacccaccctctgcaactcctcctttcatctctccctcctccaatacaagcggcactagtattcaacatacccaccgcctgattcccatcaaccccccctcacactatgaagagggagtatcatcatcctcatcacccaacttgctccacgtcccccaccggcaagggtaagatgtgggatgccgacccccagcaagacgccggcatggatgagcttctcgctgttttgggctacaacgtcaaggcctccgacatggctgaggtcgctcagaagcttgaacagcttgaggaagttattgttaatgctcaggaggatggcctctctcatctcgcttccgagactgttcattacaacccctccgatctgtctaactggcttggaagcatgctctccgagttcaaccccactcccaattgcgcccttgacaacccattcttgcctcccatctcccctcttgattacaccaattgcagcacccaaccaaaacaggagccttccatctttgactccccgtctttggattacgatctcaaagcaattccaggtaaggctctttattcccatatcgaacagccgccgcaacagccaccggcccctcctctctatcaaagggataacaagcgattgaagcccacgacttcagctacagccaactcggtttcctctgttattgggggttggggagttcccaccgagtccgctcgcccagttgtccttgttgactcgcaagagaccggaatcaggctagtccacaccctaatggcctgtgcagaagcggtccagcaggaaaatctgaagctggctgaagcacttgtcaagcaaatcgggttcctggccgtgtctcaggcgggagccatgcggaaggtagccacctacttcgccgaaggtctagctcgtcgaatctaccgactctatcctgataagcctctcgactcctcgttctccgatattctccagatgcacttctatgagacctgcccctacctcaaattcgcccacttcaccgccaatcaagctatccttgaagccttcgaggggaaaaagcgggttcacgtcatcgatttcagcatgaaacaagggatgcagtggcctgcgctgatgcaagccctagccctccgtcccggcgggccgccctcgttccgtctaaccggaattgggcctccttccacggacaacaccgatcatctgcatgaagtgggttggaaattggcccagctggcggagacgattcatgtggagttcgaatacagaggtttcgtggccaacagtttggcagatctcgacgcatccatgcttgaactgcgagatggggagtccgtggcagtgaactcggtgttcgagttgcatagtttgctggctcgccctgggggtattgagagggtgctgtcggcggtgaaagatatgaaaccagacatagtgacgatagtagagcaggaagccaaccacaacggccccgttttcctagaccggttcaccgagtcgcttcactactactccactctgtttgactcattggaagggtgtggtgtgtcgccggtgaacacccaggacaagctgatgtcggaggtatacttggggcaacagatctgtaacgtggtggcctgcgaggggcctgagcgagtggagcggcacgaaacgctggctcagtggagagcccggttgggatcggcggggttcgacccagtgaacctagggtccaacgctttcaagcaagcgagtatgctgctggctctattcgcgggtggggatgggtacagggtggaggagaacaatgggtgtctgatgctgggttggcacactcgccccctcattgccacctccgcctggcaactcgctaacaaacctgccttgccctcctccacacctgcctccaactgagtcgagtccccctgtgttcgtgttcacttacccaacgggttgactcaccctaacccgcttgtatgaccgtgccttgtgaccatgggtgagatgagtgagtaagagagagagagagagagagagagagagagagagcgagggtgagaccccaccactccttgtggcatgtgctgtgtcacccttttgttttcccctcctttttttttcccccccttaatttcttttatttattaggtattttttgagggttttctttttttgggtggaatctttgtatttttgagggtgaatcaaaggtcaatgtgtatttattatatatataagtatatagtttggtaataaaagaataggacctttttttggtagcaa

SEQ ID NO: 10371 - DNA, 2100 bp, Brassica oleracea var. italica
acccaaaaaaagaaagcaaaccctggatccaagatcagagcccaaactcagaacaaaccagagttaaactatcgaactaaatcagagacatgaagagagatctccatcagtttcaaggtcctcctgatactagattccccaaccacgagacagcgaacaccggttcctcttctaaagacaagatgatgaaggttaaggaagaagaagacggcggaaacatggatgagcttctcgctgtgttgggttacaaggtgaggtcgtcagagatggcggaggttgcgttgaagctagagcagttagagaccatgatgggtaacgttcaagaagatggtttatctaatctcgcgacggatactgttcactacaacccgtcggagctttactcgtggcttgataacatgctcacggagtttaacccgccgccgccggagataaacaactcgtttctcgccggagctggtggttccgattacgacctcaaagccattcctggaaacgcgatttacgcgagatccaaccagttcgcgatagattcttcctcctcgtcgaaccaagctggtgataacagccagagcaccaagcgtttgaagtcatgctcgagccctgattcgttggttacaggaacaacggtaacaaccacaactattgagtcaactcggtccatggtcctggtggactcgcaagagaacggtgtgcgcctagtccacgcgctcatggcctgcgcggaagctatccagaacaacgatttgtctatagcggaagctctcgtcaagcagattggattcttggccgtgtctcaagccggagccatgaggaaagtggcgacgtacttcgccgaagctctcgcgcggcggatctaccgcctctctccgccgcagactcagatcgatcactctctctcggacacgctccagatgcacttctacgagacgtgcccttacctcaagttcgctcacttcacggccaaccaagccatcctcgaggctttcgaagggaagaagagagtccacgtcatcgacttctccatgaatcaaggcctgcaatggccggcgcttatgcaagcccttgcgttgagagaaggtggtcctcctgttttccggttaaccgggattggtcctccggcggcggataactccgatcatctccatgaggttgggtgtaagttagctcagctcgcggaagcgattcacgtcgagtttgagtatcgtggcttcgtggctaatagcttggccgatctcgatgcttcgatgcttgagcttagaccgagtgagatcgaagctgtggcggttaactctgttttcgagctacacaagctccttggccgtaccggtgggatagagaaagttctcggcgtggtgaaacagattaaaccggtgattttcacggtggttgagcaagagtcgaatcataacggtccggttttcctagaccggtttactgagtcgctgcattactattcgacactgtttgattctttggaaggtgttcccagtagccaagacaaagtcatgtcggaagtttacttagggaaacagatttgcaatctcgtggcttgtgaaggaccagaccgggtggagagacacgagacgctgagtcaatgggctaaccggttcggtacgtccggttttgcgccggcacatctcgggtctaacgcgtttaagcaagcgagtatgcttttggctttgtttaacggcggcgaaggttatagtgtggaggagaataatgggtgtttgatgttgggttggcatactcgacctctgataacaacctccgcttggaagctattggcggcgcactgagtggacacgtagactaggttggtggtggtatggtgggttgactcggttgtttgagtttcaaaatcagtggaccggtgatgagatatgttcggaccagaccagaaccgaactgaatcgaaccgttttgccgtttgtttaatttattttcacctgtttaaaattcttatatcttttttgttagctcgtttttaatttatgctttttggggtaagttaaatatgcagagtatgtatttactaaatgttttaaaataattcctcattttcatgccaaaaaaaaaaaaaaaaaaaaaaaaaaaaaa

SEQ ID NO: 10372 - DNA, 2295 bp, Vitis vinifera
agacccctttgggttccgagacccaccgtctgcaactcctcctttcctctctccctcctccaatacaagcggcaatagtattcaacatacccaccgcctgattcccatcaaccccccctcacactatgaagagggagtatcatcatcctcatcacccaacttgctccacgtcccccaccggcaagggtaagatgtgggatgccgacccccagcaagacgccggcatggatgagcttctcgctgttttgggctacaacgtcaaggcctccgacatggctgaggtcgctcaggagcttgaacagcttgaggaagttattgttaatgctcaggaggatggcctctctcatctcgcttccgagactgttcattacaacccctccgatctgtctaactggcttggaagcatgctctccgagttcaaccccactcccaattgcgcccttgacaacccattcttgcctcccatctcccctcttgattacaccaattgcagcacccaaccaaaacaggagccttccatctttgactccccgtctttggattacgatctcaaagcaattccaggtaaggctctttattcccatatcgaacagccgccgcaacagccaccggcccctcctctctatcaaagggataacaagcgatcgaagcccacggcttcagctacagccaactcggtttcctctgttattgggggttggggagttcccaccgagtccgctcgcccagttgtccttgttgactcgcaagagaccggaatcaggctagtccacaccctaatggcctgtgcagaagcggtccagcaggaaaatctgaagctggctgaagcacttgtcaagcaaatcgggttcctggccgtgtctcaggcgggagccatgcggaaggtagccacctacttcgccgaaggtctagctcgtcgaatctaccgactctatcctgataagcctctcgactcctcgttctccgatattctccagatgcacttctatgagacctgcccctacctcaaattcgcccacttcaccgccaatcaagccatccttgaagccttcgaggggaaaaagcgggttcacgtcatcgatttcagcatgaaacaagggatgcagtggcctgcgctgatgcaagccctagccctccgtcccggcgggccgccctcgttccgtctaaccggaattgggcctccttccacggacaacaccgatcatctgcatgaagtgggttggaaattggcccagctggcggagacgattcatgtggagttcgaatacagaggtttcgtggccaacagtttggcagatctcgacgcatccatgcttgaactgcgagatggggagtccgtggcagtgaactcggtgttcgagttgcatagtttgctggctcgccctgggggtattgagagggtgctgtcggcggtgaaagatatgaaaccagacatagtgacgatagtagagcaggaagccaaccacaacggccccgttttcctagaccggttcaccgagtcgcttcactactactccactctgtttgactcattggaagggtgtggtgtgtcgccggtgaacacccaggacaagctgatgtcggaggtatacttggggcaacagatctgtaacgtggtggcctgcgaggggcctgagcgagtggagcggcacgaaacgctggctcagtggagagcccggttgggatcggcggggttcgacccagtgaacctagggtccaacgctttcaagcaagcgagtatgctgctggctctattcgcgggtggggatgggtacagggtggaggagaacaatgggtgtctgatgctgggttggcacactcgccccctcattgccacctccgcctggcaactcgctaacaaacctgccttgccctcctccacacctgcctccaactgagtcgagtccccctgtgttcgtgttcacttacccaacggcttgactcaccctaacccgcttgtatgaccgtgcctcgtgaccatgggtgagatgagtgagtaggagagagagagagagagagagagagagagagagcgagggtgagaccccaccactccttgtggcatgtgctgtgtcacccttttgttttcccctcctttttttttccccgccttaatttcttttatttattaggtattttttgagggttttctttttttgggtggaatctttgtatttttgagggtgaatcaaaggtcaatgtgtatttattatatatataagtatatagtttggtaataaaagaataggaccttttttggtagcaaaaaaaaaaaaaaaaaaaaaaaaaaaaaaa

SEQ ID NO: 10373 - DNA, 1728 bp, Medicago truncatula
atggagagtgttaaaaccaattccaaatactcatccatcttaatagctatttttgttctctcatcttttgcattggctttagcaaatcccaaaactcacgagcatgagtttgttgttgaagcaactccagtgaagaggctgtgcaaaacacacaacaccataactgtgaatgggcaataccctggtccaaccctagaaatcaacaatggagacactttggttgtaaaagtcactaacaaagctcgttacaatgtcaccattcattggcatggtgttcgacaaatgaggacaggatgggcagatggtcctgaatttgtgactcaatgtcccattcgtcctggagggagttacacctaccgtttcactgttaatggacaagaagggacactttggtggcatgctcatagctcatggttaagggccactgtttatggtgctttaatcattcgtcctagggaaggagagccctacccttttcctaagcctaaccacgagacatccattcttttaggggaatggtgggatggaaatcccatagatgttgtgaggcaggctcaaagaactggagcagcaccaaatatatctgatgcatacactatcaatggtcaacctggtgacctttacaagtgctctaccaaaggcacaacaattattccaatacattccggagaaacaaacctcgtcagagtgatcaatgcggcactcaaccaaccacttttcttcacaattgccaaccacaaactaaccgtggttggcgcagatgcctcttacgttaaacccttcaccaccaacatcctcatgttaggacccggccaaaccaccgatgtcttaatacacgcaaaccaaccaccttccaaatactacatagctgcacgcgcctatcaatccgcccaaaatgcaccgttcgataacaccacaaccacagccattctccaataccacaattcaatcaaaacaaaaccaatcatgccaccactcccttcttacaataacaccaacatagttactaaatttagtagaagcttttttagtctgagaaaagctgaagtcccgacggaaattgatgaaaatctcttcttcacaattggtctaggactcaacaattgcccgaaaaatttcagaaaaagaaggtgtcaaggtcctattaacggaacacgcttcactgcgagcatgaacaatgtctcttttactcttccaaacaatatttccattttgcaggctcattaccatggaatccctggagtttttaccactgattttccagcaaaaccacccgttaaattcgattacaccggcaacgtgagccgttccctctggcaacctgttcccgggactaaagcttacaagttgaagtttggatcaagggtgcaaattgtgttgcaagataccagtattgttactcctgagaatcacccaattcaccttcatgggtatgatttttacattgttgctgaagggtttggtaattttgatgctaagaaagatacttcaaaattcaaccttgttgatccacctatgagaaatacagttgctgtacctgtcaacggttgggcagttatccggtttgttgcggataacaccagaattaaaaaagtcagtgcttggattctgcattgtcacttggatgttcatattggttggggtttggctactatactattggtagaggatggagttgggaaattgcaatcaatacaatcacctccacaggacctgcctatctgttag

SEQ ID NO: 10374 - DNA, 2127 bp, Glycine max
ctaaggtgttaattgctcataaaaaaaatggagtctgtcaagttcattaacatgaatgccaaacactcctccatcttcttattagccatgatctttgttctgatcttagcttcagcaaatgccaaaattcacgagcacgagtttgttgttgaagcaactccagtgaagaggctgtgcaaaacccacaacagcatcaccgtgaatgggcaatacccgggcccaacgttggaaatcaacaatggagacactttggttgtcaaagtcactaacaaagctcgttacaatgtgaccattcattggcacggtgttaggcaaatgagaacaggatgggcagatggaccagaatttgtgactcagtgcccgattcgtcctggaggaagttacacctaccgttttaccgttcaaggacaagaaggcacactttggtggcacgctcatagctcatggttaagggccactgtttacggtgctttaatcattcgtcctagggaaggagaaccctaccctttccccaagcctaagcacgaaacacccattcttcttggggaatggtgggacgcaaaccctattgatgttgtgaggcaggccacgcgaactgggggagctccaaacgtgtctgatgcatacactatcaatggtcaacctggtgatctttacaagtgctctagcaaagacactaccattgttccaatccattccggcgagactaaccttctacgtgttatcaatgctgcactcaatcaacctctcttcttcaccgtcgcaaaccacaaactcaccgtggttggcgccgacgcctcctacctcaaacccttcaccaccaaagtcctcatgctaggacccggtcaaaccaccgatgtattgatcaccggcgaccagccaccttccccctactacatggcggcgcgtgcgtaccaatctgcccaaaacgccgcgttcgacaacaccaccaccaccgccatactcgaatacaagtcacctcatcacagtaatcattctcaccatcattccaaaggagcactgaagaaaaaaaccaaaccgatcatgccctcactccctgcctacaacgatacaaacacagtcactgccttcagcaaaagctttagaagccctagaaaagttgaagtccccgctgaaatcgaccagagcctgttcttcactgtgggcttaggaatcaacaagtgccccaaaaactttggaccaaagaggtgtcagggacccattaatgggacgaggttcactgcgagcatgaacaacgtgtctttcgttctcccgaacaacgtgtccatcttgcaggctcaccacctcggaatccccggagtgttcaccactgattttccggggaagccgccggtgaagtttgattacaccggcaacgtgagtcgttcgctgtggcaacctgttcccgggacaaaggcacacaagttgaagtttgggtccagggtgcagattgtgttgcaggacactagcattgttactcctgagaaccaccctatccatcttcatggctacgatttctacatcgttgctgaggggttcggaaacttcgacgccaagaaagatacggccaaattcaaccttgttgatccacctttgaggaacactgtggccgtgcctgtaaatggatgggctgttattcgatttgtcgctgataaccctggtgcctggcttttgcattgtcacttggacgttcacatcggatggggtttggctacggtgttgttggtggagaacggagttgggaagttgcaatccatagagcctcctccgctggatcttcctctttgttaggatatcatttcaaaataatcgttggtccccaacaattggagttttgcagtttcattttcttagtttggaagctggtttatgtttgcattttgggagggtttttttttttgcttcattgcttgttttgattctacgttctttttatagacagataaattgggtttgaaacctaggaaaggtggtgatgcggttttaacccaaatatataccatctaaatagtcatagcccaaccagttaaattgatgatgttatttttccctcagagttcatgttacaaacagattgcaagttttgaatataaatatatcacctggattttattttttttgttacaa

SEQ ID NO: 10375 - DNA, 1770 bp, Glycine max
atggagcctgccaaaaccattcacaacaatgtcaaatactcccccatcttcttagccatctttgttctgatcttagcttcagcattgtcttcagcaaatgccaaaattcacgagcacgagtttgttgttgaagcaactccagtgaagaggctgtgcaaaacccacaacagcatcaccgtgaatggacaatacccgggcccaacgttggaaatcaacaatggagacactttggtcgtcaaagtcactaacaaagctcgttacaatgtgaccattcattggcacggtgttaggcaaatgagaacagggtgggcagatggaccagaatttgtgacttcagtgcccgattgtccaggaggaagttacacctaccgttttaccgttcaaggacaagaaggcacactttggtggcacgctcatagctcatggttaagggccaccgtttacggtgctttaatcattcgtcctagggaaggagaaccctaccctttccccaagcctaagcgcgagacacccattcttcttggggaatggtgggacgcaaaccctattgatgttgtgaggcaggccacacgaactgggggagccccaaacgtgtctgatgcatacactatcaatggtcaacctggtgatctttacaagtgctccagcaaagacaccaccattgtcccaatacatgccggcgagaccaaccttcttcgtgtcatcaatgctgcactcaatcaacctctcttcttcaccgtcgcaaaccacaaactcacagtggttggtgccgacgcctcctacctcaaacccttcaccaccaaagtcctcatactgggccccgggcaaaccaccgacgtcttaatcaccggcgaccagccaccttcccgctactacatggcggcgcgtgcgtaccaatccgcccaaaacgctgccttcgacaacaccactacaaccgccatactcgaatacaaatcaccgaatcaccacaataagcattctcaccatcgtgccaaaggagtaaagaacaaaaccaaacctataatgcctccactccctgcttacaacgacacaaacgcagtcacttccttcagcaaaagcttcagaagccctagaaaagttgaagtacccactgaaattgaccagagcctcttcttcactgtgggtttaggtatcaagaagtgccccaaaaacttcggaccaaagaggtgtcagggacccattaatgggacgaggttcactgcgagcatgaacaacgtgtctttcgttctcccgaacaacgtgtccatcttgcaggctcaccacctcggaatccctggagtgttcaccactgattttccggggaagccgccggtgaagtttgattacaccggcaatgtgagccgttcgctgtggcaacctgttcccgggacaaaggcacacaagttggagtttgggtcgagggtgcagattgtgttgcaggatactagcattgtcactcctgagaaccaccctatccatcttcatgggtacgatttctacattgttgcagagggtttcgggaacttcgacccaaagaaagatacggcgaaattcaaccttgttgatccacctttgagaaacacagtggctgtgcctgtaaatggatgggcagttattcgatttgtggctgataacccaggtgcatggcttttgcattgtcacttggacgttcacattggatggggtttggctacggtgttgttggtggagaatggagttgggaagttgcaatccatagagcctcctcctgtggatcttcctctttgttag

SEQ ID NO: 10376 - DNA, 1831 bp, Glycine max
atggaagctctcaagaccatcttcttagccctttctgttgtcttagcttcagcattgtattcagtcaatgccaaaatccaggagcatgagtttgttattcaagcaacgccagtgaagaggctgtgcaacacccacaacactatcacggtgaatggccaattccctggcccaacattggaagtcaacaatggagacactttggtcgtcaaagtcactaacaaagctcgttacaacgtgaccattcactggcatggaattcgacaaatgagaacaggatgggctgatggaccagaatttgtgactcagtgccctattcgtcctggagaaagttacacctatcgttttaccattcaaggacaagaaggaacactttggtggcatgctcatagctcatggctaagagcaacagtttatggtgctttaatcattcaccccagggagggagaggcatatcctttcactaagccaaagcgcgagacaccaattcttcttggggagtggtgggacgcaaacccgatcgatgttgtgagacaagccacacaaacaggagcagcacctaatatttctgatgcatacaccatcaatggtcaacctggtgatctttacaagtgttctagccaaggcagcaccatcgttccaatagattctggcgagacaaacctcctaagagtgatcaatgcagcactgaaccaacccttgttcttcaaagtggcgaaccacaagctcacggtggttggtgccgatgcttcctaccttaaacccttcaccaccaacgtcatcatgctgggaccaggccaaaccaccgatgtcctcatccaaggtgaccaacctcccacacgctactacatggccgcacgtgcctaccaatccgcgcaaaacgcaccgtttgacaacaccaccaccaccgccattctcgaatacaaatccgcaccttgccccgccaagggttcttcgatcaaacccgttatgccgtctctccctgcctacaacgacaccaacacagtcactgcattcagtaaaagcttcagaagccccagaaaagttgaagtccccgcagaaatcgatgaaaatcttttcttcaccattggccttggactcaacaattgcccaaaaaatttcaacgcaaaccaatgccagggaccgaatggaacgcgcttcactgccagcatgaacaatgtctcgtttgttctccccaacaacgtttcgatcttgcaggctcatcaccttggagtgcaaggcgtgttcaccactgattttcctacgcagcctcctgttaagtttgattacactggtaatgtgagtcgttccttgtggcaacctgttccagggactaaagtgaccaagttgaagtttggatcgagggtgcagattgtgttgcaggatactagcattgtgacccctgagaaccaccccattcaccttcacgggtatgatttctacatcgtggcggaggggtttgggaatttcgaccccaacaaagatacttccaagttcaaccttattgatccacctatgaggaacactgtggctgtgccagtcaatggatgggcagttatcagatttgttgctgacaacccaggagcttggattatgcattgtcacttggatgttcacatcggatggggtttggccactgtgctcttggtggataatggagttggcctgttgcaatccatagagccccctcccgaggatctgcctctatgttagaataatcaaaatcaaaattattgaatttgttaccatagttcagttccaaaattttcctagttcattgttgtttccctgtattggaggtatttctcctttttctctattttgttgttctttt

SEQ ID NO: 10377 - DNA, 1982 bp, Glycine max
atggaagctctcaagaccctcttcttagccatttttgttgtcttggcttccgcattgtattcagccaatgccaaaatccaggagcatgaatttgttattcaagcaacgccagtgaagaggctgtgcaacacccacagcaccatcacagtgaatggacaattccctggtccaacattggaagtcaacaatggtgacactttggtcgtcaaagtcactaacaaagctcgttacaatgtgactattcactggcatggaattcggcaaatgagaacaggatgggctgatggaccagaatttgtgactcagtgccctattcgtcctggagaaagttacacctatcgttttaccattcaaggacaagaaggaacactttggtggcatgctcatagctcatggctaagagccactgtttatggtgctttaatcattcaccccagggagggagaggcgtatcctttcactaagccaaagcgcgagactccaattcttcttggggagtggtgggacgcaaacccgatcgatgttgtgagacaagctacacaaacaggagcagcacctaatacttctgatgcatacaccatcaatggtcaacctggcgatctttacaagtgttctagccaaggcaccaccattgttccaatagattctggcgagacaaacctcctaagagtgatcaatgcagcactgaaccaacccttgttcttcacagtggccaaccacaagctcacagtggttggtgccgatgcctcctaccttaaacccttcaccaccaacgtcatcatgctgggaccaggccaaaccaccgatgtcctcatccaaggtgaccaacctcccacacgctactacatggccgcacgtgcctaccaatccgcccaaaacgcaccgtttgacaacaccaccaccaccgccattctcgaatataaatccgcaccgtgccccaccaagggttcttcgatcaaacccgttatgccgtctctcccagcctacaacgacaccaacacagtcactgctttcagcaaaagcttcagaagccccagaaaagttgaagtccccgcagaaattgatgacaatcttttcttcaccattggccttggactcaacaattgcccgaaaaatttcaatgcgaaccaatgccagggaccgaatggaacgcgtttcactgccagcatgaacaatgtctcgtttgttctcccaaacaacgtttccatcttgcaggctcatcaccttggtgtgcaaggagtgttcaccactgattttcctacgcaacctcctgtcaagtttgattacactggtaatgtgagtcgttctctgtggcaacctgttcaagggaccaaagtgaccaagttgaagtttggatcgagggtgcagattgtgttgcaggatactagcattgtgacccctgagaaccaccccattcaccttcatgggtatgatttctacatcgtggctgaggggtttgggaattttgatccgaacaaagatacttccaagttcaaccttgttgatccacctatgaggaacactgtggctgtgccagtgaatggatgggcagttatcagatttgttgctgacaacccaggagcttggatcatgcattgtcacttggatgttcacatcggatggggtttggccactgtgcttttggtggataatggagtaggcctgttgcaatccatagagccccctcctgaggatctgcctctatgttaggataatcaaaatcaaaattattgaatttgttaccatagttcagttccaaaattttcctagttcattgttgtttccctgtattggaggtatttctccttttgcttttattttgttgttcttttcatatagagataacccgggtttaaaagagacggtggtgcgtgatttcaacacggaatgccatcttatatggtcacaagcccgattgattaaattgatgtcggttgttttcttccccttgtggttaatgttattaagaaagatgattttga

SEQ ID NO: 10378 - DNA, 1776 bp, Medicago truncatula
attgcaatttgcaaccttaaccttcattcatacacattaaagttttgattatattgtttactactctaaacaatggaagttttcaacaccatcttcttagcaatttttcttctctttgcttctttagctaatgctaaagttcacgagcacgagtttgtcgtacaagcaactccagtgaagaggctgtgcaacacacaaatgagcatcactgtaaatggacaatttcctggtccaactttggaaattaataatggagatactttggttgtcaaagtcattaacaaagctcgttacaatgtcaccattcattggcatggagttagacaaatcagaacagggtgggctgatggaccagaatttgtgactcagtgtcctattcgtcctggagaaagttacacctatagatttaccattaatggacaagaaggtaccctttggtggcatgctcatagttcatggcttagagccacagtttatggagctctaatcattcatcctaaggaaggagatgcttatcctttcactaagccaaagcgtgaaacacccattcttctaggggaatggtgggatgcaaaccctattgatgttgtgagacaagccacacaaacaggagcagctccaaatatatctgatgcatacactattaatggtcaacctggtgatctttacaagtgctctagcaaaggcacaacaattgttccaatagattcaggagaaacaaacctcataagagtaatcaatgcagccttaaaccaacctcttttcttcacaattgcaaaccataaactaacagtagtaggtgctgatgcttcctatgtcaaaccattcacaaccaatgtcctcatgttaggacctggccaaaccactgatgttctcatccaaggtgaccaaccaccatcaagatactacatcgccggacgcgcttaccaatcagctcaaaacgctgcattcgataacacaacaaccactgccattcttgaatacaaatcatcaccttgtcctgcaaaggggggtgcaaatatcagaccaatcatgccttcattacctgcttacaatgacacaaacactgttacatcatttagtaaaagttttagaagcctaagaaatgttgaagttcctaatgaaattgatgaagatcttttcttcactattggattaggactcaacaattgtccatcaaatttcaattcaaatcaatgtcaaggaccgaacgggacgaggttcacttctagtatgaacaatgtgtcttttgtacttcctagcaatttttcaatcctgcaggctcataaacttggagtacaaggtgtttttacgacggattttcccacaaaacctcccgtgcaatttgattacaccggtaatgtgagtcggtcgttgtggcaaccgattcaagggactaaagttactaagttgagatttggatcaagggttcaggttgttttgcaagatactagtattgttactcctgagaatcaccctattcatcttcatggatatgatttctatattgttgccgagggatttggaaattttgaccctaagaaagatgcttcaaaatttaaccttgttgatccacctatgaggaacactgttgctgtacctgttaatggttgggcagttatcagatttgttgctgacaatccaggtgtttggattatgcattgtcacttggatgttcacattggatggggtttggcaactgtgtttttggtagaggatggagaagggctattggaatccatagaagctcctcctgaggacctgcctttgtgttag

SEQ ID NO: 10379 - DNA, 1980 bp, Populus trichocarpa
ttgctcctgcttctggcctcagcaatgtcattagctattgcaaaaacccaccaccatgattttactgttcaagcaacaaaagtgaaaaggctatgcaaaacccacaacagcatcacagtaaacggaatgttcccggggccaaccttggaagtgaagaacggagacactctagttgtaaaagttgtgaacagagcccgatataatgttaccattcactggcacggtattaggcaaatgagaacgggctgggcagatgggccagaatttgtgacacaatgcccaattagaccaggtggaagttacacctacaggtttactattgaaggacaagaaggaacactttggtggcatgctcatagctcctggcttagagccactgtttatggtgctctaatcatccatccaagagaaggatcatcgtatccattctctaagccaaagcgtgaaacacccatactccttggtgaatggtgggatgcgaaccctattgatgtggtgagggaagcaactagaaccggagcggctcctaatatatctgatgcttataccattaacggtcaacctggtgatctttttaactgctccagcaaagatactaccatcgttccgatcgactctggtgagacaaacctcctccgagtcatcaatgctgcactcaatcaaccacttttcttcaccatagccaaccacaagtttacagttgtcggtgccgatgcatcctatcttaagccctttaccacctcggtcatcatgctaggacctggccaaaccacagatgttttgatctctggcgaccaactacctggccgatattacatggcagcccgagcctatcaaagtgcgcaaaatgcaccatttgacaatactaccaccactgccattcttgaatacaaatctgttctttgccctgcgaagtgtacaaagaaaccatttatgccaccacttccagcttacaatgacacagctacagtcacagccttcagtagaagctttagaagtcctcgaaaagttgaggtcccgaccgatattgatgagaacctcttcttcacaatcggcctaggactcaacaattgtcccaaaaactttagagctaggcggtgtcaaggacccaacggcactcgtttcactgctagtatgaacaatgtgtcctttgtgtttccttcaaaagcctcgctattgcaagcatataagcaaaaaattcctggagtcttcaccaccgattttccagcaaaaccacaagtaaaatttgactacactggcaatgttagtcgttccctctttcaacctgctcgtggaactaagctgtacaagttgaagtacggatcaagggtgcagattgtgctacaggacacgagcatcgtcacaccagaaaaccatccgatccatctccatggatacgacttctacatcatcgctgaaggatttgggaatttcaatcccaaaactgataaatccaaattcaaccttgttgatccaccaatgaggaatacagttgcagtacccgtgaatggatgggcggttattagatttgttgctgacaacccaggtgtgtggctaatgcactgtcacttggatgttcacatcacatggggtctggccatggcgtttttggtagaagaggggattgggattttacagagtgtcgagcctcctccagccgatctgccaatatgttaattaatatcaatacataaaagaagattttacccattgttgacactcatagaagccaacaactacaggattttctttcacctttttttctgtttcttgtagtcaatttcccatgttgttcttccctgcatttggggacatatttcattattgtattcttcctctctgggcttacaagccttagaaacaagagctgccatcttattttagttattgacctgcttgttattgattttccagagctgtttttgtttctcttcgttaataatacattcaaactttttgaaaaaaaaaaaaaaaaaaaaa

SEQ ID NO: 10380 - DNA, 1992 bp, Glycine max
gacaaacatttcttcatttcattaaactacattttttgttacaacatgaaacgttttgtgttttctctagcatgggtttttgctcttgtgctagcttcttcgttggctcatgctgcggttgtggaacacacttttaatgtggaggacattactgtgcagcgtttgtgtcgtcaacaattgatcactgccgttaatggaaccctaccaggaccaacaattaacgctcgagagggtgatactattgtcgtccacgtattcaacaagtcaccctataatcttactcttcattggcacggtattattcaatttttaactccttggtcagacggtcctgaatttgtaactcaatgcccaataccttccggtagcagatacacatacaaatttaacctaacgggacaagaagggactctttggtggcatgcacactcatcatttctgcgtgctacggtctatggtgctcttttaattcggcctcgagttggacactcctacccttttcctaaagtatatcaagaagtccccatactgcttggagagtggtggaatgctaatgttgtagaggttgagcacaatgcaacagaatcccaaacagcgccaatcccctcagctgcgtatacaattaacggtttacccggcgattcctataactgctctgaaaatcaaatgtatcagctcaaagtcaagcaaggaaaaacctacttgctacgcattatcaatgctgcactcaatgagcaacacttcttcaaaatagcaaatcacacattcacagtggtagccatcgatgctctctacacccaacactacaaaactgatgttgtagtgcttgctccaggccaaaccgttgatgtcctctttagcacaaatcaacatgtggattcttattacatggcattcactccataccattcggccccacaaatcccaatcaacaactcaacaacaagagggctggtaatttatgagggtgccacatcagtagaaaagcccatattgccaaatctaccggcccaaaccgacacaccaacggcccacaagttctacaccaacatcacagggttggctggtggaccccactgggtcccggtgccacgtcaggtggatgagcacatgttcatcacttttgggcttaactttgacctttgcaaaaatgtttcaacaccaaatggttgctctgcaaggcaacctccactctctgccagcatgaacaatgagtcatttgtgttgcctcggggaaaagggttatcaatgcttgaagcattctataacaatgatgttaacggagtgtacactagagattttccaaatcagcctccgattgtgtttgactataccgacccaaacataacgagcactacagaattagccttcaaaatcgcacccaaatcaacgaaagtgaagacgttgaagttcaattcaactgttcagattgtacttcaaaacacggccattgtctctgcagagaaccaccccattcacattcacggcttcaatttccatgttttggctcaagggttcgggaattacaacgccactagagacgagcccaagttcaatcttgtcaaccctcagatacgtaacacaatttctgtccccgtcggaggatggtccgttgttagattccaagcaaataatccaggtgtttggcttgtgcattgccatttggaaactcatttgccgtgggggctagccatggctttcgaggttgagaatgggcccactccttctttatcagtgcctccgcctccagctgatcttcctaggtgctaagcgcacgccatgcgttcatgactaaaaacatttatagattggttaatgtttatacacatacatactttcataatgtggatttctaatatcatttgtttgattgagaaaaataaggtgtaataaaggaggaaagtttggctattctttcaaccatgtgacttgatggccaattgtactctatcaaataacatatgttaatctgtcattaattatattttttta

SEQ ID NO: 10381 - DNA, 1978 bp, Glycine max
tttatttcatttatcactcacgttcttcaacatgaaacgtttcgtgtttgctttggccagggcttttgctctttttctagcatgttccttggcttctggtgctgttgtggaacacattttcaatgtggaaaacattactgtgcaacgtttgtgtcgtcaacaagtgatcactgccgtcaatggaaccctgccaggaccaacaattaacgctcgagagggtgacactgtagtcgttcacgtattcaacaagtcaccctataatcttactattcattggcacggaatttttcaatttttaacaccgtggtcagacggtcctgaatttgcaactcaatgcccaatagcttctggtagtagttacacatacagatttaacctaactggacaagaagggactctttggtggcatgcacactcatcttttctacgtgctacggtctatggtgctcttctaattcggccacgactaggacactcgtacccgtttcctaaagtttatcaagaaatccctatactagttggagaatggtggaatgctaatgttgtagaggttgagcaaaatgcaacagaaactcaacagccgccaattgaatcagatgcatatacaattaatggtttacccagcgatctctataactgctctcaggatggaacataccaggtcaaagtaaagcaaggaaaaacctacttgttgcgcataatcaactctgcactcaataatcaacacttttttgaagtagccaaccatacattaaccgtagttgccattgatgctacctataccaatcactacgacaccaaggttgtagtgcttgctcctggccaaaccgttgatgtcctcctaagaacaaaccaaagtgtgggttcttactacatggccttcactccataccattccgctccacttgtacaaatcaacgccaacatgactcgaggagtgataatttatgagggtgccacgtcagcaaagcccatcatgccagatctcccggcccaaactgacactccaacggcccacaagttttacaccaacatcacagggttggccggtgggccccactgggtcccagtgccacgtcaagtggatgaacacatgtttataacttttgggcttagctttgacatatgtcgcagtgatacaggagtttgtcctgggccagtacccttattttctgcaaacatgaacaacgagtcctttgtgttgccacatggcaaaggggtatcaatgcttgaagcgtttttccggaacgatgttactggggtgtacactagagattttccggatcagcctgcggttgtgtttgactttaccaacccaaacataacgtcgtcgccagatacacctcgtgaattcctaatcgcacctaaatcaacgaaggtgaagacgttgaagttcaattcaacagttcagattgtgcttcagaacacggccatcattgccgctgagaatcaccctattcaccttcatggcttcaattttcatgttttggctcaagggtttgggaattacaacgccactagagatgaacccaagttcaattttgtgaatcctcaaatacgtaacacaattgctgtgccggtcggaggatggtccgtcattagattccaagcaaataatccaggtgtttggcttatgcattgccatttggaaactcatttgccgtggggactatccacggctttcgaggttgaaaacgggccttcaatcagagtgcctccgccaccggctgatcttcctaagtgctaaacgcatgccattcgttcatgaactatataccttacatttttagattaaaataaaatatagattggttaatgtttatacacatattttcgtaatgtgggtttctgattaatttgtttgattgagaaaaataaagtgtaataaaggacgaaagttaggctattctttcaaccgtaagtgtgacttggtagccacttctctgaaataacatatgttactttgtcattttaaaca

SEQ ID NO: 10382 - DNA, 1859 bp, Glycine max
atgaaacgtttggtgttttctttggcctgggcttttgctcttttgctagcttgttcattggtttctggtgctgttgtagaacacactttcaatataggtaacttgactgtgtcccgcttgtgcaatgaggaagtgattacaacagtcaatggaagcctgcctggaccaacgatttacgttgaagagggtgacactcttgtggtccatgcaaacaacaattcaccctacaatattacccttcattggcatggaatttttcaaattttgactgcatgggcagatggtcctgaatctgtaactcaatgtccaatacgtcctggtggaaagtatacctatagatttaacataacaggacaagagggtaccctatggtggcattcccactcttcttttctacgtgcaaccgtctatggagctcttatcattcgccctagaagaggaaactcacacccattcccttcagtttaccaagaagtccccatattgcttggggaatggtggaatggtaatgttgttgatgtggagaacaacgcaattgaaaccggtattggtccaaatttgtcagatgcttacacaattaatggcttgcctggagatacttacaattgctcccaaaatcagacataccaactccaagtgaaacatggagaaacctacctgttgcgcattatcaacgctgcactcaatgcacaacacttttttaagatagccaaccacacattcacagtggtagccatcgatgcttcctacactcaaccctacaacaccgatgttataatccttgccccaggccaaaccgtggatgcaatcataaccacaaaccaaactttgggttcttattacatggccttcactccatatcattccgccccaggcgtttcaatcaacaataacataacccgaggcgtggtcatttatgagaatgccacatcagcatcacctgtcatgccggacctcccagcccaaactgacacacccactgcccacaagttctacaccaacatcactgggttggctggtggacctcactgggtcccagtaccacttaatgtggatcaacatatgttgataacttttggaattgggttagaccattgtcccgaactagatccagaggggtgtggtggaagaaattttcgactctccgcaagtatgaataacgagtcatttgttttgcctaaagggctctcgatgatggaagctttttttcgaaatgttagcggggtgtacactagagattttccagataatcctccatttgtgtttaactacaccgatccaacgttagagaccaatggtacagacatagcgtttgcacctaaatcaaccaaggtgaagcctttgacgttcaattcaacagtgcaagttgttcttcagaatacggctatacttgcaagggagaaccatccaattcaccttcacagcttcaatttccatgttttagcacaagggtttggaaattatgattccaacgtggatgaatcaaagtttaatcttgataaccctcaaatacgtaacacgatttcggtgccggtaggaggatgggccgttattagattccaagcaaataatccaggtatatggctagtgcactgccacttggagactcatttgccatgggggttagccatggctttcgaggttgaaaatggacctgaaccatgggtgctgcctccgccaccagctgatttgccccaatgctaagtgaaaaatgcaccaattcactcataccttacaaattttaaaataaatgaaaggaagatttgatcatatatttatttactattacttttgacgatgtgaattcctaattcaatttgtttgactgggaataaagaaagtatgataaataatgatgg

SEQ ID NO: 10383 - DNA, 2028 bp, Glycine max
atgaccacaactattccttcatcacattcattttttgtggcattcctctttgccaccagcttcctttggtcttttcccgaatttgctctcgctacttcaaagcatggaagtgtcacaaggcactacaagtttgatataaggctgagaaacattacgaggctgtgccacacgaagagcatggttaccgtgaacggaaagttccctgggcctagagttgttgcaagagaaggtgacagaatagtggtaaaggtggttaatcatgttcccaacaatgtcagcatacactggcatggagtgagacagcttcaaagtggatgggcagatggtccatcttacataactcaatgccccattcaaactggccagagttatgtgtacaacttcacaattgttggacaaagaggaaccctcttctggcatgctcacatttcatggttaagagccactctctatggacccctaatcctcctccctaggcgcaacgaatcttacccatttgagaaaccctacaaggaagttcccatcctctttggtgagtggtggaatgctgatccagaggctgttattgcacaagcccttcagacaggggctggcccaaatgtctctgatgcctacacttttaacggtcttcctggacccctctacaattgctccaacaacgacacgttcaggttaaaggtgaagccagggaagacatatcttcttcgtttgatcaatgctgcactcaatgatgaactctttttcagcattgcaaaccacaccttggtaactgttgaagctgatgctacttacgttaaacctttcgagtcagagatcatcgtaatagggccaggacaaacctcaaactttctgttaaagacaaaacctgagtacccaaatgtcaatttcttgatgctagcaagaccatatttcactggcatgggaactttcgacaattccacagttgctggcattcttgagtacaagaaaccgcttgttgctccaaaaaacactattcccactttgaaaccctctcttccagccatcaatgacacttccttcgttgccaacttcagtagtaaattcctcagtttgaacactgacaagtaccctgcaaaggtgcctcaaaccgttgacaagagcttcttcttcacaattggacttggaacaagtccttgccccaaaaaccaaacatgccaaggaccaaacaacagttcaaagtttgcagcctcaatgaacaatatatccttcactcttccttccatagcacttcttcagcaacatttcttcggccaagctaataatggcatttacaccactgatttccctgccatgccactcatgccattcaactacacggggaccccaccgaacaacacaagggtcagtaatggaacaaagactgtggtgataccctttaacacaagggtgcaagtggtgctccaagacactagcattttgggagctgagagccaccctttgcaccttcatggctttaacttctatgttgtgggtcaaggctttgggaactttaatcctaacactgaccctccaaaattcaaccttgttgaccccgttgaaaggaacactgttggtgtgccctctggtggttgggttgcaatcagattccttgctgacaacccaggtgtttggctaatgcattgccattttgatgtccaccttagttgggggttgaggatggcttggattgttgaggatgggaagctacctaatcagaagttgcctcctccaccagctgatctccctaagtgttgatgattttctggaccactggcatctgcaaatttttccttcatctttcacaccatttgattttccattaattctaagttaatttccggatttttggtttgtctactatgaaagagtgaagagtcatcaccggcattggcgtttcagtaatttctttctttgtattaatctgtcaggttctggatgacttttctatacctccacctaattttctagtgccaataaagtagggggtggctggagttataccatccagaatatcaatgcattacttcc

SEQ ID NO: 10384 - DNA, 2063 bp, Glycine max
atgatcaaacctattccttcatcaccttcactttttgtggcattcctctttgccaccagcttcctttggtcttttcccgaatttgttctcgctacttcaaagcatggaagtgctacaaggcactacaagtttgatataaggttgagaaacgttacgaggctgtgccacacgaagagcatggttaccgtgaacggaaagttccctgggcctagagttgttgcaagagaaggtgacagaatagtggtaaaggtggttaatcatgttcccaacaatgtcagcatacactggcatggagtgagacagcttcaaagtggatgggcagatggtccatcttacataactcaatgcccgattcaaactggccagaattatgtgtacaacttcaccattgttggacaaagaggaaccttattctggcatgctcacttttcatggttaagagccactctctatggacccctaatcctcctacctaggcgcaacgaatcttacccatttgagaaaccctacaaggaagttcccatcatctttggtgagtggtggaacgctgatccagaggctgttattgcacaagcccttcagacaggggctggcccaaatgtctctgatgcctacacttttaacggacttcctggacccttttacaattgctccaataacgacacggacactttcaggttaaaggtgaaaccagggaagacatatcttcttcgtttgatcaatgctgcactcaatgatgaactctttttcagcattgcaaaccacaccttggtaactgttgaagctgatgctacttacgttaaacctttcgagtcagacatcatagtcctggggccaggacaaacctcaaacgttctgttaaagacaaaagctgagtacccaaatgccaatttcttgatgctagcaagaccatatttcactggcatgggaactttcgacaattccacagttgctggctttctagagtataagaataaaccacttgctgctcccaaaaatattaatattcccactttgaaaccatttcttccagccatcaatgacacttccttcgttgccaactttagtaacaaattcttcagtttgaaccctgcaaaggtgcctcaaatagttgacaagagcttcttcttcacaattggacttggaacaagtccttgtcccaaaaaccaaacatgccaaggaccgaacaacagttcaaagtttgcagcctcaatgaacaacatatctttcactcttccttccatagcacttcttgagcaacatttctttgggcaagctaataatggcatttacaccactgatttccctgccatgccactcatgccattcaactacacggggactccaccgaacaacactttggtcggtaatggaacaaagactgtggtgataccctttaacacaagcgtgcaagtggtgcttcaggacactagcattttgggagctgagagccaccccttgcaccttcatggctttaatttctatgttgtgggtcaaggctttgggaactttaatcctaacactgaccctcaaatattcaatctttttgaccccgttgaaaggaacactgttggtgtgccctctggtggttgggttgcaatccgattccttgctgacaatccaggtgtttggctgatgcattgccactttgatgtccaccttagttgggggttgaggatggcttggattgttgaggatgggaagctacctaatcagaagttgcctcctccaccagctgatctccccaagtgttgatgattttctggcctactggcatctgcaaattttttccttcatttccacaccatttgattttccaattccaagttaatttccggaattttggtttgcctactatgaaagagtacatgaagagtaatcaccaacattggcgtttcagtttttctttctttgtatcaatctgacacgttctggatgacttttcaatacctccacctaattttctagtgccaataaagtaggggtggctggagttataccatccagaatatcaatgtgtacttccctagctttcaaagtttaataaaaacttaccttggttg

SEQ ID NO: 10385 - DNA, 2125 bp, Medicago truncatula
gtgactaatgcaataagatatatccttcaactatcttctactcattcaaggtggcaatgcatatcaaaatgattgtcactgttccattatcaaaggctctttttgcagcctttctctttgtcaccaccttcctcttaacctcccctggatttgttttggctacttcacagcatggaagtgttacaagacactacaaattcgatataaggttggcaaacgttacgaggctgtgccacacaaaaagcatggtcaccgtgaatgggaagttcccgggtcctcgaattgttgttagagaaggggacagattgttggttaaggttgttaatcatgttccaaacaatatcagcttgcattggcatggtgtgagacaacttcgtagtggttggtcggatggtccatcatacataactcaatgcccaattcaaacaggtcagagttatgtgtacaacttcaccattgttggacaaagaggaactcttttctggcatgctcatttctcatggttaagagctactgtctatggacctctcatccttctcccaaggcacaatgaatcttatccttttcaaaaaccctacaaggaagtccccattctctttggtgagtggtggaatgcagatcctgaagctgtaattgcacaagctcttcagacagggggtggcccaaatgtttctgatgcctacaccattaatgggtttcctggacctctttacaattgctccaaagatacatacaaattgaaggtgaagccaggaaaaacatatttactacgtttaatcaacgctgcactcaatgacgaactctttttcagcattgctaatcacacattaatcattgttgaagcagatgcatcttacattaaaccattcgagtccaataccatcatacttggaccaggtcaaaccacaaatgttctattaaaaacaaaaccaaattaccctaattccacattctacatgctagctagaccatatttcacagggcagggtactttcgacaattccacagtagctggaattttagaatacactaaaccaaatgatcaaacaaatttaaatctccctattctaaaacctgtgcttccagtcatcaatgatactaattttgttgctaattttagtaacaaatttcttagcttaaatagtccaaaataccccgcaaatgtgccaaaaactattgacaaaaactttttctttatcgttggactaggaactagtccatgcccaaaaaaccaaacatgtcaaggaccaaataatagttcaaaatttgcagcttcaatgaacaatgtatcatttgctttaccttctatagcacttcttcaacaacatttctttggagctaataatggttttacaacggattttccggttgtaccgttaaggccgtttaattatacaggaacacctccaaacaatactttggttagtaatggaacaaagacagtggtgataccatataacactagagttcaggttatattgcaggatacaagcattttgggagctgagagtcatcctttgcatcttcatggatttaatttctttgttgttggtcaaggttttggaaattttaatgctagtagtgaccctgcaaagtttaatcttgttgatcctgttgagaggaatactgttgctgtgccttctggtggttgggttgcgatacgattccttgctgacaatccaggtgtttggctgatgcattgccactttgatgtgcaccttagttggggattgaggatggcttggattgttgaagatggaaagttaccagatcaaaaattgcctcctcctcctaaggatctccccaaatgttgatcactataccatttgactctgctaattttccttactaaagaaacccttttctacatcttttgattttccatttccatttccatgtaaatttaaagatttatggtttgccacattttgcatatatagtgctgagagtgaagtgcgtccggcactagtctttctttcattgtatcaatttttgttttcaccaaattttcaagtgaccaaaaaataaaggtgggtggttttctatatatcattataaatatcattgtacttaagggttaatcataacttgattgaaataatatgtatttttctcatcatctttg

SEQ ID NO: 10386 - DNA, 2505 bp, Vitis vinifera
attgcactagccaaagacactggcttaaccaggcactacaagtttgaggtatgtctgatggccttattggcagaatatatagattaattctctagctaatatttcaatttcaatcactttgtctctgcttcttgtttaaatgcttttgtagatcaagttgcaaaacgtgacacgactgtgccacacaaagagcattgtaacagtgaatgggcmgtttcctgggcctcgaattgtagctagggagggtgaccgtcttcttattaaagtagttaaccatgtccaagataatatctccatccattggtatggactttagatcacttaattagtatacaatgaagaaataggttgctgattaattcaatcactttaatgtatgttacaagtatgttctgtttcaatctgtgacaggcatggcattaagcagcttcaaagtgggtgggctgatgggccagcgtatgtgacgcagtgccccattcaaactggtcagagctatgtctacaacttcaccattgttggccagagagggactctattctggcatgctcacatctcatggctaaggtcgactctctatggtcccataatcattcttccaaggcgtaatgcatcctatccatttgagaagcctcacaagggagtccccatcatctttggtacagtgtgctaattcaatctgttgtttctctttgatagtctaaaatttggtagcttacacataaactacaatacatgaaatgcaggagaatggtggaatgcagatcctgaagctgttattagccaggccctgcaaaccggtggggggcctaatgtgtctgatgcctataccatcaatggacttcccggacccttatataattgctctgccaaaggtatcaaaagttggtgaatatcaacttctttgagaaaaagtactaatgtggtaatgggctttggctgcagatacattcaagctcaaggtaaaaccaaacaagacttacctcctccgtttcatcaatgcggcactcaatgatgagctcttcttcagtatagcaaaccacactctcacagtcgtagatgtcgatgccatttatgttaaaccttttgagactaagacccttctcattacccccggacagaccacaaatgttcttctcaagaccaaacccaatttcccaaatgccaccttcctcatgactgctaggccatatgtgaccggtcttggcacctttgacaactccactgtagctggtatccttgaatatgaattaccatctggttcccctcactctactttattcatcaaaaagcttccactcttcaaaccaactcttccccctctcaatgacacttcatttgctgccaacttcacaagtaaactccgaagcttagcaagccctcaattccctgccaacgtcccccagaaagttgacaggcacttcttcttcacagttggacttggatcaagcccatgtgaccaaaatcaaacctgccaagggcctaatggaaccaaattctcagcttcatttaacaacatatcctttgcacttccyaccacagccctcctccaagcccacttctttgggcaatcaaatggtgtttacaaacctgacttccctatcactccgatcattccctttaactatactggaaccccaccaaacaacactctggtgagcaatggaaccaaagtggtggttctaccattcaacaccagtgtggagcttgtcgtgcaggacactagcattcttggtgctgaaagccaccctctrcacctgcatggcttcaacttctttgttgttggccaaggrtttggaaactatgatcccaataaagaccctgcaaaattcaatcttgtcgaccccattgagaggaacaccgtgggagtgccctctgggggttgggttgccattcggtttctagcagacaacccaggtgagtatgaaagaacagcaaaaaatacagtgaaccaacttcaatttaggcatattactattgctactttgctcataaacacgcatacatgaaaaataatagtcaagcaaaattcaccaaaaacttctaacaaccgagatgaattcaaaactttcttggtctttcaatattagactaaatctactttcttttctcttttacagactgaaagcgacatgtcagatatatatatatatattttttttttttttcaaaattgaaaacctttaacttgtacctagagaaccattggcgaatctattatcccttatacaaatcttattttctcacaatatgaaatcaatacctaaaaatggtggagcaggactaaagttattttctctaggctttggttatactaatgatttgcagagttgtatgaagttaattaacactaacaatggagaccatgtgtggcaaataggggtatggttcatgcattgccacctggaaatccacaccagctggggcttgaagatggcctgggttgtcttagatggaaagctccccaatcagaagttgcctcctccaccagcagatcttcccaaatgt

SEQ ID NO: 10387 - DNA, 1758 bp, Vitis vinifera
atgggtgtttcttttcttccttcaccaccatttgtgggagtttttgtgttctcatgcatggcattatgcctccttcctgagcttgcccttgcccaggattctggcataaccaggcactacaagtttgatatcaaattgcaaaatgtgacgagactgtgccatacaaagagcattttgacagtaaatgggcagtttcctgggccacgcattgtagcaagggagggtgaccgtcttctcattaaagtggttaaccatgtccagaataatatctccatccattggcatgggattcgacagcttcggagtgggtgggctgatgggccagcatatgtgacgcaatgccccattcaaactggccagagctatgtctacaacttcaccgttgttggccagagagggactcttttctggcatgctcacatctcatggctaaggtcgactctctatggtcccttaattattctcccaaaacgtaatgtcccctatccatttgagaagcctcacaaggaagtccccatcatctttggagagtggtggaatgcagacactgaggcagtcattagccaggccctccaaactggtggaggcccaaatgtgtctgatgcctataccatcaatggacttccaggcccattgtataattgctctgccaaagatacattcaagctgagagtgaaggcaagcaagacttacctgctccgtttgatcaacgcagcgctcaatgacgagcttttcttcagtattgcaaaccatacactgacagtagtggatgctgatgctatttatgttaaaccttttgagactgacacacttctcattgcccctggacagaccacaaatgttcttctcaagaccaaaccccacttcccaaatgccgctttcctcataactgctaggccatacgtgactggccttggcacctttgacaactccaccgttgctggtatccttgaatatgaattaccctctgcttcccctcactctactgtctccattaaaaagcttccactcttcaaaccaacacttcctcctctcaatgacacttcctttgcgaccaacttcactaataggcttcgtagcttggccagccctcagttccctgctaacgtcccccagaaagttgacaggcacttcttcttcacaattggactgggaacaagcccttgcgaccaaaaccaaacatgccaaggacccaatgggacaaagtttgcagcttcggttaataatgtgtcctttgcatcttcaaccacagcccttctacaagcccacttctctgggcaatcaaatggggtttacaaccctgacttccctatcactccgatcattccctttaactataccggaaccccaccaaacaacactctggtgagcaatggaaccaaagtggtggttctaccatttaacactagtgtggagcttgtcatgcaggacactagcattcttggagctgaaagccaccctctccatctgcatggcttcaatttctttgtcgtcggccaaggtttcggaaactatgatcctaacaaggaccctgcaaacttcaatctggtcgaccccattgaaaggaacaccgtgggagtgccctccggtggttgggttgccattcggtttctagcagacaacccaggggtatggttcatgcattgtcacctggaaatccacaccagctggggcttgaagatggcgtgggttgtcttagatggaaagctccccaatcagaagctgcttcctccaccagcagatcttcccaagtgttga

SEQ ID NO: 10388 - DNA, 1755 bp, Vitis vinifera
atgggtgcctctcttctttcatcaacagcaattttcagagtcatgttcatagttttgaacactctgtggctctctcctgagcttgccagtagtgctggcgttactagacattacaagttccatatcaagctgcagaatgtgacaagattgtgccacacgaagagcattgtgagtgtgaatgggcagtttccaggacctcccatcattgctagagaaggagatcaagtggtggttaaggtgattaaccatgtgcagaacaatgtcaccatccattggcatggagttcgacagcttcgaagcgggtgggctgatgggcctgcatatgtgactcagtgccctattcaaacaggccagacctatgtatacaatttcaccatcactggccaaaggggaaccctgttttggcatgctcacatttcatggctaagagccactctctatggacccatcatcatcctaccaaagaaaaatgtgccttacccatttgtcaaaccctacaaggaagttcccatcatatttggagaatggtggaatgctgatcctgaggcagtcatcacccaggccctgcagaatggaggaggccccaatgtctccgatgcctacaccatcaacggcctccctggccccttgtacaactgctcagctcaagatactttcaagctaaaggtgaaacctggaaggacatacctcctgagattgatcaatgctgcactcaatgatgagctcttcttcagcattgccaatcacacccttacagtggttgatgtggatgctatttatgtcaaaccctttaaaactgatacaattctgatcacaccaggccaaaccaccaacctcctcctcaaagccaaaccccacttccctaatgccaccttccttatggctgctcgcccttatgccactggccgtggaacttttgacaattccactgtcaccggtctcctccactatgaaacaccacccaaatcctctccctctgcctcctcatttaaaaatcttcccctcttcaaaccaacactccctcctctaaacgacacttcctttgcagccaacttcactcacaaactccgcagtttagcaaatagtcagttccctgctaatgtacctcaaaaggttgataaacgatttttcttcacggttgggctggggacaaacccttgcccccagaaccagacttgtcaaggacccaataatagcaccaagttttcagcttcggttaacaacgtctcctttgttctacccaccacagccatcctccaagcacacttttttcagcaatccaatggcgtctacaccactgattttccagccactccaatctttcctttcaattatacggggacaccacccaacaacaccatggtgaacaatggaactaaggtggtggtgcttccatttaacaccagtgtggagttagtgctgcaagatactagtattcttgggattgaaagccaccccttgcaccttcatgggttcaacttctttgtggttggtcaaggctttgggaacttcgattcaaagaaggatcctcccaaattcaatctcgtagacccagttgagaggaacacggtgggcgtgccttctggaggatgggtggctattcgcttccttgctgacaacccaggtgtatggttcatgcactgccacttcgaagttcacatgagctggggcttgaaaatggtttggatggtaatggatgggaaactgcctaaccagaagctgcctcctccaccctctgatcttccccaatgttga

SEQ ID NO: 10389 - DNA, 1859 bp, Glycine max; identical to SEQ ID NO: 10382

SEQ ID NO: 10390 - DNA, 1992 bp, Glycine max; identical to SEQ ID NO: 10380

SEQ ID NO: 10391 - DNA, 1960 bp, Glycine max
atggattctcattgggttcgaatggtgcttctcattgcttgcattcttccagctttggttgaatgcagagtgaggcactacaaatttcatgtggtgtctaaacaaaccaatagattgtgttcaagcaaatctattgtcaccattaatgggaagttcccaggacccacactttacgctagggaagatgatacagtgctggtcaaagtcattaaccaagtcaaccacaacgttaccatccattggcatggtgtgaggcaattgagaactggttgggctgatggacctgcatatgtcacacagtgcccaattcaaccagggcaaacctatctgtacaatttcaccctcaccgggcaaagaggaacacttctttatcatgcacatgttaactggctaaggtcaactctccatggtgccttagttatcttgccaaagagaggtgtgccttatcccttcccaaagccagatgatgaattggttgtggtattaggagaatggtggaaatccgatactgaagctattatcaatgaagctctcaaatcaggattggcaccaaatgtctcagatgctcatactattaatggccttccaggggcagttaccaattgttctacacaagatgtttacaacctacccgtggagagtggaaagacctacctgttgagaattatcaatgctgcactcaatgaagagctcttcttcaaaattgctggccacaagctcacagtggtagaagttgatgccacatatgtaaagcccttcaagattgaaacaattttgatagcccctggtcaaaccaccaatgttcttttaaatgctgaccaaaaatttggcaagtacttggtagcagcttctcctttcatggatgctcctattgctgtggacaacttgactgccacagcaacattgcactacacaggaactcttgctgccactcccacaattctcaccaccccacctcccaaaaattctacacaaattgccaacaacttcatctcctctcttagaggccttaactccaagaaataccctgtcaatgtcccattaactgttgatcactcacttttcttcactgttgggttggggattagcccttgtccatcttgcaaagctgcaaatggaagcagggttgtggctgctatcaacaatgtgacatttattatgccaaccattgccttacttcaagcacattatttcaacataaaaggggtgttcaccactgatttccctgccaatccaccccatttgttcaactactcaggtcctggaccagccaatttgaacaccgaaactggcacaaaggtttatcgggtaccattcaatgccacagttcaggttgtgctgcaagatactggaatcattgcacctgagaaccacccagttcatcttcatgggttcaatttctttgttgttggaagaggagtaggaaatttcaaccccaaaattgaccctaagaactttaaccttgttgatcctgttgaaaggaacactattggagtaccagctggagggtggactgcatttagatttagagcagataatccaggagtttggttcatgcactgccacttggaggtacacacaacatgggggctaaagatggcctttttggtggacaatggcaaaggtccaaagcaatcagtgataccaccacctaaagatcttcccaaatgctaatgcgtcaatcatcaattaattatgcaatacacaaaagaaaggccttccaatgccgaaacaaaagaagctttggagggatacagagaagccaggcaaaagaagagtgagtgaaaagaaaaaggttatttaataagcgagtatccccgaatatttttctttgagcaaataggtgatttgttcaaccacgtttaataagatggagcgagcattttggttttcctcttgcaaattcatttttctaagacgcattgtgtatgtatcggaatcaacaagtgtacactcttgt

SEQ ID NO: 10392 - DNA, 2076 bp, Glycine max
ggacacaagaagtacgacaaattaagacagggcctaagagaaggtgttgtagagaggatacagcgagagcaaaatgtattctcattgggttcgattgatgcttctcattgcttgcattcttccagctttggttgaatgcagagagaggcactacaaatttcatgtggtgtctaaacaaactaatagattgtgttcaagcaaatctattgtcaccattaatggcaagttcccgggacccactctttacgccagggaagacgatacagtgttggtcaaagtcatcaaccaagtcaatcacaacgttaccatccattggcatggtgtgaggcaattgagaactggttgggctgatggacctgcatatgtcacacagtgcccaattcaaccagggcaaacctatgtatacaatttcacactcacagggcaaagaggaacacttttgtatcatgcacatgttaattggctaaggtcaactctctatggtgccttggttatcttgccaaagagaggtgtgccttatcctttcccaaaaccagatgatgagttggttgtggtattaggagaatggtggaaatctgatacagaagctgtaatcaatgaagcactcaaatcaggattggcaccaaatgtctcagatgctcatactattaatggccttccagggacagttaccaattgttctacacaggatgtttacaacctgcccgtggagagtggaaagacctaccttttgagaattgtcaatgctgcactcaatgaggagctattcttcaaaattgctggccacaagctcactgtggtagaagttgatgccacatatgtaaagccattcaagattgaaacaattgtgatagcccctggccaaaccaccaatgtgcttctaaatgcaaaccaaaaatctggcaagtacttggtagcagcttctccattcatggatgctcctgttgctgtggataacttgactgccacagcaacattgcactacaccggcactcttgctgccacccccacaattctcaccaccccacctcccaaaaatgctacccaaattgccaacaacttcatcagctctcttagaggccttaactccaagaaataccctgtcaatgtcccattaacagttgatcactcacttatcttcactgttgggttgggaattaacccttgtccatcttgcaaagctgcaaatgggagcagggtggtggctgctatcaacaatgttacatttattatgccaaccattgccttacttcaagcacattatttcaacatcaaaggggtgttcaccactgatttccctgccaatccaccccatgttttcaactactcagggcctggaccagccaatttgaacaccgaaaccggcacaaaggtttacaggctaccattcaacgccacagttcaggtggtgctacaagacacaggaatcattgcacctgagaaccacccagttcatcttcatgggttcaatttctttgttgttggaagaggagtaggcaatttcaaccccaaaattgaccctaagaactttaaccttgttgatcctgttgaaaggaacactattggagtaccagctggagggtggactgcatttagattcagagcagataatccaggagtttggttcatgcactgccacttggaggtacacacaacatggggactaaagatggcctttttggtggacaatggcaaaggtcctaagcaatcagtgatacccccaccaaaagatcttcccaaatgctaatgtgtcaatcatcaattaattatgcaatacacaaaagaaaggccttccaatgccaaaacaaaagaagctttggagggatacagagaagccaggcaaaagaaaagtgagtgaagaagaaagggttatttaataagcgagtatcccaaatgttttttctttgagcaaataggagaatttgttcaaccacatttaataaaatggagcgagcattttagttttcctctttgcaaattcaattttttaagacacgttgtgtatgtattggaatcaacaagtgtatgctcttatttgtttcaggaaatacaataagggttatttacttcgttaaa

SEQ ID NO: 10393 - DNA, 2075 bp, Medicago truncatula
gaatgcaacttaaggacctgaagttgcaaaagaaaattcaagaaattaaaaagctaagatagtgaaaatggtttcttggattcgagtactacttcttatttgttgcatatttccagcgttggtcgagtgcaaagttaggcactacaaatttcatgtggtggccaaaaatacaagtagattatgttcaagcaaagcaattgtcacagttaatgggaagtttccgggacccactctttatgccagggaagatgatacagtgatagtcaaagttcgtaatcaagtcaacaacaatattaccatccattggcatggtattaggcaattgagaacaggttgggctgatggacctgcatatatcacacaatgtccaattcaacctggacatagttatacatacaatttcaccattactggtcaaagaggaacacttctttggcatgcacatgttaattggctaagatcaactgtccatggtgccattgttattttaccaaagaaaggtgttccttatcctttcccaaagccagatgatgaattggttttggtattaggagagtggtggaaatctgatactgaagctgttatcaatgaagctctaaaatcaggattggcaccaaatgtttcagatgctcataccataaatggtcttcctgggacagtggccaattgttctacacaagatgtttacaaactacctgtggagagtggcaaaacctatctactaagaatcatcaatgctgcactcaatgaagaacttttcttcaaaatagctggccacaaactcacagtagtagaagttgatgcaacatacacaaaaccattccaaattgaaacaattgtgatagcacctggtcaaacaacaaatgtactattaaaagcaaaccaaaaatctggcaaatatttagtagcagcttcacctttcatggatgcacctgttgctgtagacaatttaacagccacagctacattacattattcaggaactactcttacaaacacccctacatttctaactacacctccacctacaaatgctacacaaattgctaataactttttaaactcacttaaaggacttaattccaagaaatacccagttaatgttcctttaaaaattgatcattcacttttttttactgttggattaggggttaatccttgtccttcatgtaaagctggaaatggtagtagagttgtagctgctattaataatgttacatttgttatgccaactacagctttactacaagcacattatttcaacattaagaatgtttttactgcagattttccaccaaatccacctcatatttataatttcactggtgctggacctaaaaacttgaacactacaagtggtacaaagttatataagttatcatttaatgatactgttcagcttgttatgcaagatactggaatcattgcacctgagagtcatcctgttcatcttcatggtttcaatttctttgttgttggtagaggagttggaaattatgatagtaaaaatgattcaaagaagtttaaccttgttgatcctgttgaaaggaacactgttggtgtaccagctggtggttgggttgccattagattcagagctgataatccaggagtttggttcatgcattgccatttggaggtgcatacaacatggggtctaaagatggcctttttggtggacaatggcaaaggtcctaaacaatcagtgatagctccacctaaagatcttccaaaatgttgatattcctcacatcaaatcaaatgttcatacaattcacaaagggtagtaggccttccaaattcacaaaagtaggtgtggagggatacagaggagccaggcaaaaataaaagagagtgaaggggaaaaaaggttatttaataagtgaatactaccataaattgttttttgattgagcaaaagggagaatttgttccagcatatttaataaatggagtatgtacattttgattttcatcacacaattttaagagattgtgcatatgtattattggaaccaacaagtgtacacttttgactttggtgtttggtttaatacaaaagggttatctacttc

SEQ ID NO: 10394 - DNA, 1958 bp, Vitis vinifera
atgaagtactcttgggttcgcgttctggttcttgtggcttgcctgttaccagcattagtcgagtgcagggttcggcaatacacatttaatgtggtgttgaagaatacaaatagactatgcgctagcaagcccattgtcaccgtgaatggacggttcccggggcccactctctatgtcagggaagacgacacagtgcttgtcagggttgtcaaccacgtcaaatacaatgtttccatccattggcatggtataaggcaactgagaacggggtggtcggacgggccagcatacatcacccagtgcccaatccagacagggcaaagctatttatacaacttcaccgttactggccaacggggcacacttctttggcatgcgcatgtcctttggctaagggcaactgtccatggtgccatcgttatcttgcctaagcgaggggtgccctatccttttccaaaaccccataaggaggttgttgtcatattaggtgagtggtggaaatcagatgtcgaggctgtgatcaatcaagctcttagctccggtttggctcccaatgtttcggatgctcacaccattaacggccatccaggccctgtctccaattgtccttcacagggcggcttttcattgcaagtcgaggccggaaaaacctacctactccgaatcattaacgctgcactcaatgaagaactcttcttcaagattgctggacatcaactctctgtcgtagaagtggacgccgtctacacaaagccattcaagatcgacactcttgttattgcccctggccaaaccacaaatgctcttatcacagcagatcaaagctctggcaagtacttgatggccgcctcccctttcatggactcccccatcgcagtagataaccttactgcaacagcaactctgcactactccggcacacttgcgagttcccccaccagtcttactagcccacctccaccaaatgcaactgcagttgctaacaagttcgtaaactctctccgaagccttaattccaaaaagtacccagccaaagttccattaaccgtggatcactcccttttcatcacggtggggctaggaattaacccttgtgctacctgcgtcgccggtaatggaagccgggcagtggctagtatgaataatgtcacgtttgtgatgccaactacagccattcttcaagcacactacttcaacataagcggtgtgtacaccaccgacttcccagctaacccacccgtggcttttaattacactggctcgcccgcaaacttgcagaccacgaatgggacaaaggtttatagggtaccttacaactctacggttcaagtagttttacaagatactgggatcatcgccactgagaaccatccagtccatctacatgggttcaacttcttcgctgtgggcaaaggactgggaaattacaacccaaagacggatcctcaaaactttaatctcattgatcctgttgagcggaacactattggagtaccatccggtgggtggacagctatcagatttctagcagataatccaggagtttggttcatgcattgccacttggaagtgcatacaacctggggactgaagatggcattcttggtggacaacggcaaaggccccaaccagtccattataccccctccaagtgatcttcccaaatgttaatttacatcccaaacaacagctaattatacatacaagtagagtggaattttccccgtgaagagtggatgagacaggaaaaagttccacgcagatgaagaaaaggagagttttattgtttcttgagtaaaacacgagaatttgctcaagcatgcttcaataagcgctagcattttagttatgggaaattgggaataatactcaaatttttcagggtcacgtgtgttggaatctgaataatatatgtataagttttgattgtatgtgtttatgtaagttcccaaggttct

SEQ ID NO: 10395 - DNA, 1917 bp, Glycine max
atggactcttgggttagaatgctgtttctcattgcttgcattgttccagctttagtcgagtgcaaagtgaggcactacaaattcaatgtggtactgaagaatactactaggttatgttcaagcaaaccaattgtcaccgttaatgggaaatttccaggacccactctttacgctagggaagatgatacagtgctagtcaaagtcaataaccttgtcaaccacaatgtcaccatccactggcatggtgtgagacaacttagaactggttgggctgatgggcctgcatacatcacacagtgcccaattctgtcaggacaatcatatttgtacaacttcacccttacaggacaaagaggaacacttctttggcatgctcatgttaactggctaaggtcaactctccatggtgccatagttatcttgccaaagaggggtgtgccataccctttcccaaaaccagataaagagttggttgtaatattaggagaatggtggaaatctgatacagaagatgttatcaatgaagctctcaagtcaggattagcaccaaatgtctcagatgctcataccattaatggccttccagggattgtgtctgtggccaattgttctacacaagatgtgtacaagcttcctgtggaaagtggcaagacctacctattgagaatcatcaatgctgcactcaatgaggagctcttcttcaaaattgctggccatccattcactgtggttgaagttgatgcctcatatgtaaagcccttcaagacagacactctttcgatagcccctggtcaaaccaccaatgcccttttaactgctgaccaaaactctggcaaatacacaattgtagcctctactttcatggattctccagttgtagctgtggataacttgactgcaacagccacattgcactacactggcactcttgccaccactcctacacttctcaccacccctcctccaagaaatgccacccaagttgctaacaacttcaccaattctctcaaaagccttaattctaagaaatacccagcaaaagtcccacaaaaagttgatcattcacttctcctcactgttggtttggggattaacccttgtccatcttgcacagctggcaatgggagtagagtagtggctgctgtcaacaatgtgacatttgtgatgccaaccactgcactgcttcaggctcattacttcaacatcaagggggtgttcaccactgatttccctggcaacccttctcatgtttacaactacacggcgactccgccggcggcagcttggcagaccacaaatggcaccaaggcttacaggctggcattcaactccacagttcaggttgttttgcaggatactggggtcattgctcctgagagccacccggttcatcttcatgggttcaacttctttgttgttggctctggtgtaggaaattatgatcccaaaacggatcaaaataactttaatcttgcggatcctgttgagaggaacacaattggagtgcctactggagggtgggttgctttcagattcagagcagataacccagtgtggttcttgcactgccatttcgaggtgcatacaacatgggggttgaagatggcattcttggtggacaatggtaaaggtcctaatgaatcactgctacccccaccaaaagatcttccaaaatgttagacttttcagtcatcgattgaacaacacacagacaagggaacaacacacagacaagggaaggatacagagaagctaggaaaaacaagagaataaaggggatggtggttatttaataagcaggatgtcccacttgcctttttgagctaatgggagcatttcttcacagtaggttggagtcagcattttggttttctttgaacatacacttttttcttgttaaagcgattcagatcatat

SEQ ID NO: 10396 - DNA, 1984 bp, Nicotiana tabacum
cagaaaatcatttcaattcgttctctatagcacaattgtaaatagaagtccaattgcagaaatttcaagaaagagacaaaaatgaactcttggattcgtcttttcatagtattggcagcttgtctttttcctcttgtcgttgaatgcaggattcgacattacaagttcaatgtggtaatgaagaacacgactcgcctttgttcatccaagcccattgttactgttaatggaaaatttccaggacctacaatctatgctcgggaaggtgacacagtacttgtcaaagttgttaaccatgtcaagtataatctctctatccattggcatggtattagacaacttagaacaggttgggcagatggaccagcatacatcacacaatgtccaattcagccagggcaaaactatgtgtataacttcactattacaggccaaaggggtacactattttggcatgctcatattttgtggctaagggccactgttcatggtgcaattgttatcttgcctaaccttggagtgccttatccattccctaaacccaaccacgaagctgtcgtgatcctagctgaatggtggaaatctgataccgaagctgtgattaatgaagccataaaatcaggattagcccctaatgtttctgatgctcacactattaatggtcatccgggacccgtctcaaattgcgcatcacaaggtggatacaaattgaacgttgatccaggaaaaacctacatgttacgagtcatcaacgctgcgctcaatgaagaactctttttcaaaattgctggccataaaatgacagtagttgaagttgatgccacttacattaaacctttcaaaacagacacaattgtaattgctcctggccaaacaacaaatgtaattgtcactgccaatcaaggttctggaaaatacatggttgctgcttcaccttttatggatgcaccaattgctgttgataatgttacagcaatagccactttacattattctggcacacaaggaaatagccacatttcacttactagtacaccacctaaaaatgccacccctgtagccaacacttttcttgattctttaagaagcctgaattccaaaaaataccctgctaaagttcccaaaaaaattgatcattccctatttttcacggtaggtttagggattaatccatgcccaacttgcaaacaaggtaatggaagcagagttgtggctagtgtaaacaatgttacattcgttatgccaacggttgcccttttacaagcacatttctttgggactaaaggagttttcacgacagattttccagcaaacccgccttttgctttcaactatacgggaacaggaccaactaatttggcgacgatgaatgggactaaggtttataggctgcggtataacgatacagttcaattggttttgcaggatactggaattatagcccctgagaaccatccaatccatttgcatggcttcaatttttttctagtgggtaaaggcataggaaattttaatccaaaaacagatcctaagaattttaatcttgtggatcctgttgagaggaatacagttggtgttcctgctggaggatgggttgctataagatttcgtgctgacaatccaggagtttggtttatgcattgtcatctagagatacacacaacatggggattgaaaatggcatggcttgtagataatggcaaaggcccaaatgagtcccttttgccacctcctaaggatcttccaaaatgctaaaattggagaggccttttttaaaggagttaaatttcacatacgaagcataatgtagggaaagcaggctgaagactgcaccaagagagacaaagaagaaaggcgagtcaaaaagcaatgtattcatttttgagtgaaagagaaaaaacattttttttcctcagccaaattttaataattatacgagtattcaatgtatacattttttgagattgttaatggaagtttgaag

SEQ ID NO: 10397 - DNA, 1931 bp, Vitis vinifera
atgggtgcttctcttattccatcaacaacaattttcaaagtcctattcctagttttgaactctttgtggtaccttcccgagcttgccaatggttctggcatcactaggcattacaagttcaatatcgagttgcagaatgtgacaaggctatgccacacgaagagcatcgtaagtgtgaatgggcagtttccagggcctcccatcattgctagggaaggggatcgtgtggttgttaaggtggttaatcatgttcagaacaatgtcaccattcattggcatggagttcggcagcttagaagtgggtgggcagacgggcctgcgtatgtgactcaatgcccaattcaaacaggccagacctatgtatacaatttcaccatcactggccaaaggggaaccctgttctggcatgctcatatttcatggctaagatccactctttatggccctatcatcatctttccaaagaaaaatgtgccttacccatttgccaaaccttacaaggaagttccgatcatattcggagaatggtggaatacggatccggaggcagtcattacccaggctctacagaatggaggtggccccaatgtctctgatggctataccatcaacggcctccctggccccttgtacaactgctcagctcaagacactttcaagctaaaggtgaagcccggaaagacatacctcctgagattgatcaatgctgcactcaatgatgagctcttcttcagcattgccaaccacacccttacagtggttgatgtggatgccatttacgttaaaccctttaaaaccgatacaattttgatcactcctggccaaaccaccaacctactcctcaaggccaaaccccacttccctaatgccaccttcctcatggctgctcgcccttatgccaccggcagtggaacctttgacaattccactgtcgccggaatcctccactatgaaccaccacccaaatcctctccctctgccccctcatttgaaaatcttccactcttcaaaccaacactccctcctctaaatgacacttcctttgcagccaacttcacccgcaaactccgcagtttagcaaacactcagttccctgctaatgtacctcaaaaggttgataagcgatttttcttcacggttgggctggggacaaacccttgcccgcagaaccagacttgtcaaggacccaataatagcaccatgttttcagcttcggttaacaatgtctcttttgttctacccaccacggccatccttcaagcacacttttttcagcaatccaatggcgtctacaccacagattttccagccactccaatctttcctttcaattatacagggacaccacccaacaacaccatggtgagcaacggaactaaggtggtagtgcttccatttaacacgagtgtggagttggtgctacaggatacaagtattctgggaattgaaagccaccctttgcaccttcatggcttcaatttctttgtggttggtcaaggttttgggaactttgatgctaagaaggacccttccaaattcaatctcgtagatcctgttgaaagaaacacagtaggtgtgccgtccggcggttgggtagctattcgcttcctcgctgacaatccaggtgtatggctcatgcattgccatctggaagtccacacaagctggggtttgaagatgggttggatagtaaaggatggcaaaatgcctaatcagaagctgcctcctccaccctctgaccttcccaagtgttgacctcgtcttccaaaattcttttgttcccaacctggcctcaaatgatgcctccatttttccctcttgtaatttatttattctgtttttattgttttttcccccgactgttcttttctcccaacttatgaaatggagaagtttttggaaataaaatgttggctactgttaatacttca

SEQ ID NO: 10398 - DNA, 1755 bp, Vitis vinifera
atgggtgcttctcttctttcatcaacagcaattttcagagtcctgttcgtagttttgaacactctgtggctctttcccgagcttgccagtagtgctggcatcactaggcattacaagttcaatatcaagctgcagaatgtgacaagattgtgccacacgaagagcattgtgagtgtgaatgggcagtttccaggacctcacatcattgctagggaaggagatcgagtggtggttaaggtggttaaccatgtccagaacaatgtcaccatccattggcatggagttcggcagcttaggagtgggtgggcagacgggcctgcgtatgtgactcaatgcccaattcaaacaggccagacctatgtatacaatttcaccatcactggccaaagaggaaccctgttttggcatgctcacatttcatggctaagatccactctctatggacccatcatcatccttccaaagaaaaatgtcccttacccgtttgtcaaaccctacaaggaagttcccattatatttggagaatggtggaatgcggatccggaagcagtcattacccaggccctgcagaatggaggtggcccaaatgtctctgatgcctataccatcaacggcctccctggccccttgtacaactgctcagctcaagatactttcaagctaaaggtgaagcccggaaagacatacctcctgagattgatcaatgctgcactcaatgatgagctcttcttcagcattgccaaccacacccttacagtggttgatgtggatgccatttacgttaaaccctttaaaaccgatacaattttgatcactcctggccaaaccaccaacctcctcctcaaggccaaaccccacttccctaatgccaccttcctcatggctgctcgcccttatgccacaggccgtggaacctttgacaattccactgtcgccggaatcctccactatgaaccaccacccaaatcctctccctctgcctcctcatttaaaaaccttccactcttcaaaccaacactccctcctctaaatgacacttccttcgcggccaacttcactggcaaactccgaagtttagcaaacactcagttccccgctaatgtaccccaaaaagttgatcaacgctttttcttcacggttgggctgggtacaaacccttgcccgcagaaccagacctgtcaaggacctactaatatcaccatgttttcagcttcggttaacaatgtctccttcgttcttcccaccacagccatcctccaagcccactttttccaacaatccaaaggcgtctacaccacagatttccccaccacgccaatctttcctttcaattatacagggacaccacccaacaacaccatggtgagcaatggaactaaggtagtggtacttccgtttaacacaagcgtggagttggtgttacaagatactagtattcttggaattgaaagtcaccccttgcaccttcatgggttcaacttttttgtggttggtcaaggttttgggaacttcgattcaaagaaggatcctcccaaattcaatctggtagaccctgtcgagaggaacaccgtgggtgtgccttccggcggatgggtagctatccgctttcttgctgacaatccaggtgtgtggttcatgcactgccacttggaagtccacacaagctggggtttgaagatggcgtggatagtaatggatggaaaactgccaaatcagaaattgcctcccccaccttctgatcttcccaagtgttga

SEQ ID NO: 10399 - DNA, 1752 bp, Vitis vinifera
atgggttcttctcttctttcatcagcagcaatgttcagagttctgttcctagttttgaactctctgtggttgtttcccgagcttgccagtgctggcatcactaggcattacaagttcaatatcaagttgcagaatgtgacaaggttgtgccacacgaagaacattgtgagtgtgaatgggcagtttccaggacctcgcatcattgctagggaaggagatcgagtggtggttaatgtggttaaccatgtcccgaacaatgtcactatccattggcatggagttcgacagcttcggagtgggtgggcagatgggcctgcatatgtaactcagtgccctattcaaacaggccagacctatgtatacaatttcaccatcactggccaaaggggaaccctgttttggcatgctcacatttcatggctaagatccactgtctatggacccatcatcatccttccaaagaaaaatgtgccttacccgtttgtcaaaccctacaaggaagttcccatcatatttggagaatggtggaatgcggatccagaggcagtcattacccaggccctgcagaatggaggtggccccaatgtctctgatgcctataccatcaacggcctccctggccccttgtacaactgctcagctcaagatactttcaagctaaaggtaaaacccgggaagacctacctcctgagattgatcaacgctgcactcaatgatgagctcttcttcagcattgccaaccacacccttacagtggttgatgtggatgccatctacgtcaaaccctttaaaaccgatacaattttgatcactcctggccaaaccaccaacctcctcctcaaggccaaaccccacttccctaatgccaccttcctcatggctgctcgcccttatgccaccggccgtggaacctttgacaattccactgtcgccggtctcctccactatgaaccaccacaaaaatcctctccctctgcctcctcctttaaaaaccttcctgtcttcaaaccaacactccctcctctaaatgacacttctttcgcggccaacttcaccagaaaactccgaagcttggcaaacagtcagttccctgccaatgtaccgaaaaaggttgacaaaagatttttcttcacagttgggctagggacaagcccttgccctcagaaccagacctgtcaaggtcccaacaacagtaccaaattttcagcctcggttaataatgtctcctttgttctacccaccacagccatcctccaagcacacttttttcagcaatccaatggcgtctacaccacagattttccagccactccaatctttcctttcaattacacagggacaccacccaacaacaccatggcgagcaacggaactaaggtggtagtgcttccatttaacacgactgtggagttggtgctacaagatactagtattcttggaattgaaagccaccctttacaccttcatggcttcaatttctttgtggttggtcagggttttgggaactttgactctaagaaggaccctcccaaattcaatcttgtagaccctgttgaaaggaacacagtcggtgtgccgtccggcggttgggtagctattcgcttcgtcgctgacaacccaggtgtatggttcatgcattgccacctggaagtccacacaagctggggtttgaagatggcttggatagtaaaggatggcaaactgcctaatcagaagctgcctccgccaccctctgaccttccccagtgttga

SEQ ID NO: 10400 - DNA, 2405 bp, Vitis vinifera
atgggtgcttctcttctttcatcaacagcaattttcagagtcktgttcatagttttgaacactctgtggctctttcccgagcttgccagtagtgctggcatcactaggcattacaagttcaatgtatgttttttttcatatggctatctgtatataattgagtagatggatmcatwttgcttaaagttttgtttaactttrtgttggaatctttctagatcaagctgcagaatgtgacaagattgtgccacacgaagagcattgtgagtgtgaatgggcagtttccaggacctcacatcattgctagggaaggagatcgagtggtggttaaggtggttaaccatgtccagaacaatgtcaccatccattggtaagaaggcctattasttttctcgtcattgtcatcttctctgcccttactaattgtgcaagctgcaggcatggagttcggcagcttaggagtgggtgggcagacgggcctgcgtatgtgactcaatgcccaattcaaacaggccagacctatgtatacaatttcaccatcactggccaaagaggaaccctgttttggcatgctcacatttcatggctaagatccactctctatggacccatcatcatccttccaaagaaaaatgtcccttacccgtttttcaaaccctacaaggaagttcccattatatttggtactcatccatttatcactgtctactagcaagacttccaatcgttttcattttatgatctaaggaaattcattatccattgtatgatattttataggagaatggtggaatgcggatccggaagcagtcattacccaggccctgcagaatggaggtggcccwaatgtctctgatgcctataccatcaacggcctccctggccccttgtacaactgctcagctcaaggtacttcgctcttaatcaccatcatccatgtatatatctttactaagcagcattctatgcatacgcaagtatttaacattgattttgtattgcacattgcccagatactttcaagctaaaggtgaagcccggaaagacatacctcctgagattgatcaatgctgcactcaatgatgagctcttcttcagcattgccaaccacacccttacagtggttgatgtggatgccatttacgttaaaccctttaaaaccgatacaattttgatcactcctggccaaaccaccaacctcctcctcaaggccaaaccccacttccctaatgccaccttcctkatggctgctkgcccttatgccaccggccgtggaacctttgacaattccactgtcgccggaatcctccactatgaaccaccacccaaatcctctkcctctgcctcctcatttaaaaaccttccactcttcaaaccaacactccctcctctaaatgacacttccttcgcggccaacttcactggcaaactccgaagtttagcaaacactcagttccccgctaatgtaccccaaaaagttgatcaacgctttttcttcacggtttgggctgggtacaaacccttgcccgcagaaccagacctgtcaaggacctactaatatcaccatgttttcagcttccgttaacaatgtctccttcgttcttcccaccacagccatcctccaagcccactttttccaacaatccaaaggcgtctacaccacagatttcccsaccacgccaatctttcctttcaattatacagggacaccacccaacaacaccatggtgagcaatggaactaaggtagtggtacttccgtttaacacaagcgtggagttggtgttacaagatactagtattcttggaattgaaagtcaccccttgcaccttcatgggttcaacttttttgtggttggtcaaggttttggtaacttcgattcaaagaaggattctcccaaattcaatctggtagaccctgtcgagaggaacaccgtgggtgtgccttccggcggatgggtagctatccgctttcttgctgacaatccaggtgaccactacttaccacagcactgttcactacactagaattcaacattcctaatcgtttctatgattgtaatagctaaattaaaggcctttttccatcttaatttagtttaaaattaataagtaaaacactgttcatagctaaatggagctttttcatacttggaaaattagatttgcaaatgatcacacagacgtattgctcgtgaattgaaattctgactcagatgattgataactttggtgagctgtgcgataaaatctaattgttggtgacatgtcaacaggtgtgtggttcatgcactgccacttggaagtccacacaagctggggtttgaagatggcgtggatagtaatggatggaaaactgccaaatcagaagttgcctcccccaccttctgatcttcccaagtgttg

SEQ ID NO: 10401 - DNA, 1752 bp, Vitis vinifera
atgggtgcttcacttcttcaatcaactgcaatgcttagatttttgttcctagttttgaacaccctgttggtcgtcccggagcttgccagcgccggcatcactaggcactacaagttcaatatcaagttgcatagcgtgacaaggttgtgccacacgaagagcatcgtgagtgtgaatgggcagtttccaggacctcgcatcattgctcgggaaggcgaccgagtggtggttacggtggttaacaatgtccagaataatgttaccatccactggcatggcattcggcagcttcagagtggatgggcagatggacctgcatatgtgacccagtgccctattcaaacaggccagtcctacgtttataatttcaccatcactggacaaagaggaaccctgttttggcatgctcacatttcatggctaagatccactgtctatggacccatcatcatccttccaaagaaaaatgttccttacccatttgccaaaccctacaaggaagttcccattatatttggagaatggtggaatgccgatccagaggcagtcattacccaggccctgcagaatggaggtggccccaatgtctctgatgcctataccatcaacggcctccctggccccttgtacaactgctcagctcaagatactttcaagctaaaggtaaaacccgggaagacctacctcctgagattgatcaatgccgcactcaatgatgagctcttcttcagcattgccaaccacacccttacagtggttgatgtggatgccatttacgtcaaaccctttaaaactgatacaattctgatcactccaggccaaaccaccaacctcctcctcaaggccaaaccccacttccctaatgccaccttcctcatggctgctcgcccttatgccaccggccgtggaacctttgacaattccactgttgccggtctcctccactatgaaccaccatccaaatcctctccctctgcctcctcatttaaaaaccttcctgtcttcaaaccaacactccctcctctaaatgacacttcttttgccgccaacttcaccagaaagctccgaagcttagcaaacagtgagttccctgccaatgtaccgaaaaaggttgacaagagatttttcttcacagttggtctagggacaaacccttgcccacagaaccagacctgtcaaggacccagtaataataccaagttttcagcttcggttaacaatgtctcctttgttctacccaccacagccatcctccaagcacacttttttcagcaatccaaaggcgtctacaccacagattttccaaccactccaacctttcctttcaattatacagggacaccacccaacaacaccatggtgagcaatggaactaaggtggtggtgcttccatttaacaccagtgtggagttagtgctgcaagatactagtattcttggaattgaaagccaccccctgcaccttcatggattcaacttctttctggttggtcaaggttttgggaactttgattcaaagaaggaccctcccaaattcaatctcgtagacccagttgagaggaacactgtgggtgtgccttctggaggatgggtagctattcgcttctttgctgacaacccaggtgtatggttcatgcactgccacttggaagttcacacaagctggggcttgaagatggcttggatcgtaacggacggaaaactgcctaaccagaagttgcctcctccaccctctgatcttccccagtgttga

SEQ ID NO: 10402 - DNA, 1859 bp, Glycine max; identical to SEQ ID NO: 10382

SEQ ID NO: 10403 - DNA, 2125 bp, Medicago truncatula; identical to SEQ ID NO: 10385

SEQ ID NO: 10404 - DNA, 2028 bp, Glycine max; identical to SEQ ID NO: 10383

SEQ ID NO: 10405 - DNA, 1746 bp, Medicago truncatula
atgggtttttcccttttttcatcacttaaaatccaagtgttcattttttcattaattaattttggtttctttgaggttgcattggctagtacaacaagacactaccattttgatataaggtatgaaaatgtaacaagattgtgtcacaaaaagagcatggtaaccgtgaatggtcaatttccggggcctcgcatcgtcgctagagaaggtgatcgtcttatcatcaaagtggttaaccatgtgcagaacaacatctccattcattggcatggcattagacaacttcagtcaggatgggctgatggaccagcatatgtgacacaatgccccatccaaacaggtcaaagctatgtttacaattacacaattaaaggccaaagaggaacactcttttggcatgctcatatatcttggttaaggtcaacactttatggtcctctcattattcttcccaagaaaaatgttcaatacccttttgcaaaacctcacaaggaagttccaatcatatttggtgaatggttcaatacagatcctgaggcaatcattgcacaagctctacaaactggtggaggaccaaatgtctctgatgcatatacaatcaatggacttccaggaccattgtataattgttctgctaaagatacattcaagctaaaggtgaagccaagaaagacttaccttcttcgtttaatcaacgccgcactaaacgacgaattattcttcagcatagcaaaccacactctcacagttgttgaagcagatgcagtttatgcaaaaccttttgtcacaaacacaatcctaattgcacctggacaaaccactaatgttcttctcaaaaccaaacctcattacccaaatgctacattcttaatgttagcaagaccatatgctacaggccaaggcacttttgacaactcaacagttgctggaatcatagaatatgaaattccatttaatactcaccattcaaattcttcactcaaaaaacttccacttttgaaacctattctacctcaacttaatgacacttcatttgcaacaaatttcactaacaaacttcatagcttagcaaatgctcagtttccagctaatgttcctcaaaaagttgataagcactttttcttcacagtaggtcttggtacaaatccttgccaaaacaagaaccaaacatgtcaaggacctaatggaacaatgtttgcggcatcggtgaacaatgtttctttcataatgccaaccacagcacttcttcagacacatttctttggacaaaacaatggaatttacaccactgatttcccaagtaaacctatgaatccattcaactataccggcacaccgccgaataacactatggtgagtaatggaacaaaggttgtggttcttccttttaacactagtgtggagcttgtgttgcaagacactagtattcttggtgttgaaagtcaccctcttcatttgcatggatttaacttctttgttgttggacaaggatttggtaactttgattcaaatagtgatccacaaaattttaatcttgttgatcctgttgaaaggaatacagttggtgttccatctggtggatgggttgctatcagattcctagcagataatccaggggtgtggttcatgcattgtcacttggaaatccacacaagttggggtcttaagatggcatggattgttttggatggaaagctcccaaatcagaaggtgcttccacctccagttgatcttcccaagtgttaa

SEQ ID NO: 10406 - DNA, 1942 bp, Glycine max
ttttttctttttctttccttttttatttttatttttttattgcctttcatgctctggcggagtactactagacactaccattttgaaataaggcaccaaaatgtgacacgactgtgccacacaaagagcatggtgacagtgaatggtcagtttccaggacctcgcattgtagccagagagggagaccgtcttcttatcaaagtgactaaccatgtttcgaacaatatcaccattcactggcatggaattagacaacttcaatcagggtgggctgatgggccagcatatgtgactcaatgccccattcaaagaggccaaagttatgtctacaattacaccattgttgggcagagaggcactctctggtggcatgctcacatttcatggttaagatcaactttgtatggtcctctcatcattcttcccaagctcaatgctcaatatccttttgccaaaccccacaaggaagttcctatcgtatttggagaatggtggaatgcagatcctgaggcagtcataacccaagcccttcaaaccggtggaggaccaaatgtatccgatgcttacacaattaatggacttccagggccattgtataactgctctgacaaagatacattcaagctgaaggtgaagccagggaagatttaccttctacgtttgatcaatgccgcactgaatgatgagctattcttcagcattgcgaaccacaccctcacagtagttgaagcagatgcagtttacgtaaaaccatttgcaaccaacaccatccttattacccctggccaaaccactaatgttcttctcaaaaccaaatctcattaccccaacgccacattcctcatgactgctagaccatatgctagtggccttggcacttttgacaacacaactgtggctggcatactgcaatataaaaccccaccaaatactcatcattcagctgcttcactgaaaaatcttccactcctcaaacctattctccctgcactcaatgacacttcttttgccacaaaattcaacaacaaactccgcagcttagcaagtgctcagtttccagccaatgtaccccagaaagttgatacgcactttttcttcacagtgggccttggcacaactccctgcccacaaaaccaaacttgtcaaggacccaccaatgcaacaaaatttgcagcatcagtgaacaatgtctcttttatacaaccaaccactgcacttcttcaaacccacttctttggacaatccaatggagtttacacagctgacttcccagccaaaccattgattccattcaactatactggcactccaccaaacaacaccatggtgagcaatgggacaaaggttgtggttcttcccttcaacacaagtgtagagctagtgatgcaggacaccagcattcttggtgctgaaagtcaccctctccatttgcatggctttaacttctttgctgttggtcaaggttttggtaactttgatccaaataaggaccctgcaaacttcaatcttcttgacccaattgagagaaacacagtgggagtcccatctggtggatgggttgctatcagattcctagcagataatccaggggtatggttcatgcattgtcacttggaagtgcacacaagctggggtcttaagatggcatgggttgtgttggatggaaaactcccaaatcagaagctgtttccaccgccagctgatcttcccaagtgttaacaaagcctcgaattccttcagtttgtttcaacaatgagcaattgcttctaaccagttgcttcaatttttttattttttatttccgttttcgggtgaaaaaggagttgaggcttgaattgagattgaggttggactttttcctttctttggctgagaattttatttataggtgtctttgtctacaaaattgtaataaattattttgaatgaaaaatcttcatga

SEQ ID NO: 10407 - DNA, 2073 bp, Glycine max
aaacaaactgtttaaagattatattttctgtcttgcaccctctagaacaaagaaatatgggtgctcctattaaatcatttgcattgccagcaatgcttctcttctcaatgatcatcataccccagcttgcactagggggcattaccaggcactaccattttgatataaaataccaaaatgtatcacgattatgccacacaaagagcgtggtcacagtgaatggtcagtttccagggccacgcattgtagcaagggagggtgacaatcttcttatcaaagtgactaaccatgttcagaacaatatctccatccattggcacggaattcgacagcttcgatcaggttgggctgatggaccagcctatgtgactcaatgccccattcaaacaggccaaagttacgtctacaattacacagttgttggccaaagaggcactctctggtggcatgctcacatttcatggttaagatcaactttatatggtcctctcatcattcttcctcagtatggagttccatatccttttactaagccttacaaggaagttcccatcatctttggagaatggtggaatgcagatcctgaggcagtaataacacaagcattacaaacaggtggaggaccaaatgtgtctgacgcatacactattaatggacttccagggccattgtataactgttctgctaaagatacattcaagctaaaggtcaagccaggcaaaacataccttctccgtttgatcaacgctgcacttaatgacgaactcttcttcagcattgcaaatcacactctcacagtggttgatgtagatgcaatttatgttaagccatttgacactgacactattctcatttcccctggacaaacctccaatgttcttctcaaaaccaaatctcactatcctaatgccacattcttgatgagtgctagaccatatgcgactggccagggcacttttgacaactcaactgtggctgctatccttgaatatgaagtttcaccacacgctcttcactcaacaacttcaatcaagaagctttcactcttcaagcccatcctccctgcccttaatgacacttctttcgcgacaaacttttccaacaagcttcgtagcttagcaagtgctcagtttccagccaatgtaccccagaaaattgataagcactttttcttcacagtaggccttggcacaactccctgctcacaaaaccaaacatgtcaaggacccaccaattcaacaaaatttgcagcatcagtgaataatgtatcttttatacaaccaaccactgcacttcttcaatctcacttctttggacaatccaatggggtttactctccttactttcctattagtccattgattccatttaactataccgggaccccaccaaacaacaccatggtgagcaatggaacaaaggtggtggttcttcccttcaacacaagtgtagagctagtgatgcaagacacaagcattcttggagcagaaagtcaccctctccatttgcatggctttaacttctttgttgttggtcaaggatttggcaactttgatccaaataaggacccagcaaacttcaatcttgttgatcctgttgaaaggaacacagttggtgtcccatctggtggatgggttgctatcagattcctagcagataatccaggggtatggttcatgcattgtcatcttgaagtgcacaccagctggggtctgaaaatggcgtggattgtgttggatggagaacttccaaatcagaagctgcttccaccaccagctgatcttccaaagtgttaaatattcactagcaattgcggccataactttctgaatatggtgttggtgttttgtttttatctttttcccattttttttctctccttcgttcacatggccctttttgccattcttcccgggctaactgactgtcattagtttcatcttttatttttccccttcggggataatgtggaagtgtggaaaataatattaaggtgtgtcaacaataacagatttgctctcaatattgtaatattctttcacttcaatgagaaatctttgattttaattatcc

SEQ ID NO: 10408 - DNA, 1713 bp, Glycine max
atgaagctttctgtgttctggtttgcatgggctttttctcttctaatttccatggcttctgctgctacagtagaacacactttcattgttcaaaacaaggctgtcacacgcttgtgcaaagagcgagtgattgtcacagtgaatggactttaccctggaccaaggatagatgtccgagaaggggacgctgtggttgttcacgtaatcaacaagtcaccctacaatatcactattcattggcatggagtatttcagctctttagtgcatgggcagatggtcctgaatatataacccaatgcaatattcgtcctcaaaatagttatacctataaattcaatgttatacaacaagaaggtacattgtggtggcatgctcactcaggagttttacgtgccacggttcatggtgctttcatcattcaccctcgttcgggtctgtttccttttcccaaaccccacaaacaagtaccaataatattaggtgattggtatgacggtaatattgtggatatttatcagcaagtactccttctcggggatgtaaggccatctgctgcctacaccatcaatggtttgcctggtgatctctacaattgctctagaaatcagatgttcaagctaaaggtaaagccagggaagacctacttgctaagaatgatcaacgctgcattcaataacaaccttttcgtcaagatagccaaccacagcttcacagttgttgccatggacgcttcctacatcgaaccctatgtgaccgacatcatcaccatcgcccctggccaaactgctgacgtgctcttcaaagccgaccaacccataggctcatattacatggcagcctctccttacgttgtgggccagccagaagccctattcgacaccacgacaactcgcggcattgtcgcttacgaaggctacacgacatcattaaaagactcgaagcccattgtgccactacttccacccttcaacgccacaccaattgctcacaaattttttagcaacatcacgagcttggtgggggccccacattgggccccggtcccacttgaggtggaccagcacatgttcatcaccattaacattaacctagaaaggtgtcccaagaatggcacgtgtcaaggtgtatttggacagaaattctccgcaagcatgaacaatgaatcatttgtgcaccccgttggaaaagggtactctatgttggaagcatcgttttataatgtgagtggtgtgtatactactgatttccctgacaagcctccaatcatatttgatttcacaaaccctaaaattgctttggatacgaagtatttgtttacgccgccaaaatcgaacaaggtgaagaaactcaagttcaattcgaccgtggaggttgtgtttcaaaatacacaaattatgaatgcgcaaagccaccccatgcaccttcatgggtttagtttccatgttttggctcaagattttgggaatttcaattacaccaaagataaatacaagtttaatttggtgaatccaatatttcgcaacacgattgctgtgccagctggaggatgggctgttataagattcaaagctaacaatccagggatgtggtttgtgcattgccatgtggatgatcatcagttatggggactagacatggttttcgaggttgagaatggaccaactccttcaacttctctccctccaccacctgctgatctacctaaatgttag

SEQ ID NO: 10409 - DNA, 1996 bp, Glycine max
tgataattcagagaaaagcttctatcctactatctatttggattcgccacttcatcaacatgaagctttccgtgttctggtttgcatgggcttttgctcttctagtttccatggcttctgctgctacagtagaacacactttcattgttcaaaacaaggctgtcacacgcttgtgcaaagagcgagtgattgtcacagttaatggactttatcctggaccaaggatagatgtcagagaaggggacgctgtgattgttcacgtaatcaacaagtcaccctacaatatcactattcattggcatggagtattccagctctttagtgcatgggcagatggtcctgaatatataacccaatgcaatattcgtccccaaaagagttacacttataaattcaatgtgatacaacaagaagggacattgtggtggcatgcacactcaggagttttacgtgccacggttcatggtgcttttatcattcaccctcgttcgggtctgtttccttttcctaaaccctacaagcaagtaccaataatattaggtgattggtatgacggtaatgttgtggatatttatcagcaagtactgcttctcggggatgtaagaccatctgctgcctacaccatcaatggtttgcctggtgatctctacaattgctctagaaatcagatgttcaagctaaaggtaaggccagggaagacctacttgctaagaatgatcaacgctgcattcaataataaccttttcgtcaagatagccaaccacagcttcacagtcgttgccatggacgcttcctacatcgaaccctatgcaaccgacatcatcaccattgcccctggccaaagtgctgacgtgctcttcaaagccaaccaacccataggctcatattacatggcagcctctccttacgttgtgggccagccagaagtgctattcgacaccacgacaactcgcggcattgtcgtttacgaaggctacaagacatcatcaaaaaattattcaaagcccattgtgccaatactcccacacttcaacgacaccccaattgctcacaaattttttagcaacatcacgagcttgatgggggccccacattgggtcccggtcccacttgaggtggatgagcacatgttcatcaccattaacataaaccttgaaaggtgtcccaagaatggcacgtgtcaaggtgtgtttggacagaaattctccgcaagcatgaacaacgaatcatttgtgcaccccgttggaaaaggatactctatgttggaagcatcgttttacaatgtgagtggtgtgtatactactgatttccctgacaagcctccaatcatattcgatttcacggaccccaaaattgctttggataccaagtatttgtttacgccgccaaaatcgaccaaggtgaagaaactcaagttcaattccaccgtggaggttgtgtttcaaaatacccaaattatgaacgcgcaaagccaccccatgcaccttcatggttttagtttccatgttttggctcaagattttgggaatttcgattacaccaaagataaacacaagtttaatttggtgaacccaatatttcgcaacacgattgctgtgccagcgggaggatgggctgttatcagattccaagcaaacaatccagggatgtggtttgtgcattgccatgtggatgatcatcagctatggggactagacatggttttcgaggttgaaaatggaccaactccttcaacttctctacctccaccacctgctgatctacctaaatgttagctatatatatgtgcctgcagaatgcaatcacaaatcacaagtcaataccaatttcctcctccttttcttttttcaatgcacttaataagccaattttttttaatttcaagcagtaaataatagcttcacttaaacacaacatcaagcaagataagtaaaccagaattatttgtaaaatcttgctataattaattaataaaagtaccttactgctaagctta

SEQ ID NO: 10410 - DNA, 1719 bp, Glycine max
atgaagcttttcgtgttttttcttgcatgggctatggctcttcttgcttcttcctttgcttcagctgctgtagtggaacgcactttcaaagttcaaaacaagactatcaaacgcttgtgcaatgagcgagtgattgtcacggttaatggaacattccctgggccaaagattaatgtccgtgaaggtgacactgtgattgttcatctattgaacgagggaccctataatatcactattcattggcatggggtgtttcagctgtttagtgcatgggcagatggtcctgaatatgtaactcaatgcacaattagtccgggaactaagtatacttataaattcaatgtgacacaacaagaaggaaccttatggtggcatgctcatgcatctgttttacgtgccactgttcatggtgctttcatcattcaccctcgttcagggcaatttccctttcctaaacctttcaagcaagttcccattatattaggtgattggtatgatgctaatgttgtggatgttgaaacgcaagcactggcctccggtggtcctccaaatgtatctaatgctttcacaatcaacggcttgcctggcgatctcttcaattgttctcgaactcagacattcaagatgaaggtgaagcaaggaaagacctacatgctacgaatgatcaatgctgcactcaataaccatcttttcttcaagatagcaaatcacactttcacagttgttgccttggatgctgcatataccgaccactacatcaccgaaatcattgtcattgcccctggccaaaccattgatgcactattcacagcaaaccaacccttaggttcatactatatggctgcatctccttattctattggtgttcccgtcattgacaacacgacgacacgtggcattgtcgtttacgactatgcaccaccaccatcatcatcaaaacctttgatgccaaccctaccacctataaacgacacagcaacggctcacaaattctacagcaacataactggcaaggtgggggccccacactgggttcctgtgccagccaaagtggatgagcacatgttcattactattggattaaacctagacacgtgtgatcctaagaatgccaccaatgccacgtgtcagggtccatctggccagagattttcttctagcatgaacaacgagtcctttgtgattcctaaggggagagggttctctatgttggaagcgttctttaagaatgtgagtggagtctacactgctgatttccctaacaaccctccggttatgtttgacttcacaaaccctaatattagttttaaccctaaccttttgtttgcaccaaaatcaaccaaatcgaagaaactcaagttcaattcaaccgtggagattgtgtttcagaatacagcgattgtcggtgtgcagaaccatccaattcacattcatggttttagtttccatgttttggctcaagggtttggaaatttcaactccaccgtagattcaaccaagtttaatttggtgaatcctcagctacgcaacacaattgctgttcctgttggaggatgggctgtcattagattccaagcaaacaatccaggggtatggtttgtgcattgccatgtggaagatcatgtgccatggggactagacatggcttttgaggttgagaatggaccaacttcttcaacttcactccctccaccacctgttgatctgcctaaatgttaa

SEQ ID NO: 10411 - DNA, 1976 bp, Pisum sativum
aaaaacatataaattcactttctcacaactatgtaaagtgtcatcattcagttaacttgagataaaagcatttgttttctatcttctcttttgttcaaggttagtcacttcaacatgaagattttgatgttgtggctaacatgggctcttgctctaagtttttcttcgatggtttcggctgctatagtggaacgtactttcacgattcaaaacaagactatcaaacgactgtgccatgagcaagttattgtgaccgttaatggcctttaccctggcccaaatatggaggtcagagaaggtgactctgtcattgttcacgttatcaacaattcaccctacaatataacaattcattggcacggagtattccagctgttgagtgcatgggcagatggtcctgaatatataacacaatgttcaattcgtcctgaaaataagtatacatacaaattcaaagtgacacaacaagaaggaacagtgtggtggcatgctcatgcatcagctctacgcgcaacagtgcatggtgcttttatcattcaacctcgttcgggtcgatttccatttcctaaaccttacaaggaagtgccaataatattaggggattggtatgatggaaatgttgaggatattgtcagaaaagaacttgaaactggcgataaaatatcgtctgatgctttcactatcaatggttttcctggtgatctcttcaattgttcaaaaaatgatgtatataacttgagagtgaagcaagggaagacctacttgttccgaatggtcaatgctgcactcaataacaatcttttcttcaagatagcaaatcacaacttcacagttgtagccctggatgctgcatacaccgagccttataacaccgacataatcgtcctcgcggccggccaaaccgctgatgtgcttttcacagcagaccaacgcaaaggtccctacttcatggctgcatctccttatgttcttggcgaaccagcaccgctctttgacaatacaacaactcgaggcattgttgtttacgacggttacaaaaaatcaaaaagttcccaacttaagcctttgatgccagcattgccactccacaacaatacaccaatagctcacaaattcttcagcaacataactagtcttgtgaaggctccacattgggtacctgttccacttgaggtggatgagcacatgtatatcacaattaacatggctttacaaccttgtcctaagaatgccaaatgcacaggtccacttggacaaaaattctcagctagcatgaacaatgagtcctttttgcttcctgttggaaaagggttttctataatggaggcatatttttacaatgtgagtggtttgtacactactgatttccctaataaccctccaaaaatttttgacttcacaaacccgaaaatattttttgatgctaatgttacatttgcgccaaaatcgaccaaggtgaagaaattcaagttcaactcgacagttgagattgtgtttcaaaatacagctattttgaacgcgcaaagtcatcccatgcatcttcatggtatgaattttcatgttttggctcaagggttcgggagtttcgatccgaaaagagataaattaaagtataatttggtgaatcctttaattcacaacacggttgctgtgccagtgggaggatgggctgctattagattccgaacaaacaatccaggggtatggtttttgcattgtcatgtggatgatcataacctttggggactagtgacggctttcatagttgagaatggaccaacaccttcaacttctcttcctccaccacctgctgatttacctaaatgttaattaccagttagttaacagatttttcgcagattcttgaaagtttcttgaagaattcagtattgtagtctaaatattttcaaatacatttgttaacaactaaatatatgaacaaaataatgaagattgcaaaaggaaaaaaaaaaaaa

SEQ ID NO: 10412 - DNA, 1728 bp, Medicago truncatula; identical to SEQ ID NO: 10373

SEQ ID NO: 10413 - DNA, 1992 bp, Glycine max; identical to SEQ ID NO: 10380

SEQ ID NO: 10414 - DNA, 2075 bp, Medicago truncatula; identical to SEQ ID NO: 10393

SEQ ID NO: 10415 - DNA, 1960 bp, Glycine max; identical to SEQ ID NO: 10391

SEQ ID NO: 10416 - DNA, 2076 bp, Glycine max; identical to SEQ ID NO: 10392

SEQ ID NO: 10417 - DNA, 2363 bp, Vitis vinifera
gtgtttcttttcttccttcaccaccatttgtgggagtttttgtgttctcatgcatggcattatgcctccttcctgagcttgcccttgcccaggattctggcataaccaggcactacaagtttgatgtatgtgtcctatggccttggcagaacagttcctgatcagctaatatatatcttcttgtatrggaaactaatatattttgaatttcttgtttgaaatattgtgtagatcaaattgcaaaatgtgacgagactgtgccatacaaagagcattttgacagtaaatgggcagtttcctgggccacgcattgtagcaagggagggtgaccgtcttctcattaaagtggttaaccatgtccagaataatatctccatccattggtatgtgtgttcagaaaacatgagtttgttctgtaaagcaaacatcayaatgtgtagtataagtgtgatttcatttggaacaggcatgggattcgacagcttcggagtgggtgggctgatgggccagcatatgtgacgcaatgccccattcaaactggccagagctatgtctacaacttcaccgttgttggccagagagggactcttttctggcatgctcacatctcatggctaaggtcgactctctatggtcccttaatyattctcccaaaacgtaatgtcccctatccatttgagaagcctcacaaggaagtccccatcatctttggtaattaatcaactgtktaatattcactttgtttgatatctcatggctaaaatttgttgagtatataaacyatgacaatgtgaaaatacaggagagtggtggaatgcagacactgaggcagtcattagccaggccctccaaactggtggaggcccaaatgtgtctgatgcctataccatcaatggacttccaggcccattgtataattgctctgccaaaggtatcaaaaacctatgaatattgcatgcccaaacagcattataatttggattttccaggaaattaataatgcgtaaatgggtttggctgcagatacattcaagctgagagtgaaggcaagcaagacttacctgctccgtttgatcaacgcagcgctcaatgacgagcttttcttcagtattgcaaaccatacactgacagtagtggatgctgatgctatttatgttaaaccttttgagactgacacacttctcattgcccctggacagaccacaaatgttcttctcaagaccaaaccccacttcccaaatgccgctttcctcataactgctaggccatacgtgactggccttggcacctttgacaactccaccgttgctggtatccttgaatatgaattaccctctgcttcccctcactctactgtctccattaaaaagcttccactcttcaaaccaacacttcctcctctcaatgacacttcctttgcgaccaacttcactaataggcttcgtagcttggccagccctcagttccctgctaacgtcccccagaaagttgacaggcacttcttcttcacaattggactgggaacaagcccttgcgaccaaaaccaaacatgccaaggacccaatgggacaaagtttgcagcttcggttaataatgtgtcctttgcatcttcaaccacagcccttctacaagcccayttctctgggcaatcaaatggggtttacaaccctgacttccctatcactccgatcattccctttaactataccggaaccccaccaaacaacactctggtgagcaatggaaccaaagtggtggttctaccatttaacactagygtggagcttgtcatgcaggacactagcattcttggagctgaaagccaccctctccatctgcatggcttcaatttctttgtcgtcggccaaggtttcggaaactatgatcctaacaaggaccctgcaaacttcaatctggtcgaccccattgaaaggaacaccgtgggagtgccctccggtggttgggttgccattcggtttctagcagacaacccaggtgagcatgaaagaatagcacaacatgcagtgaaatttaagtctacacaaaattattggccataattagagtgccataatatgaaaattattctgataagaacaggccatgattttacttataatttattcttcaaattcataaaaaatttacaatttgaagctaatgacaatggtgataaatatgtgggaaacaggggtatggttcatgcattgtcacctggaaatccacaccagctggggcttgaagatggcgtgggttgtcttagatggaaagctccccaatcagaagctgcttcctccaccagcagatcttcccaagtgttsattttgactcactcatgcattcacactgatcacaaactgccc

SEQ ID NO: 10418 - DNA, 1704 bp, Glycine max
atgcttctcttctcaatgatcatcataccccagcttgcactagggggcattacccggcactaccattttgatataaaataccaaaatgtatcacgactatgccacacaaagagcgtggtcacagtgaatggccagtttcctgggccacacattgtggctagggagggtgaccgtcttcttatcaaagtgactaaccatgttcagaacaacatctccattcattggcatggcattcgacagcttcgatcaggttgggctgatggacctgcctatgtgactcagtgccccattcaaacaggccaaagttatgtctacaattacaccatttttggccagagaggcactctcttttggcatgcccacatttcatggttaagatcaactctctatggtcctatcatcattcttcccaagcaaggagctccatatccctttaccaaaccttacaaggaagttcccatcatctttggagaatggtggaatacagatcctgaggcagtcataacacaggcattgcaaacaggtggaggaccaaatgtgtctgatgcctacactattaatggtcttccaggaccattgtataactgttccgctaaagatacattcaagttaaaggtcaagccagggaagacataccttctccgtttgatcaatgctgcactcaatgacgaactcttcttcagcattgcaaatcacaccctcacagtggttgatgtagatgcaatttatgttaagccatttgacactgacactattctcattgcccctggacaaacctccaatgttcttctcaaaaccaaatctcactatcctaatgccacattcttcatgagtgctagaccatatgcgactggccagggtacttttgacaactcaactgtggctgctatccttgaatatgaagttccaccacattttgttcactcaacaacttcagtcaagaagctttcactcttcaagcccatcctccctgcccttaatgacacttctttcgcaacaaacttcgccaacaagcttcatagcttagcaagtgctcagtttcctgccaatgtaccccagaaagttgataagcactttttcttcacagtgggccttggcacaactccctgccctcaaaatcaaacttgtcaaggacccaccaatgcaacaaaatttgcagcatcagtgaacaatgtctcttttatacaaccaaccactgcacttcttcaagcccacttctttggtcaatccaatggagtttactccccttactttcctattagtccattggttccatttaactatacaggcactccaccaaacaataccatggtgagcaatgggacaaaggttgtggttcttcccttcaacacaagtgtagaactagtgatgcaggacaccagcattcttggtgctgaaagtcaccctctccatttgcatggctttaacttctttgttgttggtcaaggttttggtaactttgatccaaagaaggaccctgcaaacttgaatcctgttgatcctgttgaaaggaacacagttggtgtcccatctggtggatgggttgctatcagattccttgctgataatccaggggtatggttcatgcattgtcaccttgaagtgcacaccagctggggtctgaaaatggcgtggattgtgttggatggagaacttccaaatcagaagctgcttccacctccagctgatcttccaaagtgttaa

SEQ ID NO: 10419 - DNA, 1740 bp, Glycine max
atggattccccccactttccttcatttgcatctctcagagttcttctgtttggtttctgcgttataactttgtttcctgagtttgtagtgagcataacaaggcactacacatttaatgtggagtacctgaacgtcactagattgtgccacacaaggaacattctgagtgtgaatgggaaattcccaggacctcgcttggtggcaagggaaggtgatagggttgtggttaaggtggttaaccatgtctcaaacaatgtatccattcattggcatggcatccgtcagataacaactgggtgggctgatggaccagcatatgtgacacagtgccccatacaaaccaaccagtcatacacatacaacttcaccatagttgggcagagagggactctgctttggcatgctcacatatcatggctgagagcaaccatctatggacccatcatcatcctccccaagcacaatgagtcttttccattcgagaagccacacaaagaaatccccatactttttggggaatggtttaatgttgacccagaagcagtcataagtcaagccttgcagacaggagggggacccaatgtttcagatgcatacaccatcaatggacttcccgggcctttgtataattgttcttctaaagatacatacacattaaaggtgaagccaggcaagacatatctgctaagactaatcaatgctgcactcaacgaagagcttttcttcagcatagccaaccacaccctaactgtggttgaagcagatgccagatacaccaaaccatttgacacagacacactcctcatagcccctggccaaaccacaaacgtgcttctcaaaaccaagccatattttcccaatgccacattccaaatgtctgctaggccttatttcacaggccgtggcacctttgacaactccacaactgcaggtaccctaatctacaagcaacccttgaaaaattccagtgtaaaaaatctcacccttctcaaaccaactttgccaccaataaatgccacaagctttgtggcaaacttcacagcaaaattcagaagcttggctagtgccaaattccctgccaaggtacctcaaaaagtggacagaaaatttttcttcactgtggggctagggactagtccttgccccaaaaacacaacatgccaagggccaagtaataacaccaagttcgcagcctcggttaacaacatttcttttgcacttccatcatctgtttccatcatgcaggcctactattcaggccaggccaatggggttttcaagactgattttcctgccacccctttgaaccctttcaattacaccggaacgcctccgaacaacacaatggtcaccaatgacacaaagctggtggtgctcaaattcaacaccagtgtggaggtggtgctgcaggatactagtattcttggtgctgagagtcaccctttgcatcttcatggctacgacttctttattgttgggcaagggtttggaaactatgaccccaacaatgaccctgcaaagtttaacctgattgaccctgttgagaggaacactgttggtgttcctgctggtggctggattgcttttagattccttgcagacaacccaggggtgtggttcatgcactgtcacttggacctccacacaagttggggattgagaatggcatggctagtactagatgggcctgggcccaagcagaagcttcaaccacccccttctgatcttccaaaatgctga

SEQ ID NO: 10420 - DNA, 2037 bp, Glycine max
atggatttcccccactttccttcatttgcatctctcagagttcttctgttttgtttctgcgttatgacattgtttcctgagtttgtagtgagcataacaaggcactacacctttaacgtcgagtacctgaacgtcactagattgtgccacacaaggaatattctgagtgtgaatggaaaattcccaggacctcgcttggtggcaagggaaggcgatagggttgtggttaaggtggtcaaccatgtctcaaacaatgtaaccattcattggcatggcatccgtcaaatgacaactgggtgggctgatggaccagcatatgtgacacagtgtcctatacaaaccaaccagtcatacacatacaacttcaccatcgttgggcagagagggactctgctttggcatgctcacatatcatggctaagagcaaccatttatggacccatcatcatcctccccaagcagaacgagtcttatccattcgagaagccacacaaagaaatccccattctttttggggaatggtttaatgttgacccagaagctgttataagtcaagccttgcagacaggagggggacccaatgtttcagatgcatacaccattaatggacttcccgggcctttgtataattgttcttctaaagatacatacacactaaaggtgaagccaggcaagacatatctgctaagactaatcaatgctgcactcaacgaagagcttttcttcagcatagctaaccacaccctaactgtggttgaagcggatgccaaatacaccaaaccatttgacacagacacactcctcatagcccctggccaaaccacaaacgtgtttctcaaaaccaagccatattttcccaatgccacattccaaatggctgctaggccttatttcacaggccgtggcacctttgacaactccacaaccgcaggtaccctcatctacaagcaacattccaatgtcaaaaatctcacccttctcaaaccaactttgccaccaataaacgccacaagctttgtggcaaacttcactgcaaaattcagaagcttggcaagtgctaaattccctgtcaaggtacctcaaaaagtggacagaaaatttttcttcactgtggggctagggactaatccttgccccaaaaacacaacatgccaagggccaagtaataacaccaaatttgcagcctcagtgaacaacatttcttttgcacttccatcatctgtttccatcatgcaggcatactattctagccaggccaatggggttttcaagactgattttcctgccacccctttgaaccctttcaactacacaggaacacctccaaacaacacaatggtcaccaatgacacaaagctggtggtgctcaagtttaacaccagtgtggagttggtgctgcaggacactagtattcttggggctgagagccatcccttgcatcttcatggttatgacttctttgttgtggggcaagggtttggaaactatgatcccaacaatgaccctgcaaggtttaatctgattgaccctgttgagaggaacactgctggtgttcctgctggtggttggattgctattcgattctttgcagacaacccaggggtgtggttcatgcactgtcacttggacctccacacaagttggggattgagaatggcatggctagtactagatggacctgagcccaaccagaagcttcaaccacccccttctgatcttccaaaatgttgactttgactaacccttttgggtccgaatacattggctatgcatcatttcctcctgagttactctccaatgttttttgttccttttgttttcaacaacaaatgtgaaattcttttgacgtgttaagggaaaacgaataagttgtggctcgatcgagtcacatggggtttgtaatggtaaaatggtttggttaattgtcttgatgttgttgtcatgtttggttggttggtttggaatgagcagtcacagggtttcgccgtctgatagaatattcaaagcaatagttggcaactaaaatttgatcaattc

SEQ ID NO: 10421 - DNA, 2109 bp, Populus trichocarpa
ggcacgagccaaatatttcttccataccaaacagtgtgtgagagaaatatttcaagagaaaggtccgaaatgggcaactctccgcgttccacagtattgccttcaatggcagctctgcagctcttgtgttttttctttttctctttagtgccggacttcgcagcggccataacaaggcagtacacgttcaatatcacacacaagaattttacgagattatgccacacaaggagcctagtgacagtaaatggacagttcccaggtcctcgcctggtagcaagggaaggtgatcaagttctagttaaggtggtcaatcatgttgctgaaaatattaccattcactggcatggagtaaggcagctaacaaccggatgggcagatggtccagcttacgtaacacaatgtcccatacaaactggccaggcatatacgtacaatttcaccatcactgggcagagaggaacactcttgtggcatgcgcacatttcatggctaagatcatcactctatggacccattattattctaccaaagctcaacgagtcctacccatttaagaaaccctacaaggaaatccccattctttttggagaatggtttaatgtagacccagaagctgtaattgcccaggctcttcagaccggggcaggtccaaatgtttcagatgcgtacaccatcaatggccttccagggcctttatacaattgttctgctaaagatacatacaaactgaaggtaaagccgggaaaaacctaccttctccgactaatcaacgctgcactcaacgacgagctctttttcagcattgcgaaccacactctcaccgtcgttgaagctgatgctgtttatgtcaagccttttgaagctgacacgctcctcatcagtccaggccaaactacaaatgttctactcaaaaccaagccacatctccctaatgcaaccttttacatgtttgccgggccttatttctcaggcatgggaagctttgacaactctaccactgctggtgtcctggtttataaacatccatctagtaataatcacttgaaaaagcttcctacactcaagccaactctgccaccaatcaatgctactggctttgttgcgaatttcaccaagaaattccgtagcttagccaacgctaaatttccagctaatgtgccacaaacagtggacaggaaattcttcttcactgtgggacttgggactaacccgtgccctaaaaatacaacctgtcagggaaccaataataatacgaaatttgctgcttcgattaacaatgtgtcatttgtattaccctctgtagctcttctgcaatcctactttctttggacagtcaatggtgtcttcacctccgattttcctcagaacccaacaataccattcaattatacgggtactccaccaaataatactatggtcagcaatggcacaaaagcagtggtgttaacattcaacacgagcgtggagttggtaatgcagggcacaagcatagtcgctgccgaaagtcacccactccatctgcatggttttaatttctttgtggttggacaaggttttggcaactacgatcccaacaaagatccttccaattttaatctggtcgaccctatggaaaggaacacggcgggagttccagctggtggctggatcgctattcgcttcctagcggacaatccaggggtgtggttcatgcactgccatcttgatgtgcacactagctgggggctccgaatggcatggatagttttggatggaccccaaccgaatcaaaaaataccaccaccaccgtctgatcttccaaagtgctgattgtggctgatcactggtcggcatacaatcatttatgaattcttgtttttaatgccttgtaacttaataattatgagatttttttgagcataggggagaaggcgaggctggtaaaattgagaaaacgaaaagaaagtaaggggttgattatgccttgtttggttgtgacttgttgctagttggtgtggtcgagagtcaaattgaaactgagattcgaaagagcagctcagttgtaaacatcggatggattaatcacgtttatcaataatatttattcgatatttggctcaaaaaaaa

SEQ ID NO: 10422 - DNA, 1848 bp, Glycine max
atgcaattaaagatatttctctatttaaggttatttttgtgttctatgctaaaagctaaactaccaaacatcaatgtctcagtaaaaggggaaatgggtattgcttatctcaacatgccaggcttcatgagggcaatgtttattatgttatgtgctatgatgatattgccagaactaacacatgcaaagcatgcaagagtaactaggcactacaagtttaatatcaaaatgcaaaacttcacaaggctttgccaaacaaagagcattgtaactgtcaatggacgatttcctggtcctagaatcatagcaagagaaggagacagaattgtggttaaagtcgttaaccacgttcaatacaatgtcacccttcattggcatggaattcgccaactaaaaagtgcatgggcagatggaccagcctatatcacacagtgtccaattcagacaggtcaaagttttgtgtacaacttcacagtcattggccaaagaggaacattgtggtggcatgcacatatctcatggcttagaacaactctctatggtcccattgtcattcttcccaaaagacatgtcccttacccattccctcaacctttcagagaagtccccatcatattgggggagtggtggaaagcagacacagaagcagttataaaccaagcaatgcaaacaggattggcaccaaatatctcagatgttcacaccatcaatggtcttccaggtcctgtctccaactgcgcagccaaagaaacattccagctcaaggtgaagcctggaaaaacatatctgcttcgtctgatcaacgctgcacttaatgatgagatgttcttcagcatagccaaccacacccttaccatggttgaagctgatgcagtgtatgtaaagcccttcagcacaaagattgttctgatcacacctggtcaaaccgtcaacgtccttctcaaggccaaatccaaggctccaaatggcacatttgccatatccacaaggccctatgctacaggtccagcttcttttgataacaccacagccacagggttccttgagtacaagaaaacttcacatgcaagcaacaagtcaaacaccaagaagcttcctcttcttagagcagtgttccctaaattcaatgacactgtctttgcaatgaacttccacaacaaggttcgtagcttggccaatgcaagattcccagcaaaagttccaaaaaccgtagacaggcacttcttcttcactgttggcttaggaatcagcaaatgctcaaaaaatcaacaatgccaagggcctaacaacacaagggtagctgctgctgttaacaatgtgacatttgtgacaccaaacattgctttactccaagcacattttttcaacaagtccaaaggagtgtacaccacagatttcccttccaaccctcctttcaagttcaactacactggcactccaccaagcaacatctttgtgagtagtggcactaagacagtggtgttgccatacaacaccagtgtggagttggtacttcaagacacaagcattattggagctgagagtcaccctcttcaccttcatggcttcaacttcttcattgttggccaaggaaatgggaactttgaccccaaaaaggaccccataaagttcaaccttgttgaccctgctgaaaggaacactgctggtgtgccatctggagggtgggttgctgttcgctttcttgctgataatccaggtgtttggttcatgcattgccaccttgaagtgcatactagttggggcttgaaaatggcatggatagtccaagatggtaaacggcgcaatcagaagctgccacctccaccttctgatcttccaaaatgttga

SEQ ID NO: 10423 - DNA, 2127 bp, Glycine max
atgggttgtgcttatctcaacatgccaggcttcatgagggcaatgtttgttgtgttatgtgcgctgatgatattgccggagctaacacatgcaaagcatgcaagagtcactaggcactacaagtttaatatcaaaatgcaaaacttcacaaggctttgccaaacaaagaacattgtaactgtcaatggacgatttcctggtcctagaatcatagcaagagaaggtgacagaattatggttaaagtggttaaccacgttcaatacaatgttacccttcattggcatggaattcgccaactgaaaagtgcatgggcagatggacctgcctatatcacacagtgtccaattcagacaggccaaagttttgtgtacaacttcacagtcattggtcaaagaggaacactatggtggcatgcacatatctcatggcttagaacaactctctatggtcccattgtcattcttcccaaaagacatgtcccttacccattccctcaacccttcagagaagtccccatcatattgggggagtggtggaaagcagacacagaagctgttataaatcaagcaatgcagacaggattggcaccaaatgtctcagatgctcacactatcaatggtcttcccggtcctgtctccaactgcgcagccaaagaaacattcaagctcaaggtgaagcctggaaaaacatatctgcttcgtctgatcaacgctgcacttaatgatgaaatgttcttcagcatagccaaccacaccctcaccatggtggaagctgatgcggtgtatgtaaagcccttcagcacaaaggttgttctgatcacacctggtcaaaccgtcaacgtccttctcaaggccaaatccaaggcaccaaatgccacatttgccatatccacaaggccctatgctacaggtccagctgcttttgacaacaccacagccacagggttccttgagtacaagaaaccttcacttgcaagcagcaagtcaaacaccaagaagcttccacttcttagagcagtgttccctaaattcaatgacactgtctttgcaatgaacttccacaacaaggttcgtagcttggccagtgcaagattcccagcaaaagttccaaaaaccgtggacaggcgcttcttcttcactgttggcttaggaataagccagtgctcaaaaaaccaacaatgccaagggcctaacaacacaagggtagctgcagcagttaacaatgtgacatttgtgacaccaaacattgccttactccaagcacattttttcaacaagtccaagggagtgtacaccactgatttccctgctaaccctcctttcaagttcaactacactggcactccaccaagcaatatctttgtgagtagtggcactaaggcagtggtgctgccatacaacaccagtgtggagttggtacttcaggacacaagcattattggagctgagagtcaccctcttcaccttcatggcttcaacttcttcattgttggccaaggaaatggaaactttgaccccaaaaaggaccccaaaaagttcaacctggttgaccctgctgagaggaacactgctggtgtgccatctggtgggtgggttgctgtgcgctttcttgctgacaatccaggtgtttggttcatgcattgccaccttgaagtgcacactagttggggattgaaaatggcatggatagtccaagatggtaaacggcgcaatcagaagctgccacctccaccctctgatcttcccaaatgttgaaaagatcgacaaccttaatgttttgcttttctttgtctatttttggggttacatttggaagtatttgctcctgccttttgttttcagttttgtccacatcttccaattttgggatttctttcctttgtacccaaaaaagaatgtttggggcaattagattgttatggttgtttctgttcttatgtgatcactctagttagaaagattattagtgggagagttgtatgtaggttacagtattcagttatctatactttgaattgtaacacattctcttttgccaactacggtattcttaaaggaccaaagctcctttatcaaagaatttgtgtatcttatgcaagttatcataaatttcatttcccttaaact

SEQ ID NO: 10424 - DNA, 1746 bp, Glycine max
atggaacttgcttctttctgctcattaagggccatatttcttttctcatgtgctctgtggataatgccagagttaacactagcaaagcatgcaaaaatcaccaggcactacaactttaatgtccaattacaaaatgtcacaagactatgtcaaacaaagagcattgtgacaattaatggtcgatttccagggcctagagtcatagcaagagaaggtgacaggctagtgattaaagtgaccaacaatgttccctacaacgttaccatccattggcacggtgttcgccaattacggagtgcttgggcagatggacctgcctatgtgacacagtgtccaattcaaacaggccaaacttttgtgtacaacttcacagtcactggccaaagaggaacattgtggtggcatgcccacatctcatggctaagaacaactctttatggtcctattgtcattcttcccaaaaaacatgtgccttacccattcccccaaacctttaaggaagtccctatcatatttggtgaatggtggaaagcagacacagaaactgttattaaccaagcaatgcaaacaggattggcacctaatctctcaaatgcttacaccatcaatggttttccaggttttctctacaatggcaccacaaaagataccttcaaactcaaggtcaaggctgggaaaacttatctcctgcgtctgataaacgctgcactcaacaacgagctcttcttcggcattgcaaaccacacactcactgtggttgaagctgatgcagtatatgtaaagcccttcagaacaaactatgtactaataacaccaggacaaactattaatgttcttctcaagacaaagtctaaggctccaaatgcagcctttgtcatagctgctaggccttatgctacaggtcctgcagcttttgacaacaccacagccactggcttgctggagtacaaaaaatcttcagtttcaaacacaaaaactaagaacaagaagcttcgtcttcttagacctgtgcttcctaaattcaatgacaccatcttcgcaatgaaattcaacaagaaggtccgaagcttggccaatgcaagattcccggcaaaagttccaaaaactgtagacaaacacttcttcttcactgttggattaggcattagctcctgccccaaaaaccaagcatgccaaggacccaataacaccagggtgactgcagccgttaataatgtgtcctttgttatgccaaacattgccttactccaagcccattttttcaacaaatccaaaggtgtgtacaccactgatttccctgctaatccacccttcagattcaactatactgggactccaccaaacaatatcatgataagcagtggaactaaggcagtggtgttgccatttaatgcaagtgtggagttgatcctgcaggacaccagcattattggtgctgagagccatccacttcaccttcatggctttaacttctttgttgttggtcaaggcaatggaaactttgaccccaagaaggacccatctaagtttaatctggttgacccggctgagaggaacaccattggtgtgccatcaggaggatgggttgccgtgcgcttctttgcagacaatccaggtgtttggttcatgcactgccatcttgaagtgcatacgagttggggattgaaaatggcatggatcgtccaagatggaaagctgcaccatcagaagcttccacctccaccctctgaccttcccaaatgttaa

SEQ ID NO: 10425 - DNA, 1734 bp, Vitis vinifera
atgggttctggctttgtgagggttatgctatttgcattttgtgctttctgggttttgcctgagctggtatttgcaaagcacgcaggcacaaccaggcactacaagtttgatattaagctgcagacagtgacgagattatgccaaacaaaaagtattgttaccgtcaatggacaattcccaggccctaggatcatagcaagagaaggtgatcgggtcatcattaaagtagttaaccatgtccaaaacaatatcacaatccactggcatgggatccggcagctaagaagcggatgggcggatggacctgcctacatcacacagtgcccaattcagacaggtcagagctatgtgtacaacttcactatcactggacagagagggaccttattttggcatgctcacatctcatggctgagagctactgtctatggatcccttgtcatcctccctaagcgaggtgtcccttacccatttccccaacccttcaaagaagtccccatcatctttggcgagtggtggaaagctgacatagagaccatgattaaccaagcaatgcaaacaggaggagccccaaatgtctccgacgcttacaccatgaatggtcttcccgggcccttgtataactgctcagctaaggatgcatttaggctgaaggtgaaaccggggaagacttatctcctccggctgatcaatgcagcactcaatgacgagctcttcttcagcatagccaaccatactgtcaccgtggttgaagttgatgcagtctatgtgaaaccatttaaaaccaacactcttgtcatcacccctggacagactaccaatatccttctcaagaccaaatctcactcccctaacgccaccttcctcatggcggccaggtcttacgccaccggtcctgctgcttttgacaattctacaacagctggaattttagaatatgagcacaaatcgtccgtgtcaaacactaagaacagaaagccctctgttctcaaaccagcccttcccatgttcaatgacacaatttttgccatgaaattcagcaagaaattacgcagcttagcctctaacaaatttccagcaaaagtcccacaaacagtgaatagacgcttcttcttcacggtgggactggggctaatccaatgctcacggaaccaagcgtgcccaggacccaacaacaccatggtagcagctgccatcaacaatgtgtcatttgtgcagccaagcacagcccttcttcaagctcatttcttcggaaagtccaagggcgtctacaccactgatttcccagcaaacccaaccttcaaattcaactacacgggtactcccccaagcaacattcttgtaaacagtgggaccaaggtggtggtgctacccttcaatacaagagtggagttggtgttgcaggacactagtatcataggtgcagagagccacccacttcatctgcacggctttaatttctatgtggtgggacagggattcggaaactttgatcccaagaaggatcctgccaatttcaacttggtcgatcccatagagagaaacaccgtgggggtgccttccggcggttgggtggccattcgtttccgcgcagacaatcctggggtttggtttatgcactgccacctggaagtccacaccagctggggattgaagatggcctgggttgtcacggatgggaagcgtcccaatcaaaaactgcctcctccgccctccgatcttcccaaatgttaa

SEQ ID NO: 10426 - DNA, 1710 bp, Vitis vinifera
atgctatttgcactttgtgcattgtggaatttgcctgagctggtacttgcaaagcatgctggcattaccagacactacaacttcgatattaaactgcagaaagtgaccagattatgtcaaacaaaaagtattgtcacagtcaatgggcaattcccagggcctcggatcatagcgagagaaggtgatcgggtcttaattaaggtggttaacaatgttcagaacaatatcacaattcactggcatggaatccggcaactaagaagcggatgggcagatggacctgcctacgtcacacagtgcccaattcagacgggacagagctatgtgtacaacttcacgatcacagggcagagagggaccttattctggcatgcccacatctcatggctgagagcaactctttatggaccccttgtcatcctacctaagcgaggtgtcccttacccatttcctcaaccctttaaagaagtccccatcatctttggagagtggtggaaagctgacacagagactatgattaaccaggcaatgcaaacaggaggggccccaaatgtctccgacgcttacaccattaatggtcttcccgggcctttgtataactgttccgctaaggatacatttaggctgaaggtgaaaccgggaaagacctatctcctccggctaatcaatgctgcactcaatgacgagctcttcttcagcatagccaaccatactgtcaccgtagttgaagttgatgcagtctatgtgaaaccatttaaaaccaacactcttgtcatcacccctggacagactaccaatatccttctcaagaccaaatctcactcccctaacgccaccttcctcatggcggccaggtcttacgccaccggtcctgctgcttttgacaattccacaacagctggaatcctagaatacgagcatatgtcgtccatgtcaaacacaaagaacaaaaggccctctgtccacagaccggcacttcccacattcaatgacacattgtttgcgatgagcttcagcaagaaattacgcagcttggccactaccaaattcccggcaaaagtcccacaaacagtcagtagacgcttcttcttcacagttggactggggctaatccaatgctcacggaaccaagcgtgcccaggacccaacaacaccatggtggcagctgccatcaacaatgtgtcatttgtgcagccaagcacagcccttcttcaagctcatttcttcggaaagtccaagggcgtctacaccactgatttcccagcaaacccaccctttaaattcaattacacgggcactcccccaagcaacattcttgtaaacagtgggaccaaggtagtggtgctacccttcaatacaagagtggagttggtgttgcaggacactagtatcataggtgcagagagccaccctcttcacttgcacggctttaacttccatgtggtggggcagggattcggaaactttgatcctaagaaggatccatccaatttcaacttggttgatcccatagagagaaacaccgtgggggtgccttccggcggttgggtggccattcgttttcgcgcagacaatccaggggtttggtttatgcactgccacctggaagtccacaccagctgggggttgaagatggcctgggttgtcatggatggaaagcgtcccaatcaaaagctgcctcctccgcccgccgatcttcccaaatgctag

SEQ ID NO: 10427 - DNA, 1992 bp, Vitis vinifera
cgaaattgcctatcaaagacaacagctagctagaagagaaagagggcagagatgggctcttgcattatgaggattatcatgtttgcagtttgtgcaatgtggtttttgcctgacctggtacttgcaaagcatgctggaagtaccaggcactacaagtttgatattaagttgcagaaagtgacgagattatgccaatccaaaaatattgttactgtcaacgggcagttcccagggcctcggattatagcaagagaaggtgatcgggtcatcattaaggtggttaaccatgttcagaacaatattacaattcattggcatgggatccggcagctaagaagcggatgggcagatggacctgcctacattacacaatgcccaattcagacaggccagagttatttatacaacttcaccatcactgggcagagagggaccttattctggcatgctcacatctcatggctgagggctaccgtctatggatcccttgtcatcctccctaagcgaggtgtcccttacccatttccccaacccttcaaagaagtccccatcatctttggcgagtggtggaaagctgacatagagaccatgattaaccaagcaatgcaaacaggaggagccccaaacgtctccgacgcttacaccatgaatggtcttcccgggcccttgtataactgctcagctaaggatacatttaggctgaaggtgaaaccggggaagacttatctcctccggctgatcaatgcagcactcaatgacgagctcttcttcagcatagccaaccatactgtcaccgtggttgaagttgatgcagtctatgtgaaaccatttaaaatcaacactcttgtcatcacccctggacagactaccaatatccttctcaagaccaaatctcactcccctaacgccaccttcctcatggcggccaggtcttacgccaccggtcctgctgcttttgacaattctacaacagctggaattttagaatatgagcacaaatcgtccgtgtcaaacactaagaacagaaagccctctgttctcaaaccagcccttcccatgttcaatgacacaatttttgccatgaaattcagcaagaaattacgcagcttagcctctaacaaatttccagcaaaagtcccacaaacagtgaatagacgcttcttcttcacggtgggactggggctaatccaatgctcacggaaccaagcgtgcccaggacccaacaacaccatggtagcagctgccatcaacaatgtgtcatttgtgcagccaagcacagcccttcttcaagctcatttctttggaaagtccaagggcgtctacaccactgatttcccagcaaacccacccttcaaattcaactacacgggcactcccccaagcaacattcttgtaaacagtgggaccaaggtggtggtgctacccttcaatacaagagtggagttggtgttgcaggacactagtatcataggtgcagagagccaccctcttcatctgcacggctttaacttctatgtggtgggacagggattcggaaactttgatcctaagaaggatcctgccaatttcaacttggtcgatcccatagagagaaacaccgtgggggtgccttcaggcggttgggtggccatccgtttccacgcagacaatccaggtgtttggtttatgcattgccacctggaagtccacaccagctgggggttgaagatggcctgggttgtcatggatggaaagcgtcctaatcaaaagctacctcctcctccatcggatcttcccaaatgttgagtttgatactcaacaagttgctttgctttttctcctctgttttttgtttttttgttttttcttcttgcatcgcccagaatgggtatcggtttgatgattgccttttattgattcaaattctatacccacactcccaaacaagagggggattttttatatgcataggtttgtaattctaattgaattattcaatgaaagaatcatcta

SEQ ID NO: 10428 - DNA, 2037 bp, Glycine max; identical to SEQ ID NO: 10420

SEQ ID NO: 10429 - DNA, 1740 bp, Glycine max; identical to SEQ ID NO: 10419

SEQ ID NO: 10430 - DNA, 1927 bp, Glycine max
atgctattgctggcagctttcttgcttccactatctgtggaagctatggttcgccactacaagttcaatgtggtgcaaaagaataccacaagattgggttcaaccaagcccattgttaccataaatggaaagttcccaggtcccaccatctatgcaagggaagatgacactgttctggttaaggtagtcaaccaggtcaagtacaatgtcagcatccattggcatggggtgagacaattgagaacaggttgggctgatgggccagcatacataacccagtgtccaattctaccgagccaggcctatgtctacaactttactcttacaggccagagaggcacactttggtggcatgcacatatcctctggcttagggccactgtccatggtgccttggtcatcttgcccaagcttggagttccttacccttttcccaaaccaaatatggaacaagttatcatattgagtgaatggtggaaatcagatactgaggctgtaataaatgaagctttgaaatctggtttggctccaaatgcctctgatgctcacacaatcaacggccatccaggacctatccaaggctatgcttcacaaggaggatataagttggatgttcaaccaggaaagacctacttgctaagaatcatcaatgctgcactcaatgaagagctcttctttaaaattgctgggcatgaactcactgttgttgaggttgatgcagtttacacaaaacctttgaaaactgataccattgtcatagcacctggccaaaccacaaatgtgcttctaacaaccaaacatgcaactggcaaatacttggttgcagcctctcctttcatggatgctcctattgcagttgacaacaagactgccactgccactttacactatctaggcacccttggttccaccatcaccaccctcacttccatgcctcctaaaaatgcaacaccagttgccaccactttcatcgactctctccgaagcttaaactccaaagagcatcctgctagagtccctttaaagattgatcataacttgctcttcacagttagccttggtgtcaacccttgtgctacttgtgtgaataatagcagggtggtagcagatatcaacaatgttacctttgtgatgcctaaaatttctcttcttcaagcacatttcttcaagatcaagggagttttcaccgacgatttccccggaaatcctcctgtggtgtataacttcacagggacacaaccatcaaatttgaagaccatgaaaggcacaagggtctatagacttgcttacaattccacagttcaattggtcttgcaagatactggaatgataacacctgagaaccatcctattcatctccatggcttcaacttttttgtggttggtaggggacaagggaatttcaaccccacaaaagaccccaagaaatttaaccttgtagatcctgtggagagaaatacagttggagtcccggctggggggtggactgctattagattcagggctgacaatccaggtgtctggtttatgcattgccacttggaaattcatacaacatggggactgaagatggcttttgttgtggacaacggtaaaggaccaaatgaatctttattaccacctccaactgacctacccaagtgttgagaaaattactaagtatatgcacaatgaggaaggagaaacatataaagagaagtatatatgccaaagggaggagaaatcaaggctttcatagagtaaagaaaggagaagatgctcagagtggaataagatcagatgaccagttgccatgtatttttctaatttcctttttcatcattcttttgtatattgtttgtactctcatcattctccttcttgaatgatatttttggcattaattatgcatataaatgtcaatcaaaattttaaggatttttaagcc

SEQ ID NO: 10431 - DNA, 1985 bp, Glycine max
agtgcattcaagagtagctagccaacaaaggagaagatattggaatagagagatcaaaaggggaggctatggcagcgtttgggattcgaatcatgctattgatggcagcttgcttgcttccactatctgtggaagctatggttcgccactacaagttcaatgtggtgctgaagaatgccacaagattgtgttcaacaaagccaattgtcaccgtaaatggaaagttcccaggtcccaccatctatgctagggaagatgacactgtactggttaaggtggtcaatcatgtcaagtacaatgttagcatccactggcatggggtcagacaattgagaacaggttgggctgatgggccagcatacataacccagtgtccaattcaaccgggccaggcttttatctacaactttacccttacaggccaaagaggcacactttggtggcatgcacatatcctctggcttagggccactgtccatggtgccttggtcatcttgcctaagcttggagttccttaccctttccccaaaccaaatatggaacaagttatgatattgagtgaatggtggaaatcagatactgaggctgtaataaatgaagctttgaaatctggtttggcaccaaatgtctccaatgctcacacaatcaatggccacccaggacctgtccaaggttgtgcttcacaagaaggatttaagttggatgtccaaccaggaaacacctacttgctaagaatcatcaatgctgcactcaatgaagagctattcttcaaaattgctggccatgaactcactgttgttgaggttgatgcagtctacacaaaaccattcaaaactgataccattgtcatagcacctggccagaccacaaatgtgcttctaacaaccaaacatgcagcaggcaaatacttggttgcagcctctccttttatggatgctcccattgcagttgacaacaagactgccactgccacattacactactcaggcacccttggttccaccatcaccaccctcacttccatgcctcccaaaaatgctacccctcttgccaccagtttcactgactcactcagaagcttgaactccaaaaagtatcctgctagagtgcctttgaagattgaccacaacttgctcttcactgttagtcttggaattaacccttgtgctacttgtgtgaataacagcagggtggtggcagatatcaacaatgttacctttgtgatgcctaaaatttctcttctccaagcacatttcttcaaaattaagggagttttcactgatgattttcctggaaatcctcctgtggtttataacttcacagggacacagccatcaaatttgaggaccatgaaaggaacaagggtgtatagacttgcttacaattctacagttcaattagtcttgcaagatactggaatgataacacctgagaaccaccccattcatctccatggctttaatttctttgtagttggtaggggacagagaaatttcaaccccacaaaagaccccaagaaatttaaccttgtagatcctgtggagagaaatacagttggagtcccagctggagggtggactgctatcagattcaggactgataatccaggtgtttggtttatgcattgtcatttggaaattcatacaacatggggactgaagatggcttttgttgtggataatggtaaaggaccaaatgaatctctattaccacctccaagtgacctccccaagtgttgagaaaattgctaagagtaacattctatacacaatgaggaagggaaaacatataaagagaaatatatatgtgcaaaaggaaggaacaatcaaggctaataagatccaatgacaagttgccatgtattttttcctttttcatcattttttttgtattgtttcattgttcgtactctctcctctttctccttcttgaatgatatttttggctttaattatacatataaatgtcaatcaaaattttaagaa

SEQ ID NO: 10432 - DNA, 1969 bp, Glycine max
atggccatgatgtggattagagtcatacttatactagcggcttgcatgcttcccctttcagtggaagccatggttcgccactacaagttcaacgtggtggtgaagaatgtcacaagattgtgttcaacaaagcccatagtaaccgtaaatggaaagttcccgggccccaccatctatgctagggaagatgacactgttttggtgaaggtggttaaccatgtcaaatacaatgttagcatccactggcatggagtgagacaattgaggacgggttgggccgatgggcctgcttacataacccaatgcccaattcaaccgggccaggcctttgtgtacaacttcaccctcacaggacagagagggacactttggtggcatgcacatatcctttggcttaggtcaactgtgcatggtgccttggtcattttgcctaagcttggagttccttacccttttcccaaaccccacactgaaaaagtcatcatattgagtgaatggtggaaatctgatactgaggctgtaataaatgaagctttgaaatctgggttggctccaaatgtctctgatgctcacacaatcaatggtcatccaggatccgttcaaaattgtgcatcacaagggggatacgaacttcaagttcaacctggaaacacctacttactaagaataatcaacgctgcactgaatgaagagttgttctttaaaattgctggccaccaactcacagttgttgaggttgatgctgtctacacaaaacctttcaaaactgacaccatagttatagcaccaggccaaaccacaagtgtgcttctaaaagccaaccgtgccgctggcaaatacttagtagcagccactcctttcatggattctcctattgcagtggacaatgtgactgccactgccacattgcactacactggctcactaggttccaccatcacaaccctcacttcattgcctcccaaaaatgccacaccagttgctacaaacttcactgactcactcagaagcctaaactccaaaaagtaccctgctagagtgcctcaaaaggttgaccattccttgttcttcactatcagccttggagtcaacccttgccccacttgtgtcaatggtagcaaagtggttgcagctatcaacaatgtgacctttgtgatgcctaaagtttctctcctccaagcacatttcttcaacataagtggagttttcattgatgattttcctgggaagcctccagtggtttatgacttcacagggacacaacagcctacaaatttgaggactaatagagggacaagggtttatagacttgcctataactccactgttcaattagtcttgcaagatactgggatgataacacctgagaatcatcctcttcaccttcatggattcaacttctttgtggttggtaggggacaagggaacttcaaccccaaaaaggacaccaaaaagtttaatcttgtggatcctgtggagagaaacacagttggtgttccatctgggggatggactgctatcagattcagagctgataatccaggtgtttggtttatgcattgccatttggaaattcatacaacatggggattgaagatggcatttgtggtggacaatggtaaaggaccaaatgagtctctactaccacctccaagtgatcttcccaagtgttgagaagaggactaatacacaatcttcgcttaaagaggaagaggggcaaacatgtaaagaaaatataatttccaaagggagtgtgtaccatcaaggctaataacaagattttcttgtagcaaataaaaaaggataagctgctaatagggaaaataagaccaattaacatgtcttcactttctatgttttttccctgtcattttttgcattatttgtacttctcatctctctccttgaaagatagttttggcttcatgtaattatatatacagtgtgaatcaaaatttacaggattttc

SEQ ID NO: 10433 - DNA, 1968 bp, Glycine max
atgtggataagaatcatacttctagtagcggcttgcatgcttcctctttcagtggaagccatggttcgccactacaagttcaacgtggtggtaaagaatgtcacaagattgtgttcaacaaagcccatagtaaccgtaaatgggaagttccctggccccacaatatatgctagggaagatgacactgttttggtaaaggtggttaaccatgttaaatacaatgttagcatccactggcatggggtgagacaattgcagacgggttgggccgatgggcctgcatacataactcaatgcccaattcaaccgggccaggcctttgtgtacaacttcaccctcacagggcagagagggacactttggtggcatgcacatatcctttggcttaggtcaactgttcatggtgccttggtcattttgcctaagcttggagttccttacccttttcccaaaccccacacggaaaaagtcatcatattgagtgaatggtggaaatcagatactgaagctgtaataaatgaagctttgaaatctgggtcggctccaaatgtctctgatgctcacacaatcaatggtcatcctggatctgtacaaaattgtgcatcacaagggggatacaaactccaagttcaacctggaaacacctacttgctaagaataatcaacgctgcactgaatgaagagttgttctttaaaattgctggtcaccaactgacagttgttgaggttgatgctgtctacacaaaaccttttaaaactgacactatagttatagcacctggccaaaccacaaatgtgcttctaaaagcaaaccgtgctgctggcaaatacttagtagcagccactcccttcatggattctcctattacagtggacaatgtgactgccactgccacattacactacacaggctcacttggttccaccatcacaaccctcacttcattgcctcccaaaaatgccacaccagttgctacaaacttcactgactcactcagaagcctaaactccaaaaagtaccctgctagagtgcctcaaaaggttgaccattccttgttcttcactgtcagccttggagtcaacccttgccccacatgtgccaatggtagtaaagtggttgcagccatcaacaatgtgacctttgttatgcctaaagtttctctcctccaagcacatttcttcaacataagtggagttttcacagatgattttcctgggaagcctccagtggtttatgacttcacagggacacaacagccaacaaatttgaggactaatagagggacaagggtatatagacttgcctataactccacagttcaattagtcttgcaagatactggaatgataacacctgagaaccatcctattcatctccatggattcaacttcttcgtggttggtaggggacaagggaatttcaaccccaaaaaggacaccaaaaagtttaatcttgtggatcctgtggagagaaacacagttggtgttccatctggggggtggactgctatcagattcagggctgataatccaggtgtttggtttatgcattgccatttagaaattcatacaacatggggattgaagatggcatttgtggtagacaatggtaaaggaccaaatgagtctctactaccacctccaagtgatcttcccaagtgttgagaagaggactaatatacaatcttcgcttaaggagtaagaaggggaaacacgtaaagaagatataatttccaaagggagtgtgtaccatcaaggctaataacaagattttcttggagcaaataaaaaggataagctgctaatagggaaaataagaccaattagcatgtcttcactttctctgttttttccctgtcattttttcattttttttgcattatttgtacttctcatctctccttgaaagatagttttgacttcatgtaattatatatacagtgtgaatcaaaatttacaggattttca

SEQ ID NO: 10434 - DNA, 1782 bp, Medicago truncatula
atggggattatgtgtattagaatcatatttctactagctgcttattgcttgcttcctctatctgtggatgccatggttcgccactacaagttcaacatgttacatgtcatgcacttagactttatttttgttcttgttgactcctatatctacttcatgaccattaaggttgataatgttttattattattgttaattcaggtggtgatgaagaatgccacaagattgtgttcaaccaaacccattgtaactataaatgggaatttccctggccccaccatctatgctagagaagatgatactgttcttgttaaggtggttaaccatgtcaaatacaatgttagcatccattggcatggaatcagacagttgagaacaggttgggctgatgggccagcatacataacccaatgcccaattcaaccaggccaggtctatatgtacaattttaccctcacaggacaaagaggaacactttggtggcatgcacatatactttggcttagagcaactgtacatggtgctattgtcattttgcctaagcttggagttccttacccttttcctagaccccacatggaacaagttatcatattgagtgaatggtggaaatcagatactgaggctataataaatgaagctttgaaatctggattggccccaaatgtctctgatgctcacactatcaatggtcatccagggcctgttcaacattgtgcttcacaagaaggattcaaattccaagttgaaccaggaaaaacctacttgctaagaataatcaatgcagcactaaatgaagacctattcttcaaaattgctggacacaaatttactgttgttgaagttgatgctgcatacacaaaaccattcaaaacagacacaatagtaataacaccaggacaaacaacaaatgtacttctcaaaaccaaccatgcaagtggcaaatacatggtagcagcttcaacattcatggatgcaccaattgcaatagacaatgtaacagccactgccacattacattacccaaatacccttggttcaacaatcacaacactcacttcactacctccaataaattcaacaaaaatagctaacagtttcactgactcattaaaaagtctgaattcccataaataccctgctagagtccctaaaaaaattgaccattcattgttttttactgtgagtcttggtgttaacccttgtgctacatgtcccaatggtagtagagttgttgcagctataaataatgtaacatttgtcatgcctaaaatttcacttcttcaagcacatttttttaacattagtggaatttttactgatgattttcctagaaaacctgaaatagtatatgattttactgggaataaacagccatcaaattttaggactaataaagggactagggtttatagacttgcttataattcaacagttcaattaattttgcaagatactggaatgatagctcctgagaatcatcctattcatctacatggattcaatttctttgtagttggtaagggacaagggaattttaatcctaaaaaggatactaaaaagtttaatttggttgatcctgtggagagaaatacagttggtgttccatctggtggatggactgctatcagattcagggctgataatccaggggtatggtttatgcattgtcatttggaaattcacacaacttggggattgaagatggcatttgttgtggacaatggtaaaggaccaaatgaatctttactaccacctccaagtgaccttcccaagtgttga

SEQ ID NO: 10435 - DNA, 1924 bp, Vitis vinifera
atgacgcagtggattcgggtcttgcttctggtggcttctctgtttccgattttagtcgattgccggactcgtcactacaagttcaatgtggttttgagaaaggccacaaggttatgttcaagtaaacctatagtcactgtgaatgggaacttccctgggcctaccattcatgctagggaggatgatacagtgctgatcaaggttgtgaaccatgtcaagtataatgtcagcattcactggcatgggatcaggcagcttaggacaggttgggcggatgggccggcatatataacacagtgtccgattcagccggggcaaagctatatatacaatttcaccattacaggccaaaggggaacacttctatggcatgcgcacatcctctggctcagggctaccgtccatggcgccctcgtcatcttgcccaagcttggtgttccttatccatttcccactccctataaggaagctgttgttattttgggtgaatggtggaaatcagatgtggaagcagtgatcaatgaagctatgaagtctggcctggccccaaatgtgtccgatgctcacaccattaatggccatcctgggccattctcaagctgctccttacagggtgggtttacactgccagtagacccaggcaagacatacatgctgagaatcatcaacgctgcgctgaatgaagagctcttcttaaagattgcaggccatcatctgactgtggttgaggtcgacgccacttacactaaacccttttcaactgacaccgtcctcatcgctccggggcagaccaccaatgtactcctaacagcaggactcggcgctggaaagtacttggttacagcgtcttctttcatggattcccccattgcagtcgacaacatgactgcaacagccaccgttcaatactccggcaccctttccagtactccgactactatcaccaacccacctccccaaaacgccacctcagtggccacaaagttcacagattccctcagaagcctgaactcgaaaaagtacccagccagagttccattggccaccgatcactcccttctgttcactgttggacttgggattaacccctgtgctacttgcgttaatggcggtaaagtggtggctaatatcaacaatgtcacttttgtaatgcctactactgctcttcttcaagcccattacttcaaaatgaagggagtttacactgatgatttccctggaaaccccccaattgcattcaactatacaggcacacagcctacaaacttccagaccatgaatgggacaaggctttatagactggcatacaactctaccgttcagttagtcctacaagacaccggtatgatagcgcccgaaagacatccagtccatctccatggcttcaatttcttcgtcattggaaggggtttagggaactataacccaaagaaggacccaaaaaaattcaacctggttgaccctgttgagaggaacacagttggagtcccctctggtggatggactgccatcagattcagagcagataacccaggggtctggttcatgcactgccatttggaagtccacacaacatggggtctgaaaatggcttttgtggttgacaatggaaaaggccccaatgaatcagttctaccacctccaagtgaccttcccaaatgctaataaaaagacttcaaaacaagaagcttaacatcagaggaaaaaagagaatagaaagaaagaaagaaagaaagagaaatctagataataaacagagtttattttttagcaagccaagctctgctcagagttggataaaacagaccaagcttctttttagtttatacagtgttgctcttttcatgggctggtatcatgtacgtttggggacatctaattatgcatataatgcccattaaaattccaatgtattgaacttcaa

SEQ ID NO: 10436 - DNA, 1782 bp, Medicago truncatula; identical to SEQ ID NO: 10434

SEQ ID NO: 10437 - DNA, 1927 bp, Glycine max; identical to SEQ ID NO: 10430

SEQ ID NO: 10438 - DNA, 1509 bp, Glycine max
atggaaaagatgttagggagaaattgtgggaagttgaagaccaagattgtgtgcactttgggaccatcaagtaggtcagtggagatgctggagaagcttctgaaggcagggatgaacgtggctcgcttcaacttctctcatggcactcactcttaccaccaagagacccttgataatctcagaactgcaatgaacaacaccggcattctctgtgctgtcatgttggacaccaagggtccagagatcagaactgggtttttgaatgaagggaagccaatacaaatccataggggacaagaaatcacaatcacaactgattacagcataaagggtgatgagaacatgatcagcatgagctacaagaagttggcacaccatttgagtccagggagtaatattctgtgtgctgatgggacaattagtttcactgtgctagaatgtgacaaagagaatggcttggttcgatgtcattgcgaaaattctgcagttctgggggagaggaagaatgttaaccttcctggagtggttgttgatcttccaatcttgacagagaaggacaaggaggacattttggagtggggggttcctaataagattgatatcattgctctctcttttgttagaaaaggttcagaccttgtggaggtcagaaatctacttggaaagcatgcaaaaagcatacttctcatgtccaaggttgaaaatcaagagggtgttgcaaattttgatgaaatactggaaaattcagatgcattcatggtggcaagaggtgacctgggaatggaaattccaattgagaagatctttctagctcagaaagttatgatacacaagtcaaacattaaaggcaagcctgtggtgacagccacccagatgttagagtccatgatcaaatctcctcggcctacacgagccgaggccaccgatgttgccaatgcagtccttgatggcacagactgtgttatgcttagcggggaaactgctgcaggagcctatccagacattgctgtccaaaccatggccagaatctgttcagaggcagagagtttcatagactatggtgacctattcaagagagtgatggaaacagctccaactccaatgagtcctttggagagcatggcttcagcggcagttaggactgcaaattgcatcaatgctgcactcatcttagttctaactagaggaggaaccacttcaaaacttgtggcaaagtatagacccagcatgcctattctgtcactggtggttcctgagataacaacagattcttttgaatggttctgcagtcaggaagcccctgcaaggcatagccttatctaccggggactaatacctgttttgggcacaggttcttttggagattccatgactgaatcaacagaagaaaccatacagcttgctctttcatatgcaaagaaaaatgacttgtgcaagcctggagactctgttgtagcacttcaccgtcttgagtctggtactgtcatcaagatattggatgtttgttaa

SEQ ID NO: 10439 - DNA, 1419 bp, Glycine max
  misc_feature (460)..(460): n is a, c, g, or t
  misc_feature (1069)..(1070): n is a, c, g, or t
atgaccataggagagagaaggtataatttgaaaaaaatttccttcaacttctctcatggttcttaatcttaccaccaagaaacacttgataatctcaggactgcattgaacaacactggcattctctgtgctgtcatgttggataccaagggtccagagatcagaacagggtttttgaaacaagggaagcccatagaaatccaaagaggacaagaaatcacaatcacaactgactatagcataaagggtgatgaaaacatgatcagcatgagctacaacaagttggcacaccatttgagtccagagagtaatattctgtgtgctgatgggacaatcagtttcactgtcctggaatgtgacatggagaatggcttggttcgatgtcgttgcgaaaattctgcagttcttggggagaggaagaatgttaacctacctggagtggttgttgatcttccaaccnttacagaaaaggacaaggaggacattttggagtggggggtcctaataagattgacatcattgctctcttttgttagaaaaggttcagatcttgtggaagtcagaaatctactaggaaagcatgcaaaaagcatacttctcatgtccaaggttgaaaatcaagagggtgttgccaattttgatgaaatactggcaaattcagatgcattcatggtggcaagaggtgacctgggaatggaaattccaattgagaagatctttcttgctcagaaagttatgaaacacaagtcaagcatacaaggcaagcctgtggtgacagccacccagatgttagagtctgcgatcaaatctccccggcctacgcgagctgaggccactaatgttgccaatacagtccttgatggcacagactgtgttatgcttagtggggaaactgctgcaggagcctatccagacattgctgttcaaaccatggccagaatatgttcagaggcggagagtttcatagactccactgacctattcaggagagtgatagaaacagctccaactccaatgagtcctttggagagcatggtttcggccgcagttaggactatattgcagcaanntgctgctctaatcttagtgctaactagaggaggaaccacttcaaaacttgtggcaaagtatacacccagcatgcctattctgtaagttgtggttcctgagataataacagattcttttgaatggttctgcagtgaggaaacccctctaaggcatagccttatctaccggggactaatacctgttttgggcacaggttcttatggagattccatgactaaatcaacagaagaaaccatagagcttgctctttcatatgctaagaaaaatgacttgtgcaagactggagactctgttgtagcactgcaccgtcttgagtctagtactgtcatcaagatattggatgtttga

SEQ ID NO: 10440 - DNA, 1950 bp, Vitis vinifera
aggggggaggaggatggaaaaggcccaagacaaagatagtgtgcacgttgggaccggcgtccaggtctgttgaagtgatagagaagcttttgagggctggtatgaacgtggcgcgcttcaacttctcccatggctcccatgcctaccaccagcaaacccttgacaatctcaggactgccatggccaacaccgaaaccctttgcgccgtcatgttggatacgaaggtctctctcgctcttctctctttgtttatctatctgcatggcatatttctggttcttgggactgggtttcctgaacccatttaaaccctcttcccttgcattgcctccaaaattattttaaaaaccctaaataaatttttgamgaaaaagaaacaaaaggtaggggaaggctgaagcctggttttgaattttytttctttcttatttttgttaatgcaatttattygtttcttgatttcttcccctgtttccatcaatatatatacgtcatgacaaagctgacatttcttggtccgaagcaggggatattaccaaaaatattccagagaattcytttttttttttttttttttwaatttggatgtaaacatggcagggtccagagattcgtactggatttttgaaggatgggaagcctgtccaactcaaaaagggtcaagagatcaccatctccactgactatagcatcaagggtgatgaccacatgatctgtatgagctaccaaaagctggctgaggatttgaggccacagagtgtaattctatgtgctgatggcactatcaccctcacagtcttggcctgtgacaaagaattggggttggttcgatgtcgttgtgaaaactctgcagttctgggtgagaggaagaatgtcaatcttcctggggttgttgtggaccttcccaccttaacagagaaagacaaagaggatatcttagaatggggggtacccaataagattgatatgattgctctgtcttttgttcgcaaagggtcagaccttgtggaggttcgaatgctgctggcggaacatgctaagtctatccttctcatgtcaaaggtatgttgaggctgcaaagaactctgttgaagtatttgcatttttgggaaggatatgactaattttgtgatttggcaggttgaaaatcaagagggtgttgctaattttgatgaaattcttgcaaactcagatgcgtttatggtggccaggggtgaccttggaatggaaatccccattgagaagatatttcttgcacagaaagtgatgatatataagtgtaacattcagggaaaacctgtagtcactgcaactcagatgttggagtccatgatcaaatctccccggcctacacgagctgaagccactgatgttgccaatgcagttcttgatggcaccgactgtgtgatgctgagtggggaaactgctgctggggcataccctgaacttgctgttcaaaccatggccaggatttgcttggaggcagagaattcacttaattatggagatgtcttcaagacaatcatggaaactgcaccaatgcccatgagccccatagagagtttggcctcctcagcagtacgggcagccaatgggtctaaagcagctttgattttggtcctgaccagaggtggaacaactgctaatctggtggctaagtaccggcccagcatgccaattttgtctgtggtagtcccggagatcacagcagattcctttgattggtcttgcagtgatgaatccccggccagacacggcctgattttcaggggactggtacctgttctatgctcaggatctgcaaaagcttctgacagtgagtcaacagaagaggctttggagttttcacttcaatatgcaaagaccaaggaaatgtgcaagcctggagactcagttgtggcattgcaccgagttggaactgcttctgtgatcaagatactaactgtcaaa

SEQ ID NO: 10441 - DNA, 1927 bp, Medicago truncatula
gagaaagcacagcacaccaaaacaacagagagactaaagaagaagaagaagaagaaaaccaaggtcaccaccactgatcgatctaatccaaagatgtcgacgattgtagaagagaagaaaccgaaaactaagatcgtttgcacgctgggacccgcatctaggtctattcccatggtcgagaagcttttgcgagcaggtatgaacgttgccagattcaacttctctcacggttctcatgactatcatcaggaaactcttgataatcttagagccgccatggagaatactggtattctttgcgccgtcatgcttgatactaaggggcctgagattcgtactggatttctcaaggatggcaaacctatccaactgaaacaaggtaatgaaataactatttcgaccgactatagcctaaagggtgatgagaatacgatctgcatgagctacaaaaagttggctgaggatgtgaagcccgggagtgtcatactctgcgcagatggaaccatatcatttacagttttatcatgtgacaaagaattgggtttggttcgagtccgctgtgagaactctgctgttctaggcgagagaaagaatgttaatctgcctggagttgtagtggatcttcccactttgactgagaaagacagggaagatattatggtttggggtgttcccaataaaattgacatgattgcactatcttttgttcgaaaaggttctgatctggtgcaagttcggaaactgctaggacaccatgctaagaacattcttctcatgtcaaaggttgaaaaccaagaaggggttgcaaactttgatgatatccttgcaaattcagatgcatttatggtggcacgtggtgaccttggaatggaaattccaattgagaaaatatttctagcacagaaagtgatgatttataagtgcaatatccaaggaaagcctgttgttactgcaacccagatgttggagtcaatgatcaaatctcccaggccaaccagagctgaagctacagatgtcgccaatgcagttctggacggcacagactgtgtcatgcttagcggtgaaactgctgctggagcttatccagaacttgctgttcgaactatggctaaaatttgtgttgaagctgagagtaccattaactatggagatgtatttaaaaggataatggagcactcaccagtacccatgagcccattggagagtctagcttcttctgcagttaaaatggccaactcagctaaagcagcacttatattggttttaactagaggagggagtactgcaaaattagtggctaaatacagggctggcatgccaattctttctgttgtcgttcctgagattaagactgacacttttgattggtcctgcagtgatgaggcccctgccagacatagcttgatattccgaggattgattccagtactcagcgcaggttctgctagagcttctcacacagaaacaacagaagaggcactagacttcgccattcagtatgccaaaacaaagggtctctgcaataacggggattctgtggtggctctgcatcgcgtgggtgtcgcatcagtcatcaaaatcttgactgtgaaatgatctcctattaaaaggagttcttcagctgcttttggcaatttttgatggtgggaaagaagttttatcatacatttttcattcctaattggatgcagaacatcagtcagaattttttttgttattagggatacatactccctgttttagaattattcatatatcattgtttcttcgccttattattgtttccactgcggtaagtggtgatgcatgatgctttttgtaaacctaaaaggtgaccaatttctggcctatcagttttgatttgttttgatagagaaggttatggtttttatattgggaaatgttaacacttattttaattattcgt

SEQ ID NO: 10442 - DNA, 1491 bp, Medicago truncatula
atggcagagaagaaacccaaaacaaagatcgtgtgcacgctgggacctgcatcgaggtctgttccaatggtggagaagcttctacaagcaggcatgaatgtcgctcgtttcaacttctctcatggttcctatgaatatcatcaggaaacgcttgataatcttagaaccgctatgcaaaataccggtattctctgcgccgtcatgcttgacactaaggggccggagattcgaaccggatttctcaaggatggaaagcctgtccaactgaaacaaggtcaggaaataaccatttcaaccgactatgacataaaaggagatgagaatatgatctgtatgagctacaaaaagttggcttatgacgtgaagcccggaagcattgtattatgcgcagatggcaccatatcatttaaagttttatcatgtgacaaaaaagctggtttggttcgatgctgctgtgaaaactctgccatgcttggcgaaagaaagaatgttaatcttcctggagtcatagtggatctcccaacattgactgagaaagacaaggaagatatcatggtatggggagttcctaataatattgacatgattgcactttcttttgttcgaaaaggttctgatctggtggaagttcgcaagttgttgggaaaacatgctaagaacatacttctcatgtcaaaggttgaaaaccaagaaggagttgcaaattttgatgaaatccttacaaattcagatgcatttatggtggcacgtggcgaccttggaatggaaattccaatagagaagatatttctagcacaaaaagtgatgatttataagtgtaatatccaaggaaagccggttgtcactgcaacgcagatgttggagtcaatgatcaaatcacctaggccaaccagagctgaagctactgatgtcgcgaatgcagttctggatggcacagattgtgtcatgcttagtggtgaaactgctgctggagcttatccagaacttgctgttcgaactatggctaaaatttgtgttgaagctgagagtaccatcaactatggagatgtatttaaaaggataatggagcactcaccagtaccgatgggcccattggagagtctagcttcttctgcggttaaaatggcaaactcagctaaagcagcacttatattggttttaactagaggagggagtactgcaaaattagtggctaaatatagggcaggcatgccaattctttctgttgtcgttcctgagattaagaccgatacctttgattggtcctgcagtgatgaggtccctgccagacatagcttgatattccgaggattgattccagtactgagtgcgggttctgctagagcttctcatgcagaaacaacagaagaggcactagacttcgccattcagtatgccaaaacaaaaggtctttgcaataacggggattctgtggtggctctgcatcgtgtaggtgtcgcatcaatcatcaaaatcttgactgtgaaatga

SEQ ID NO: 10443 - DNA, 1985 bp, Glycine max; identical to SEQ ID NO: 10431

SEQ ID NO: 10444 - DNA, 3681 bp, Glycine max
agggtgagaaattttggtcccgggaatcttcaccataggccactcacgttatcttttttcatcacttcttcttcaccttcgatccttcctatgtccaattaattgtttaaggagaggaccaactcataacgtcacaaacaatattattattaacatttagatttaggtggtggtggatttcaaattccagctattactattgttgttgttgttgtttttttttatcgaaaacccccaatcctaaggaatcgaaattgaaattgaaacagagcaacacagagcctgatttgttccaatcggtgtgggctatggagagtgtgaatgatctgatccaagaggccaagctccgcactctctggtgggcactctgtatattcgccgtttcctatttcctaactcatactagtaaatcaatgtggatgaatgtacccatgtcgatcctatttgttgtggggctgcgcattcttttcaatagggtggagtttcgttggaagcttcaacagcctagaccgcagacctatctatctcatttggagaaaaagcagttgtctctcaatgatccatgcctcactagtttgccttcccctgcaaaatggaagaggaaaattgattctcctgctgtggaggctgcaatgagtgatttcattgataagattttgaaggattttgtggttgatttgtggtactcagagatttctccagataaggagtttccggagcagatacgggcaataatcatggatgttctagctgaaatatcaggaagggttaaagagataaacctggttgacctgctgacaagggatttagtagatttaataggtgttcacatagaacttttcagaagaaatcaagctgttataggtgttaatattatgaaaacattatcttctgaggagcggaatgacagattaaaattccatctgttgaattctaaggagcttcatccggcactaatatctcctgagagtgagtacaaggttcttcagcggctaatgagtgctgttttagctacagtactaagacaacgagaagctcagtgtcctgtgattcgttctatatctcgggaattattaacttgcttggtaatgcagcctattatgaatttggcaagccctgggtatattaatgaactgattgaatctcttctacttctctttaatgatgatggtacggaagggatgggcagtgatcagtcaactaatgtagcaagtctccatcatggtcattctgttgccagtaagggtggacacaacaatctcacagcctctaataagcatccatctttaaatcaaggaactgatatgatattggctaaaatgagtgatcagggagggacatcgttacaagatagcactctccatcaagagtctaaacaagttgggcctgctgattgggcacgaatgttggaggttacaactcagaggagaactgaaattcttatgccggagaatcttgagaacatgtggacaaagggaaggaattacaaaaggaaagagaacaaaattatcaaagctggctctaaggatctttctgcaaagagtccctctacagacagttcacggcctcatagaaaattggctcaggaaacatcagcaagtaaacgtggaaagtatgaagttgcagatgggaagtcttctctgccgccattgcctgccataggttcagatcccctgcaaaatgttggaagtgcaaaaaattcagaatctcctaaaaaccctggcaaggaattgtctattgtgggagatcttgcttctgatgcttatagaagtccactaaagaggtcgagtagtgcttcttccttaggaatcctatctaataaagaagactccagaatttcagagtttttcaaccctgaacttgagaggcacagtgaaggatttcggggaaagagttcttctaatatgattgttaggaaagaagggtcattagttcctaagcttcggtgtcgggttgtgggagcatattttgagaaaattgggtccacatgttttgctgtttattcaattgcagtgactgacgcacaaaataaaacttggtttgtaaaaagaagatacaggaattttgagcgattgcaccggcatcttaaagatattcccaattacacattgcaattgcctcctaaaaggatattttcctcaagcacagatgatgcctttgtacatcaacgctgcattcaacttgataaatatcttcaggatctcctgtcaatagctaatgtagccgaacaacatgaagtatgggatttcttcagtgtttcctcaaagaactactcatttgggaaatctccttcagtgatgaagaccttggcagtcaatgtagatgatgctatggatgatattgtacgccagtttaaaggtgtttcagatggtttaaggcgaaaagttgttggttcatcatccctcatcaatgagggatctgctacatctaataccccatggaatttgtcctggaatgctgatgaaatcgacaaaagcattccaaggcaaagtactgcagaaagtgttagctctgataatgaggaaggtgaaaggaacaattttgaccgtgagaatattgatagagaagcagcacaagatagtggattgcattcttacaatgcattgatctcaaagggttactcatcacgaataagcaattgggatgaagagtccaggaacttggattttgatagaaagcatgatatggtggttgaagctagggctggcaatggtattcctgctacaaatttcattctgattcatgataatttggaggatccagttggagtgccacctgagtggactccacctaatgttagtgtccccattttgaatttggttgacaacatatttcaacttaataaaagaggctggataagaagacaggtctattggatttcaaaacagatattacagttggtgatggaagatgcaatcgatgattggctcctgagacagattcattggctccggagagaggaaactgtttcccaagggattcggtgggtccaagatgtcctatggcctggtggtacattttttttaagagttgggactccccagataattagtgacagtgataaaaaatcttctccaacaatgagcagatctggtggaagcaacatcacgaaatctgagtcagggtcttttgagcaagagctcgaggctgctcgtagagcaagtgacatcaagaaactgctgtttgatggagctccaacaactttagtcagcttaatcggccataagcagtacagacgttgcgcccgggatatatactactttagtcagtctaatgtatgtgtgaagcaacttgcttatgcaattttggaacttgcacttgtctccatcttccccgagattcggaatgttgtgaagagtattcaccaacctgtatagagcttttccatcatgacatatggtatggccagcatatgtgggacatgaaattgggaagaacacgtttgatggctttgctgtccggtaacatgcaagatgattgatttgggaactaggccaattgttttgtaactatgtccatctgtataaaaagatagatttagtgcgtgtacagaaacaattgttttgtgggattcattatgctttgtcaagtcaaggcatacccccttgtcatggggattttgtattgttacagactcgagaagtcaaatgcatctagtgaatgaatattctttatttgttc

SEQ ID NO: 10445 - DNA, 4685 bp, Glycine max
ggtcccgggaagggaatcttcaccatatgccactcacgttatcttttcatcacaccttcaccttcgatccttcctatgtccaattaattgtttaaggagagaccaactcataaagtcacaaagaatattactataaacatttggatttaggtggtggtggtggtggtggtgtatttcaaattccagctgttactattgttgttttatcgaaaacccaaattcccaaaggaatcgaaattgaaatcgaagtgggaacagagcaacacagagcgtgatttgttccaatcggtcggtgggctatggagagtgtgaatgatctgatccaagaggccaagctccgcactctctggtgggccctctgtatattcgtcgtttcctatttcctaactcatactagtaaatcaatgtggatgaatgtacccatgtcgatcctatttgttgtggggctgcgcattcttttcaatagggtggagttccgttggaaggttccacagcctagactgcagacctatctatctcatttggagaaaaagcagttgtctctgaatgatccacgcctcactagtttgcctccccctgcgaaatggaagaggaaaattgattctcctgctgtggaggctgcaatgagtgatttcattgataagattttgaaggattttgtggttgatttgtggtactcagagattactccagataaggagtttccagaacagatacgggcaataatcatggatgttctagctgaaatatcaggaagggttaaagagataaacctggttgacttgctgacaagggatttagtagatttaataggtgttcacatagaacttttcagaagaaatcaagctactattggtgttgatgttatgaaaacattatcttctgaggagcgggatgacagattaaaattccatctgttgaattctaaggagcttcatccagcactaatatctcctgagagtgagtgcaaggttcttcagcggctaatgagtgctgttttagctacagtactaagacaacgagaagctcagtgtcctgtgattcgttctatatctcgggaattattaacttgcttggtaatgcaacctattatgaatttggcaagccctggccttgctttgtacttgttgatagtgccatcaggattctccttcaccctaaacacccattttcagccaataggagccctagatggagggacaggagctacagaaacagtggcaggggaagataaagatacctcagcagtagtgacttcaacattggatgatgcatctgaagaaacagaagatactgttgccggtggagtattaggtaattcagaatttccttgtggcaaaggagaagaattagatgttgataaggttggtgttgtagcttcaggtgaattgacagatgctacagctgtttgtgaagcagtagcagataggcatggcacccgcgcggggcaaggtgtccccgaaccttaccctgttccccgttcccgtccccgctcccgtggtggggaattcaaaacagaatttgaagatgctctgaagacaggttctgaaacatcagatgaattgaataccactgttgattgggattttggtttgagttggagtactgattctggtttggacagttcattggtcgaattgaaagtgtcaatgaagcttattccagacatgctaggaggacttacaactgatgagtctagcgagaacatcaccggaaaatcatggattgaagccatgatagcggaagttgatcttgttgttcccaaagcagaaactcaggagagacattatcagcatcacaatcagctagagaagcatatcacagtggaatttatcaaatgggagatatctttcgctgttgcaataggggaagtgacggcgactggcgtagcagcgtctgcattgaccggaatcgcattcaccagagttgcattatgcaccggaacttcattggtcaccagcggtggcagaggagggtatattaatgaactgattgaatctcttctacttctctttaatgatgatggtacgcaagggatgggcagtgatcagtcaactaatgtagcaagtcaccatcatggtcattctgttgccagtgagggtggacacaacaatctcacagcctctaataagcatccatctttaaatcaaggaactggtatgatattggctaaaacgagtgatcagggagggacattgttacaagatagcattctccatcaagattcttcacaagtcaggcctgctgattgggcacgaatgttggaggttgtaaatcagaggagaactgaaattcttatgcctgagaatcttgagaacatgtggacaaagggaaggaattacaaaaggaaagagaacaaaattatcaaaactggctctcaggatcttcctgcaaagagtccatctacagacagttcactgcctcatagaaaattggctcaggaaacatcagcaagtaaatgtggaaagtatgaagttgcagaggggaagtcttctctgccaccattgcctgtcatgggttcagctcccctgcaaaatgttggagatgcaaaaagtttagaatcttctaaaaaccctgacaaggaattatctattgtgggagatcttgcttctgatggttataaaagcccgctgaagaggtcgagtagtgcttcttccttaggaatcctatctaataaagaagactccataatttcagaatttttcaacccggaatttgagaggcacagtgaaggatttcggggaaagagttcttctgatatgattgttaggaaagaagggccattagttcctaagctccggtgccgggttgtgggagcatattttgagaaaattgggtccacatgttttgctgtttattcaattgcagtgactgatgcacaaaataaaacttggtttgtaaaaagaagatacaggaattttgagcggttgcatcggcatcttaaagatattcccaattacacattgcatttgcctcctaaaaggatattttcctcaagcacagatgatgcctttgtacatcaacgttgcattcaacttgataaatatctccaggatctcctgtcaatagctaatgtagccgaacaacatgaagtatgggatttcttcagtgtttcctcaaagaactactcatttgggaaatctccttcggtgatgaagaccttggcagtcaatgtagatgatgctatggatgatattgtacgccagtttaaaggggtttcagatggtttaaggcgaaaagttgttggttcatcatccctcatcaatgagggatctgctacatctaataccacatggaatttgtcctggaatgcagatgaaattgacaaaagcattccgaggcaaagtactgcagaaagtgtgtttagctctgataatgaggaaggtgaaaagaacaattttgaccgtgacaatattgatagagcagtagcacaagatagtgggttgcattctgacaatgcattgatctcaaagggcaactcatcacgaataaacatttgtgatgaagagtccagcaacttggaatttgatagaaagcatgatatggtggttgaagctagggttggcaatgatattcctgctacaaatttcattctggttcatggtaatttggaggatccagttggagtgccacctgagtgggccccgcctaatgttagtgtccccattttggatttggttgacaacatatttcagcttaataaaagaggctggataagaaggcaggtctattggatttcaaaacagatattacagttggtgatggaagatgcaattgatgattggcttctgagacagattcattggctccggagagaggaaactgtttcccaagggattcggtgggtccaagatgtcctgtggcccggtggtacattttttttaagagtagggactccccagataattagtgacagtgataaaaaaccttctccaacaatgagcagatctggtggaaacaacatcacgaaatctgagtcaggatcttttgagcaagagctcgaggctgctcgtagagcaagtgacatcaagaaactgctatttgatggagctccaacaactctagtcagcttaatcggccataagcagtacagacattgcgcccgggatatatactactttagtcagtctaatatatgtgtgaagcaacttgcttatgcaattttggaacttgcacttgtctccatctttcctgagattcggaatgttgtggagagtattcaccaacctgtatagagttcttctatatgacatgtggtatggccagcatatatgaatgaaattgggaagaacacgttttggtattcaccaacacaagcatcgaccaatggttttgtaactatgtcccaactgtataaaacataggtttagggcgtgtacagaaacaattgttttgtgggattcattatgctttgtcaagtcaaggcataccccattgtctcggggattttgtatattgttacagactcgagaaatgcatctagtgagtattcttttatttgttcatcgttgggatacgactcatacgaggatttttttttatttggttaactttttgcttcctcaatagataccattatgggataaatacttattttaagttagggttggccagggacaacttgcacctgaagtttactgtagtgacactgttcataagcctctcttttttttcgttttcatttc

SEQ ID NO: 10446 - DNA, 3988 bp, Medicago truncatula
agaagaagaagaagaggaccaacaaaacaactcataacccacaatacaaagaatattccattaatattatttttctgctcgataattcaattcaattccaggtattacatactgtttcttccaaaccaaaacacaaacaagacaaaaacaaacaccttggtgcggtaaaaggtttttgatgatttgttacggtgttgttgtttgattcaacgatgaagaagaaacccatggagagtgtgaatgatctgatccaagagtttaagctccgcactctttggtgggctctctctattttcgccgtttcttatttcctcactcatacaagtaaatcgatgtggatgaatgtgccgatgtcaattctatttgtttgtgctctgcgcattattgtaaataatgtggaatttcgttggaaggttaaacaacctagatcacatacatatttatcacatttggagaaaaaacagttgtctttgaatgatccgcgtctctctagtgtacctcccccggtaaagtggaagaggaaaattgattctcctgttgtggaggatgcaatggctgatttcattgataagattttgaaggatttcgtggttgatttgtggtactcggagattactccggatagggagtttcctgatcagatacgcgctataatcatggatgttcttgctgaaatatcagcaagggttaaagagataaatcttgtcgacttgttgacaagggatttagttgatttagtaggcgatcacttggaactttttagaagaaatcaagcggctataggtgtcgacgttatgaaaacattatctacagaggagagggatgacagattgaaattccatttgttgaactctaaggagcttcatccagcactaagatctcccgagagtgagtacaaggttcttcagcggctaatgagtgcacttttagctacagtactaagacaacgtgaagcacagtgtcccgtgattcgctcaatatctcgggaacttttgacttgcttggtgatgcaacctgttatgaatttggcaagccctgggcagaatatgggaagatacaaaagagggctgaatggaaatgatattcatcgttatggcgcagagcgggtttcgggttgtgttggagacaggttatatgggtgggttcctttggtttggtcagaagaaacaatctcaatgccaggtgataatttcaagcaacaacacattcaagccggaacacttcaagtcgtgctacacctagaatcttcctgcagtttcacaccttcagatgtttgcaaaaccatgatctccttctgtttagcaaatagctttgtcggaaaggaagaaaaagaattggaaacaaacaagggagtattgaaaaaggagtttataaacgagctgattgaaacacttctacttctccttaacgacaacgatagtaaaaagtggatgggtggcgatcagtcaactaatgtagcaagtcatcatcatggtaactctgttgctaatagcggcggacatgacaatctcacagcctctagtaagcatccacctttataccaaggaactgagatgacattggctaaaatgagcgaccggggagagacatccttacaaaataattcagtccatcaaaaatcttcacagcccaagcctgctgattgggcacaaatgttggaggttgcaactcagaggagaactgaaattcttatgcccgagaatcttgagaacatgtgggcaaaaggaagaaattacaaaaggaaagagaacaaaattgtcaaaactggatctcaggatcttcacaccaagagttctgctactgaccgttcattgctgaatagaaaaatgaaccaggaaacgttagtgagtaaacatggaaagcatgaagctgctgaagtgaagtcttctctaccttcaacgcatgccttgacttcggatcccctacaaagtgttgcatctacaaatatttcagaatcttcgcaatacccagacaagacgtcatcgttcgagggagagcttagagttgataaaatgaagggcacaaaggatcttgcttctgatgggtataaaagttcgttaaagaggtctagcagtgcttctgccttggcaatccaccttaatcaagaaggtagctccattatttcagagtttttcaacccggaatttgagaggcgcgaaggatttcggggaaagagttcttctgacatgatagttaggaaagaggggcaattagctccaaagctccggtgccgggttgtgggagcatattttgagaaaattgcttccacgtcttttgctgtctactcaattgcagtgactgatgcacagaatagaacttggtttgtaaaaagaaggaattttgagcgattgcatcgacatcttaaagatattccaaattacacattgcatttgcctcctaaaaggatattttcctcgaacactgatgatgcctttgtacatcaacgctgcgttcagcttgataaatatctccaggatctcctgtcaatagctaatgttgctgaacaacatgaagtatgggacttttttagcgtttcctcaaagaactactcttttgggaaatcttcttcggtgatgaagaccttggcagtaaatgtagatgatgctgtggatgatattgtacgccagttcaagggggtttcagatggtttaaggcgaaaagttggtggatcaccatccctcctcaatgagggaccttccacatcattgtacttgccttggaatgcagatgaattggataaaagtaccacacagcaaagtgctacaacaagtgtgttaagttctgatactgaggacggtgataggaacagtaatctaggccatgataattttgatagagaagaagtacaagataatgcattgattttgaaaggttacccatcactggtaacagactatactgacgagtccagcaacttggctattgatagacagcgtgatctgtcggaggaagctaggattagcaatgacgttccaactacaaattccattcttactcgcgataatttggaggatcctgttggagtgccacctgagtggtccccacctaatgttagtgtccctcttttgaatttggttgacaagatatttcagcttaagaaaagaggttggataaggagacaggtgttttggatgtcaaaacagatattacagctggtgatggaagacgctattgatgattggctcctgatgcagattcactggcttcggaaagaggacactgttgcacaagggattcggtggctccaagatgtcctctggcctggtggtatgttctttacaagagtaagattaccccaaataacaaatggtggcagtgatgaaaagccttctcaaacaataagtggatctggggggcgcaacatcacaaaacacgaatctggctcttttgaggaacagcttgaagctgctcgtagagaaagtgacatcaagaaactgctctttgatggtgctccaacaactttagtcagcttgatcgggcataatcagtacagacgctgtgccagagatatatattacttcagtcagtctcctgtatgtatgaagcaacttgcctatgcaattctggaacttctacttgtttccatctttcctgagatgaggaatgttgtgttgagtgttcatgagaatatgaacgttcaccaagcgccgtgagttcttcatcacttgtggtagtggcttgcctatgttgtacatgaaatttggaagacggtgttttggttgtagattgtagatgcaagaacaggagctatgacagatgctttaggaaattggcaattggttttgaatctctttccaactgtataaaacttagatataggttgtgtacagaagaaacaacaatcatgttgtgttactatgttttgtcaaggcatataccccattttcatggggattttgtattgttacagatagggtcgtgaaatgcttctagtgaataggattattctttattcgtttagtcattgggattagagaggctattttgc

SEQ ID NO: 10447 - DNA, 1719 bp, Glycine max
atgaagcttttcatgtttttgctagcatgggctttcgctcttctgggttcttccttggcttcagctgctatagtggaatacactttcaaagttcaaaccacaacagtcaaccgcttgtgcaataagcgagtgattgtgacagttaatggacaattccctggcccaaatataaatgtcagcgaaggtgacactgtggttgtccatctattgaacgagggaccctacaatatcaccattcattggcatggagttcttcagctatttactgcttgggcagatggtcctgaatatgtaactcaatgcccaatcagtccaggaaataattatacctataccttcaatgcgacacgacaagaaggaaccttatggtggcatgctcatgcatctgttttgcgtgccacggttcacggtgccttcatcattcaacctcgttcgggacgatttccgtttcctaaaccctacaagcaagttcctattatattaggtgattggtatgatgctaataatgttgtggatattgagacccaagcacttgccaccggtggttctccaaatatatctagtgccttcacgatcaacggcttgcctggtgatctctttagttgttctcaaaatcagaaattcacaatgagtgtgacacaaggaaagacctacatgctacgaatgatcaatgctgcactcaataaccatcttttcttcaagatagcaaatcacactttcacagttgttgccatggatgctgcatacactgaccactatgtcaccaacatcattgttattgcccctggccaaaccattgatgcactattcacagcagaccaacccttaggttcatactatatggctgcatctccttacatcgttggtgttcctgtctttgacaacacgacaacacgtggcgtcgtcgtttacgacaatgcaccaccatcatcgtcacaacccttgatgccaaccctaccacccttcggcgacacagaaactgctcacaaattctacagcaacataactggcaaggtgggggcaccacactggattcctgtcccaaccacggtggatgaacacatgttcattactattggattgaatctagcattgtgtgaccctaacaatgccaacaatgccacgtgtcagggtccatttggccataggttttcttctagcatgaacaatgagtcctttgtgctcccaattgggagagggttctctatgttggaagcattctttaagaatgtgagcggagtgtacactgctgatttccctgacaaccctccggttacgtttgacttcgcaaatcccagcattagttttgatcctaaccttttgtttgcgccaaaatcaaccaaggtgaagaaactcaagttcaattcaaccgtggaggttgtgtttcagaatacagcgattcttggtgtgcagaaccatcccatgcacgttcatggttttagtttccatgttttggctcaggggtttgggaatttcaattccaccacggattcaaccaagtttaatttggtgaatcctcagctacgcaacacaattgctgtgcctgtgggaggatgggctgtcatcagattccaggcaaacaatccaggggtatggtttgtgcattgccatatagaagatcatgtgccatggggactaaacatggcttttgaggttgagaatggaccaacttcttcaacttcactccctccaccaccttctgatctgcctaaatgttaa

SEQ ID NO: 10448 - DNA, 2016 bp, Glycine max
atccaagtaaacttattcatagcaatagtcttatcctatcatttagtttccccgcctaaacatgaagctattctcgttttctctagcatgtgtttttgtttttgcccttctagcttcttccctggcttcagcagctatcgtggaacacattttcaaagttcaaaacacgactatcaaacgtttttgcaaggagcaagtgattgtgacagttaatggacttttcccagggccaacgataaatgtccacgaaggtggcactgtaattgtccatgtattgaacgagggaccgtatgatatcactcttcattggcatggagtgttacagctctttagtccttgggcagacggtcctgaatatataactcaatgtacaattagacccagaagtaaatacacatataaattcaacgtgacacaacaagaaggaacagtatggtggcatgctcatgcatcatatttacgagcaacagttcatggtgctttcatcattaagcctcgttcaggccgatttccatttcctaaaccgtacaagcaaattcctcttatattaggagatttgtataattctagagttgaggatattactactgaagcacaggccagtggcggaggaccaaacatatcttacgcctttacaatcaatggtttgactagcggccatctcatgaattgtactgaaaatgagacatttaagatgaaagttaagcaagggaagacctacatgctccgaatgatcaacgctgcactcaattacgacctattcttcaagatagcgaaccacaatttcacagttgttgccgtcgatgcctcctacaccgaccactacgtctccgacctcatcgtcattgcccctggccagagtgttgacgtgttattcacagcgaatcaacccactggctcgtactacatggttgcatctccttacgttgttggtctcgaagacttcgacgccaacgtagctcgcggcacggtcatttacgaaaatgccccgccatcgtcaaagcccataatgccagttctaccccccttcaacgacacggacacggcttatactaaattctacaacgtcataactagcaaagtgagggccccacactgggttcctgtgccacgtaaggtggatgagcacatgttcattaccattgggttcaacctagaattgtgtgattccaagaatcccaacaacgccacgtgtaagggtccaaatggtcacagattttctgccagcatgaacaatgagtcattttctgttcccgcgggtgtgaagctttctttgttggaagcattctataaaaacaagagcagtgtttacactagggatttccctgacaagcctccggttctgtttgacttcacgaatctgaacgacgctaacaatacgaaccttctatttgcgccaaaatcaaccagggctaagaagctcaggttcaattcaacggtggaggttgtgtttcagaatacagcacttcttgggggccaaaaccaccccatgcacattcatgggtatagcttccatgttttggctcaagggttcgggaatttcaacaggaaggatagggctaagtttaatttggtgaatccgcaattacgcaacactgttggtgtgcctatgggaggatggactgtcatcaggttccaagcaaacaatccaggggtttggcttgtgcattgccatatggaagaccatgttccgtggggactagccatgatttttgaggttgagaacggaccaactcctttaacttcagtccctccaccaccagctgatcttcctaaatgttaaccaggttgcacagtgcagtactacttatgatcagaaatcaacaccatttgtcgcgtgcattttcttctacgtgtgtcataagtatatctaatggtatctaatgttaccaaaaaaatggcatcatattgccagcaaaaaataatttctattagaaatgtttaggaatttcaaagtgaaatgttttaaccgatcgaccttggaagtcaataatataaattggagtttattgtttt

SEQ ID NO: 10449 - DNA, 1943 bp, Glycine max
  misc_feature (1043)..(1043): n is a, c, g, or t
ctttggtttccccacctaaaacatgaagctattctcgttttctctagcatgtgcttttgcacttctaacttcttccctggcttcagcaactatacaggaacacactttcaaagttcaaaacacgactatcaaacgcttttgcaaggagcaagtgattgtcacagttaatgggactttccctgggccaacgataaatgtccgagaaggtgacacagtaattgtccatgtattgaacgagggaccgtatgatattactcttcattggcatggagtgttgcagctctttagtccttgggcagatggtcctgaatatgtaactcaatgcacaattagaccaagaagtaaatacacttataaattcaacgttacacaacaagaaggaaccgtatggtggcatgctcatgcatcatatttacgagcaacagttcatggtgctttcatcattcagcctcgttcaggccaatttccatttcctaaaccgtacaagcaaattcctcttatattaggagatttgtataactctaatgttgaggatattactaccgaagcacaggccagtggcggtggaccaaacatatcttgtgcctttacaatcaatggttttactagcggccttctcattaataattgtactgaaaatgagacatttaagatgaaagtccagcaagggaaaacctacatgctccgaatgatcaacgctgcactcaattacgacctattcttcaagatagcgaaccacaatttcacagtggttgccgtcgacgcctcctacaccgaccactacgtcaccgacctcatcgtcattgcccccggccagagtgctgacgtgttattcacagcgaaccaacccatcggctcgtactacatggttgcatctccttacgttgttggtctcgatcactttgacgtcaacgtaggtcgcggcacggtcatttacgaaaatgccccgccgtcaccaaagcccgtgatgccaattctaccccccttcaacgacacggacacagcttataacaaattctacaacgtcataactagcaaggtgnggggcccacactgggttcctgtgcctcgtaaggttgatgagcacatgttcattaccattgggttcaacacagaattttgtgattccaagaatcccaacaatgcctcgtgtaagggcccaaatggtcaaagattttctgccagcatgaacaacgagtcatttgctgttcccgcgggtgtgaagttttctttgttggaagcattctatgaaaacatgagtggagtttacactacggatttccctaacaagccaccagttatgttcgacttcacaaatctgaacaacgctaataatatgaaccttctatttgcgcctaaatcaaccaaggcgaagaaactcaggttcaattcgacggtggagattgtgtttcagaatacagcacttcttgggggccagaaccaccccatgcacattcatgggtatagcttccatgttttggctcaagggttcgggaatttccacaagaaggatagggctaagtttaatttggtgaatccgcaatttcgcaacactgttggtgtgcctatgggaggatggactgtgatcagattccaagcaaacaatccaggggtttggcttgtgcattgccatatggaagaccatgtgccatggggactagccatgatttttgaggttgagaatggaccaactccttcaacttcagtccctccaccacctgctgatctacctaaatgttaatcaggttgcagagtacagtactacttatgattagaaatcaacaccatctgtcgcattttcttctgtgtcataagtatatctaatgttaccaaatggcatcatcttgccagcaaaaaataatttctagtagaaatgtttaggaatttccaagtgaaatgaccgatcgaccttggaagtcaataatataaataagagttattgt

SEQ ID NO: 10450 - DNA, 1713 bp, Glycine max; identical to SEQ ID NO: 10408

SEQ ID NO: 10451 - DNA, 1968 bp, Glycine max; identical to SEQ ID NO: 10433

SEQ ID NO: 10452 - DNA, 1917 bp, Glycine max; identical to SEQ ID NO: 10395

SEQ ID NO: 10453 - DNA, 2016 bp, Glycine max; identical to SEQ ID NO: 10448

SEQ ID NO: 10454 - DNA, 1719 bp, Glycine max; identical to SEQ ID NO: 10447

SEQ ID NO: 10455 - DNA, 1996 bp, Glycine max; identical to SEQ ID NO: 10409

SEQ ID NO: 10456 - DNA, 1719 bp, Glycine max; identical to SEQ ID NO: 10410

SEQ ID NO: 10457 - DNA, 2063 bp, Glycine max; identical to SEQ ID NO: 10384

SEQ ID NO: 10458 - DNA, 1875 bp, Glycine max
atgaaacttagatggtcttctttaagccgagatgactttattatttatttggacaagtttgaatatgatataaggcaccaaaatgtgacacgactgtgccacacaaagagcatggtgacagtgaatggtcagtttccaggacctcgcattgtagccagagagggagaccgtcttcttatcaaagtgactaaccatgtttcgaacaatatcaccattcactggcatggaattagacaacttcaatcagggtgggctgatgggccagcatatgtgactcaatgccccattcaaagaggccaaagttatgtctacaattacaccattgttgggcagagaggcactctctggtggcatgctcacatttcatggttaagatcaactttgtatggtcctctcatcattcttcccaagctcaatgctcaatatccttttgccaaaccccacaaggaagttcctatcgtatttggagaatggtggaatgcagatcctgaggcagtcataacccaagcccttcaaaccggtggaggaccaaatgtatccgatgcttacacaattaatggacttccagggccattgtataactgctctgacaaagatacattcaagctgaaggtgaagccagggaagatttaccttctacgtttgatcaatgccgcactgaatgatgagctattcttcagcattgcgaaccacaccctcacagtagttgaagcagatgcagtttacgtaaaaccatttgcaaccaacaccatccttattacccctggccaaaccactaatgttcttctcaaaaccaaatctcattaccccaacgccacattcctcatgactgctagaccatatgctagtggccttggcacttttgacaacacaactgtggctggcatactgcaatataaaaccccaccaaatactcatcattcagctgcttcactgaaaaatcttccactcctcaaacctattctccctgcactcaatgacacttcttttgccacaaaattcaacaacaaactccgcagcttagcaagtgctcagtttccagccaatgtaccccagaaagttgatacgcactttttcttcacagtgggccttggcacaactccctgcccacaaaaccaaacttgtcaaggacccaccaatgcaacaaaatttgcagcatcagtgaacaatgtctcttttatacaaccaaccactgcacttcttcaaacccacttctttggacaatccaatggagtttacacagctgacttcccagccaaaccattgattccattcaactatactggcactccaccaaacaacaccatggtgagcaatgggacaaaggttgtggttcttcccttcaacacaagtgtagagctagtgatgcaggacaccagcattcttggtgctgaaagtcaccctctccatttgcatggctttaacttctttgctgttggtcaaggttttggtaactttgatccaaataaggaccctgcaaacttcaatcttcttgacccaattgagagaaacacagtgggagtcccatctggtggatgggttgctatcagattcctagcagataatccaggggtatggttcatgcattgtcacttggaagtgcacacaagctggggtcttaagatggcatgggttgtgttggatggaaaactcccaaatcagaagctgtttccaccgccagctgatcttcccaagtgttaacaaagcctcgaattccttcagtttgtttcaacaatgagcaattgcttctaaccagttgcttcaatttttttattttttatttccgttttcgggtgaaaaaggagttgaggcttgaattgagattgaggttggactttttcctttctttggctgagaattttatttatagaaggc

SEQ ID NO: 10459 - DNA, 2127 bp, Glycine max; identical to SEQ ID NO: 10374

SEQ ID NO: 10460 - DNA, 2732 bp, Vitis vinifera
gaggccttgagctgctgcattgccaattctaggtctttcctcttgggccttttgcttctccttgcttctgcagtgttctttacagaagccgaaacccaccatcatgattttgttgtatgtcttctcttcttccttccttccttttacttgcttctttcctctcttggccttggattctgactatctgcattgatgtaacaggttcaagccaccccggtgaagaggctgtgcaaaacccacaacaccataacagtgaacgggcaatacccggggccaacgttggaaataaacaatggagacaccctagaagtcaaagtcaccaacaaagctcgatacaatgttaccattcactggtaattccatgcatgcatacatgtttcctctgtacaaaaatgaattgaattgaaggtatctggatagggcatgaatgcatgcaggcatgcaggcatgctcctacaaaagaaccaaccaaagtatatatttcatccaatgaacatactaatgtatatagaaagactcttcctaccttctatacttatcttactattatttctctccaggcacggtatacggcagatgagaacaggatgggcagatgggccagagtttgtaactcagtgcccaattcgaccaggaggaagttacacctaccggtttacagttcaaggacaggaaggcactctatggtggcatgctcatagctcatggctcagagccactgtctatggtgccctcatcatccacccaaaaccaggatcctcctatccattcactaagccaaagcgagaaacacccattcttcttggtaatgatcacttctctaatcactaacaacagatgatgataatgatgtggataataggataacaatttggatgcctatgactgagaatgatagattaacggtgagcataatgatgttcaggagaatggtgggatgcaaaccccatcgatgttgtgaggcaggcgactaggacaggagcagctccaaatgtgtctgatgcatacaccatcaatggtcaacctggtgatctttacaactgctccagcaaaggtttgcttcttttcacaaatactttgctctgctgacgagttcatgcaatatgcctagattttccctagtgggccatttcctccacacaaagacatatgatgtccgtggatgctcctagaaattataggaaaaaaaattaatccagtttttggaagacatccaaacttgtcctctcggggcaaaagagggccaccaatttaccggggcattctctgtcctttagaaaaagatgacacacctaaagaaatcagagcaattccttcaaatttttgaagcaaatccttactcttccaactcgaatccataaccagcttgacactggggactgggagagtggatttgaccatatttacccggaggttcatacattggacagaaccaaacacccaggaagcaaccaatttctactgtcctataacagctaaaacttaaatcttcatcatggatgcttagatcatgcctacaaaaaatcttctgaccttgttttattggtatgcagacactgtgatagttccaattgacagtggtgagaccaacctcctccgagtcatcaactctgggcttaaccaagagctcttcttcactgttgccaaccacaagtttacagttgtctcagctgatgcatcctataccaaacccttcaccacctcagtcatcatgctaggacctggtcaaaccactgacgtcctaatcaccggtgatcagccaccagctcgttattacatggccgcacgtgcctatcaaagtgctcaaggtgcaccatttgacaatactaccaccacagccatacttgaatacaagtctgctccttgtcctgctaagaagggtgtctccaccacccctgttttcccttctttgcctgctttcaatgacacggccactgtcacagccttcagtaagagcttcagaagtcctgctaaagtcgaagtccccacagacattgatgaaagcctcttcttcactgttggcctagggctcaataggtgcccaccaaagtttaaatccagccagtgtcaaggtcccaatggaacccgcttcaccgccagcatgaacaatgtctcttttgttctcccatccaacttttccttactgcaagctcaccagcaaggtatccctggagttttcaccactgattatcccgcagctccaccagtaaaattcgattacactggtaatgtgagccggtcactctggcaacccgttccaggtactaagttgtacaagttgaagtatgggtcaagagtccaggttgtattacagggaacaagtatcttcacagctgagaaccaccccatccatcttcatggatacgatttctacatcattgcagaaggtttcggaaacttcaaccccagtactgatacatccaagtttaatcttgttgatccacctcttaggaatacagtggccgtacctgtgaatggttgggcagtcatcagatttgttgccgataatccaggtaaaattacttgaatttcccaaaaattctacttccaatatatttcaaatttttgccctcaactttcaattcatttgtctggcaaaaacaggagtttggctaatgcactgccacttggatgttcatatcacctggggtctggccatggctttcctggtggagaatggagttggggctttgcaatcgatagagactcctccagcggatttgcctctgtgc

SEQ ID NO: 10461 - DNA, 2127 bp, Glycine max; identical to SEQ ID NO: 10423

SEQ ID NO: 10462 - DNA, 1848 bp, Glycine max; identical to SEQ ID NO: 10422

SEQ ID NO: 10463 - DNA, 1418 bp, Glycine max
acattttttttttctgatgattcgacgtgtcctaactctgaaactctactattctttctcctccgcagaaccttaacaaccaaaaccaagcattacagttcccaatttcacagaaacaccagaattgatcaaaacacataacaaaaaaaaagtgaaaatggcgagcgctgtagagaaagagggtggcgcgagagaggaaactttctctttggagcttcctgctccacctggttggaagaagcagttcatcccaaagaaagctggcacccccaagaaaaatgagattgtgttcactgcagcaacaggagaggagatccataacaggaagcagctggaaaaatatttgaaagcacaccctggtggtccagctgtatcagaatttgactggggcactggtgagaccccaagaagatctacaagaattagtgagaaggcaaaggcagctcctccatctgtaagtgagcccccaaagaagcgtactaaaagatcatcagcctcacaaaaggaaacttcccaggaagaaaaagaacaggagataaaggaagcggaaatgcaagaagctgatgacaccactaaggatgataatgatatagggaaggaaaaggatgttgtaaaggaaaatcaagatgacaagtgtgtggaagatacagatgtcaacaaatccactaattctggagaagaagctaaagctgtagaaaatgttgaggtacctattgacgagaagtccaatgctgctgatggagaactacctgcattgaaagataaagttgatgacaaaggaactgagggctctgaagtttttctgagaaaggatgaagtaaagattgagcaaccacaggaagagacaaaagaatatcgtggatctggggagccagagaaatcggaaacatgcactactgcagacaaaacggttgaagtggaaggagtggataaagaggaacacgtcaaaagtactcatgaatttgaagttggggaaatggaaggaacaaaagtgattggtgaagaacatcacaagcttgatgagataaacaagaaggctgaaacagagttgactgtgaatggaaatcatgggagctgaactggtgaggtcaaaagcctggagcagggaatagattaataagttctcggcatctctcctctcattctgacccctttagatctgtgtttgaagatgactttagtttttcttactgttatttatctgattgtttcttgaaacaatatacaattgtagaacatagccctataaggtaccattcatgggtgtattggacatacgtgtagcttctagttgctattgtaacattatgttgtaagatatgtaatatggacatgtaatcatatgtaaggcagtgatgccaagtaatttggtcctggccgtaaaacggtgcatatgaaagtctcatcttcttcatgca

SEQ ID NO: 10464 - DNA, 1401 bp, Glycine max
gacctgaactgcttcttcaaatttttttctggtgattctacaacctgtcctaactctcaaccctcttcctcttaattaatctattcctctttatcctcctctgaacctcaaacaccaaaacaaagcattacaattctcaatttcacataaacaccagaattgataaaaacacataacaaaaaaaaaaagtgaaaaatggcgagcgcagtggagaaggagggtggcgcgagcgaggaaactttgtctttggagcttcctgctccacctggttggaagaagcagttcattccaaagaaagctggtaccccaaagaaaaacgagattgtgttcactgcaccaacaggagaggagatcaataacaggaagcagctggaaaaatatttgaaagcacaccctggaggcccagctgtatcagaatttgactggggcactggtgagaccccaagaagatctacaagaatcagtgagaaggccaaggcagctcctccaacacagagggagcccccaaagaagcgtactaaaagatcatcagcttcacaaaaggaaatttcccaggaagaaaaagaagaggagaccaaggaagcagagatgcaagaagctgatgacaccactaagggtgataatgatatagagaaggaaaaggttgttgtaaacgaaaatcatgacaagagtgtggaagatacagatgtcaacaaatccactcgttatggagaagaagctaaagctggagaaaacgttgaggtacctattgaagaggaaaaatccaatgctgctgatggagaactacctgcattaaaagataaagctgatgacaaagtaactgagggctctgaagtttttctgagaaaggatgaagaaaagattgagcaaccacaggaagagacaaaagaatatagtggatttggggagccagagaaattggaaacatgcactactgcagacaaaacggttgaagtggaaggagtgaataaagaggatcacgtcaaaagtactcatgaatttgaagttggggaaatagaaggaacaaaagtgaacggtgaagaacatcacaagcttgatgagataaacaaggccgaagcagagttgactgtgaatggcactcacgagagctgaactggtgaggtcaaaagcctggagcagggaatagattaataagctctccgcttccctcctctcattctgacccctttagatctgtttgaaatgactgtagtttttgttaatgttatttctctgattgtttattgaaataacaatatacaattatagagcatagccgtatcatgtaccacccttgggtgtattggacagacgtgtagcttctagttgcttttgtaacattatgttgtaagatgtgatatggacctgtaatcatatatgtaaggaagtgatcctatatat

SEQ ID NO: 10465 - DNA, 1413 bp, Glycine max
gacctgaactgcttctttacatttatttttcttctggtgattccacaatgtgtcctaactctcaatcctcttcctcttaattatactctattcatctttttcctcataacctcaaacacaaaacccaagcattgcaattcccaatctcacagaaacaccagaattaataaaacacataacaaaaaaaaaaagtgaaaaatggcgagctcagtggagaaggagggtggtgcgagcgaggaaactttctctttggagcttcctgctccacctggttggaagaagaagttcatcccaaagaaagctggtaccccaaagaaaaacgagattgtgttcacttcaccaacaggagaggaaatcaatagcaggaagcagctggaaaaatatttgaaagcacaccctggtggtccagctgtatcagaatttgactggggcactggtgagaccccaagaagatctacaagaatcagcgagaaggccaaggtagctcctccagcagagagcgagcccccaaagaagcgtactaaaagatcgtcagcttcacaaaaggaaacttccctggaagaaaaagaagaggagacaaaggaagcggaaatgcaagaagctgatgacaccactaaggatgataatgttatagagaaggaaaaggattttgtaaaggaaaatcaagatgacaagagtgtggaaaatacagatgtaaacaaatccgctcattctggagaagctaaaccggtagaaaatgttgaggtgcttattgaagaggaaaaatccaatgctgctgatggagaactacctgcattgaaagataaagttgatgacaaaagaactgagggctctgaagattttctgagaaaggatgaagaaaagattgagcacccacaggaagagacaaaagaatatcgtggatttggggagcaagagaaattggaaacatgccttactgcagacaaaagggttgaagtggaaggagtgaataaagaggaacacgtcaaaagtacttgtgaatttgacgtggaggaaatagaaggaacaaaagtcaatagtgaagaacatcacaagcttgatgagataaacaagaaggctgaagcagagttgactgtgaatggtaatcatgggagctgaactggtgaggtcaaaagcctggagcagggaatagatgaataagctctcagcatctctgctctcattctgaccccttaaagatctgtttgaaaatgactgtagtttttgttaatgttatttatctgattgtttattaaaataacaatatacaattatagagcatagccctatcatgtaccatccttgggtgtattggacagacgtgtagcttctagttgctattgtaacattatgttgtaagacatgtgatatagacctgtaatcatatatataaggaagtgatcctatattatc

SEQ ID NO: 10466 - DNA, 1293 bp, Glycine max
gaagtccccttactcttggttattctactcttctttctcctcctcagaacctcaaacaccaaaaccaagcattacaattcccaatttcacagaaacaccagaattaataaaacacataacaacaaaagaagtgaaaaatggcgagctcagtggagaaggagggtggcgcgagcgaggaaactttctctgtggagcttcctgctccacctggttggaagaagctgttcatcccaaagaaagctggtaccccaaagaaaaacgagattgtgttcactgcaccaacaggagaggagatcaataacaggaagcagctggaaaaatatttgaaagcacaccctggtggtccagctgtatcagaatttgactggggcactggtgagaccccaagaagatctacaagaatcagtgagaaggcaaaagcagctcctccaatagaaagcgagcccccaaagaaacgtactaaaagatcatcagcttcacaaaaggaaacttcccaggaagaaaaagaagagaagacaaaggaagcggaaatgcaagaagctgattacaccactaaggatgataatgatatagagaaggaaaaggatgttgtaatggaaaatcaagatgtcaagagtgtggaagatacagatgtcaacaaatccactcattctggagaagctaaagctggagaaaatgttgaggtacctattgaaaaggacaaaggaattgaggtctctgaagtttttctgagaaaggatgaagaaaagattgagcaaccacaggaagagacaaaagaatatcgtggatctggggagccagagaaattggaaacatgcactattgctgacaaaaaggttgaagtggaaggagtgaataaagaggaaaacatcaaaagtactcgtgaatttgaagctgaggaaatagaaggaacaaaagtgaatagtgaagaatatcacaagcttgatgagataaacaaggctgaagcagagttgaccatgaatggcaatcatgggagctgaactggcgaggtcaaaaagcctggagcagggaatagattaataagttctcggcatctctcctctcattctgacccctttggatctgtgtttgaagatgactttagtttttgttaatgttatttatctgattgtttattgaaacaatatacaattttagagcatagacctataaggtaccatccatgggtgtattggacatacgtgtagcttctagttgctattgtaacattctgttgtaagatatgtaatatggaccagtaatggatcaatttcgtaaaagagcttactcgtt

SEQ ID NO: 10467 - DNA, 1351 bp, Glycine max
acatttttttctggtggttccgcaacgtgtcccaactctgaagcccgcttcctcttaattactctattattctttctcctcctcagaacctcaaacaccgaaaccaagcattacaattcccaatttcatagaaacaccagaatcaataaaaacacataacaacaaaagcagtgaaaaatggcgagctcggtggagaaggagagtggcgcgagcgaggaaactttctctttggagctgcctgctccaccaggttggaagaagcagttcatcccaaagaaagctggtaccccaaagaaaaatgagattgtgttcactgcaccaacaggagaggagatcaataacaggaaacagctggaaaaatatttgaaagcacaccctggtggtccagctgtatcagaatttgactggggcactggtgagaccccaagaagatctacaagaatcagtgagaaggcaaaggcaactcctccaacagaaagcgagcccccaaagaaacgtactaaaagatcgtcagcttcacaaaaggaaacttcccaggaagaaaaagaagaggagacaaaggaagcagaaatgcaagaagttgatgacaccactaaggatgataatgatatagagaaggaaaaggatgttgtaatggaaaatcaagatggcaagagtgtggaagatacagatgtcaacaaatccactcattctggagaagctaaagctggagaatatgttgaggtacctattgaagaggaaaaatccaatgctgctgatggagaactacctgcattgaaagataaagttgatgacaaagtttttctgagaaaggatgaagaaaagattgagcaaccacaggaagagacaaaagaatatcgcagaactggggtgccagagaaatcagaaacatgcactaccgcagacaaaacggttgaagtggaaggagtgaataaagaagtcagaagtactcgtcaatttgaagttgggataatagaaggaacaaaagtgaacagtgatcagataaacaagaaggctgaggcagagttgactgtgaatggcaatcttgggagctgaactggtgaggtcaaatgcctggagcagggaatagattaataagctctcagcatctctcttctcattctggcccctttaaatctgtttgaaaatgactagtttttgttaatgttatttatctgattgtttattaaaacaacaatatacaattatagagcatagccctatcgtgtaccatccgtgggtgtattggacagacgtgtagcttgttgatatcgtaatattatgttgtaagatatgtgatatggacctgtaatcatatccagtgatcctatatattcctgtttagtcctaa

SEQ ID NO: 10468 - DNA, 1367 bp, Glycine max
tttttttctggtggttccgcaacgtgtcccaactctgaagcccgcttcctcttaattactctattattctttctcctcctcagaacctcaaacaccgaaaccaagcactacaattcccaatttcatagaaacaccagaatcaataaaaacacataacaacaaaagcagtgaagaatggcgagctcggtggagaaggagagtggcgcgagcgaggaaactttctctttggagctgcctgctccaccaggttggaagaagcagttcatcccaaagaaagctggtaccccaaagaaaaatgagattgtgttcactgcaccaacaggagaggagatcaataacaggaaacagctggaaaaatatttgaaagcacaccctggtggtccagctgtatcagaatttgactggggcactggtgagaccccaagaagatctacaagaatcagtgagaaggcaaaggcaactcctccaacagaaagcgagcctccaaaggaacgtactaaaagatcgtcagcttcacaaaaggaaacttcccaggaagaaaaagaagaggagacaaaggaagcagaaatgcaagaagttgatgacaccactaaggataataatgatatagagaaggaaaaggatgttgtaatggaaaatcaagatggcaagagtgtggaagatacagatgtcaacaaatccactcattctggagaagctaaagctggagaatatgttgaggtacctattgaagaggaaaaatccaatgctgctgatggagaactacctgcattgaaagataaagttgatgacaaagtttttctgagaaaggatgaagaaaagattgagcaaccacaggaagagacaaaagaatatcgcagaactggggtgccagagaaatcagaaacatgcactaccgcagacaaaacggttgaagtggaaggagtgaataaagaagtcagaagtactcgtcaatttgaagttgggataatagaaggaacaaaagtgaacagtgatcagataaacaagaaggctgaggcagagttgactgtgaatggcaatcttgggagctgaactggtgaggtcaaatgcctggagcagggaatagattaataagctctcagcatctctcttctcattctggcccctttaaatctgtttgaaaatgactagtttttgttaatgttatttatctgattgtttattaaaacaacaatatacaattatagagcatagccctatcgtgtaccatccgtgggtgtattggacagacgtgtagcttgttgatatcgtaatattatgttgtaagatatgtgatatggacctgtaatcatatccagtgatcctatatattcctgtttagtcctaaaaaaaaaaaaaaaaaaaaa

SEQ ID NO: 10469 - DNA, 1505 bp, Glycine max
aatggcataatctctaaagtccgaatcatctcattctcatcaagttattatcaaataattaattaaattcctcgtggaatcttgttgaagccatgtctacagctggtcaggtcatcaagtgcagagctgcggtggcatgggaagcagggaagccactatcgatagaaaccatagaagtggcaccaccccagaaaggtgaagtgcgtttgaagatcctcttcaactccctttgccgtacagatgtttactggtgggatgctaagggccagactccgctgtttcctcgtatcttaggccacgaagcttcggggattgtggagagcgtgggcaagggtgtgacacatctgaaaccaggtgaccatgctctcccaatattcactggggagtgtggtgaatgcacctattgcaagtctgaagagagcaacctgtgtgagcttctcaggatcaacactgacagaggagtgatgctcagtgatggcaaaacaaggttctccaaaaatggacaacctatttaccacttcgttggaacctccactttcagtgaatacactgttctccatgaaggatgtgtcgccaagatcaaccctgctgcccctcttgacaaagttgctgttgtcagttgtggattctgcacaggttttggggctactgtgaatgttgcaaagccaaagcctaataatactgttgctgtatttggattaggagctgttggtcttgctgcctgtgaaggggcaagggtttctggtgcatctagaatcatcggggttgatttacttaccaatcgatttgaacaagccaaacaatttggggtcactgattttgtgaacccgaaagatcacaacaaaccagttcaagaggtcattgctgaaatgactaatggaggagtagatcgtgctattgaatgcacaggaagcatccaagcatcaatctcggcatttgaatgcactcatgatggttggggtactgctgtccttgttagtgtgccaaagaaggatgcagaattcaaaactcatcctatgaagttcatggaagggagaactcttaagggtaccttctatggtcactatagaccccgcactgacattcctggtgttgtggagaagtacctcaacaaggagctggagctggacaaatttatcactcactctgtcccattctcagagatcaacactgcatttgatcttatgctgaaaggggagggaataaggtgcctcatctgcatggaagagtaaatcaatgatgttctctgctgaacagtgtttgcgtgtaatgtgaaaagagaattgaataaatttggcatgtaattcggttattggattcatgctacatgagtgtgtaaagaggtaatgggggtgatgactttcttggtcattgtcgtggctttgtgatttctattgcaaatgttgtcttgtaactttgttgtattttcagcaatatatgatatatgatatctatcttaatttctatcttaaaaatagagtggcatctctcacccttctatgtta

SEQ ID NO: 10470 - DNA, 1497 bp, Glycine max
ggatctcattctcatcaagttattatcaaataattaattaaattcctcgtggaatcttgttgaagccatgtctacagctggtcaggtcatcaagtgcagagctgcggtggcatgggaagcagggaagccactatcgatagaaaccatagaagtggcaccaccccagaagggtgaagtgcgtttgaagatcctcttcaactccctttgccgtacagatgtttactggtgggatgctaagggccagactccgctgtttcctcgtatcttaggccacgaagcttcggggattgtggagagcgtgggcaagggtgcgacacatctgaaaccaggtgaccatgctctcccaatattcactggggagtgtggtgaatgcacctattgcaagtctgaagagagcaacctgtgtgagcttctcaggatcaacactgacagaggagtgatgctcagtgatggcaaaacaaggttctccaaaaatggacaacctatttaccacttcgttggaacctccactttcagtgaatacactgttctccatgaaggatgtgtcgccaagatcaaccctgctgcccctcttgacaaagttgctgttgtcagttgtggattctgcacaggttttggggctactgtgaatgttgcaaagccaaagcctaataatactgttgctgtatttggattaggagctgttggtcttgctgcctgtgaaggggcaagggtttctggtgcatctagaatcatcggggttgatttacttaccaatcgatttgaacaagccaaacaatttggggtcactgattttgtgaacccgaaagatcacaacaaaccagttcaagaggtcattgctgaaatgactaatggaggagtagatcgtgctattgaatgcacaggaagcatccaagcatcaatctcggcatttgaatgcactcatgatggttggggtactgctgtccttgttagtgtgccaaagaaggatgcagaattcaaaactcatcctatgaagttcatggaagggagaactcttaagggtaccttctatggtcactatagaccccgcactgacattcctggtgttgtggagaagtacctcaacaaggagctggagctggacaaatttatcactcaccctgtcccattctcagagatcaacactgcatttgatcttatgctgaaaggggagggaataaggtgcctcatctgcatggaagagtaaatcaatgatgttctctgctgaacagtgtttgcgtgtaatgtgaaaagagaattgaataaatttggcatgtaattcggttattggattcatgctacatgagtgtgtaaagaggtaatgggggtgatgactttcttggtcatcgtcgtggctttgtgatttctattgcaaatgttgtcttgtaactttgttgtattttcagcaatatatgatatatgatatctatcttaatttctatcttaaaaatagagtggcatctctcacccttctatgttaaaaaaaaaaaaaaaaaa

SEQ ID NO: 10471 - DNA, 1408 bp, Glycine max
atgcgtgcagctgcggtggcatgggaagcagggaagccactgtcaatagaaaccatagaagtggcaccaccccagaaaggtgaagtgcgtttgaggatcctcttcaactccctttgccgtagtgatgtttattggtgggatgctaaggaccagactcctctgtttcctcgtatcttaggccacgaagcttcagggattgtggagagcgtgggcgagggtgtgacacatctgaaaccaggtgaccatgcactcccaatattcactggggagtgtggtgaatgcacttattgtaagtctgaagagagcaacctgtgtgagctactcaggatcaacactgacaggggtgttatgctgagtgatggaaaaacaaggttctccaaaaatggccaacccatttaccacttcgttggaacctccactttcagtgaatacactgttctccatgaaggatgtgtagccaagattaaccctaatgccccacttgacaaagttgctattgtcagctgtggattctgcacaggttttggggctactgtgaatgttgcaaaaccaaagcctaataatactgttgctgtctttggcttaggagctgttggtcttgctgcctgtgaaggggcaagggtttctggtgcatctagaatcatcggggttgatttacttcccaatcgatttgaacaagccaaaaaatttggggtcactgattttgtaaacccgaaagatcacaacaaaccagtccaagaggtcattgctgaaatgactaatggaggagtagatcgtgctattgaatgcactggaagcatccaagcttcaatctcagcatttgaatgcactcatgatggttggggtactgctgtccttgttggtgtgccaaagaaggatgttgaattcaaaactaatcctatgaagttcatggaagggagaactcttaagggtaccttctatggtcactacagaccccgcactgacattcctggtgttgtggagaagtacctcaacaaggagttggaactagacaaatttatcactcactctgtgccattctcaaagatcaacactgcatttgatcttatgctgaaaggggagggcataaggtgcctcatctgcatggaagagtaaatcaatgatgaatgatgttccctgctgtgagaacaatgtttctgtgttatgtgaaaagagaattgaataaatttggcatgcaattcggttgttggattcatgctatatgagtgtgtaaagaggtaacggggggtgatgactttcttggtcattgtcgtggctttgtgacttctattgcaaatgttgtcttgtaactttgttgtattttcggcaatatatctatatgatatctatctttctatcttttttttgtgactctatctttatatcttaaaaatagaatggcatctct

SEQ ID NO: 10472 - DNA, 1377 bp, Glycine max
tgcggtggcatgggaagcagggaagccactgtcaatagaaaccatagaagtggcaccaccccagaaaggtgaagtgcgtttgaggatcctcttcaactccctttgccgtagtgatgtttattggtgggatgctaaggaccagactcctctgtttcctcgtatcttaggccacgaagcttcagggattgtggagagcgtgggcgagggtgtgacacatctgaaaccaggtgaccatgcactcccaatattcactggggagtgtggtgaatgcacttattgtaagtctgaagagagcaacctgtgtgagctactcaggatcaacactgacaggggtgttatgctgagtgatggaaaaacaaggttctccaaaaatggccaacccatttaccacttcgttggaacctccactttcagtgaatacactgttctccatgaaggatgtgtagccaagattaaccctaatgccccacttgacaaagttgctattgtcagctgtggattctgcacaggttttggggctactgtgaatgttgcaaaaccaaagcctaataatactgttgctgtctttggcttaggagctgttggtcttgctgcctgtgaaggggcaagggtttctggtgcatctagaatcatcggggttgatttacttcccaatcgatttgaacaagccaaaaaatttggggtcactgattttgtaaacccgaaagatcacaacaaaccagtccaagaggtcattgctgaaatgactaatggaggagtagatcgtgctattgaatgcactggaagcatccaagcttcaatctcagcatttgaatgcactcatgatggttggggtactgctgtccttgttggtgtgccaaagaaggatgttgaattcaaaactaatcctatgaagttcatggaagggagaactcttaagggtaccttctatggtcactacagaccccgcactgacattcctggtgttgtggagaagtacctcaacaaggagttggaactagacaaatttatcactcactctgtgccattctcaaagatcaacactgcatttgatcttatgctgaaaggggagggcataaggtgcctcatctgcatggaagagtaaatcaatgatgaatgatgttccctgctgtgagaacaatgtttctgtgttatgtgaaaagagaattgaataaatttggcatgcaattcggttgttggattcatgctatatgagtgtgtaaagaggtaacggggggtgatgactttcttggtcattgtcgtggctttgtgacttctattgcaaatgttgtcttgtaactttgttgtattttcggcaatatatctatatgatatctatctttctatctcccaaaaaaaaaaaaaaaaaaaaaaaaa

SEQ ID NO: 10473 - DNA, 1549 bp, Glycine max
gtggcgcagtcgtgagtaacgtgcaataccacgggtaacgcggttttctggctcacctttccgcattttccttcttccctctcgcacccataagtacccctccctaaatcaacgctttcctcacaaaaaacaaaaactcacttctcatcattcattcatcttcgttctaagagccatgtctagcaccgttggccagaccatcaagtgcaaagctgcgattgcatgggaggctgggaagccgctggtgattgaagaagtggaggttgcgccaccgcaagccggtgaagtccgtttgaagatcctctacacctctctttgccacactgatgtttacttctgggatgcgaagggccagactccattgtttcctcgcatttttggccatgaagcttcggggattgtggagagcgtaggcgagggtgtgactcatctgaaaccaggtgaccatgccctccctgtgttcacaggagagtgtggagattgcgcccattgcaagtcagaggagagcaacatgtgtgagctactcaggatcaacaccgataggggtgtcatgatccatgatggccaatcaaggttctctaagaatggacaacccatacaccatttcttgggaacctctacattcagtgaatacactgttgtccatgctggatgtgttgcaaagatcaaccctgctgctccacttgacaaagtttgtgttctcagttgtggaatttgcacaggttttggtgctactgtaaatgtagcaaaaccaaaacctggttcctctgttgccatatttggacttggagctgttggccttgcggctgctgaaggtgcaagagtttcaggtgcttcaagaatcattggagttgatttagtttctgcccgatttgaagaagctaagaagtttggggttaatgagtttgtgaacccaaaggatcatgataaacctgtgcaacaggtaattgctgaaatgaccaatggaggtgtggatcgggctgttgaatgtactggcagcatccaagccatggtctcagcattcgaatgcgtccacgatggttggggtcttgctgtacttgttggtgtgcctagtaaagatgatgcattcaaaactgctcctattaatttcctgaacgagaggactcttaagggcaccttttatggcaactacaaaccacgcaccgatcttccatctgttgtcgagaagtacatgagtggggagctagaagtggacaaattcatcactcacacagttccattctcagagatcaacaaagcttttgatttaatgctgaagggacagtccattaggtgtatcatccgcatgcaagagtgagatggatatgaaaagtccatgactgtgttctgggacagactactcttatgtgatttatgaataaaaagagagaagagagaataaaaaatttattggtaaaatccccaattaggctattaggattatgattgtattgttgcacattgagtgttgggaatgacagggcatttagccctttgttacttgattgcggcttgtttcttgtcaatttgtcatttgatagtttccatg

SEQ ID NO: 10474 - DNA, 1429 bp, Lotus corniculatus; identical to SEQ ID NO: 9509

SEQ ID NO: 10475 - DNA, 1399 bp, Phaseolus acutifolius; identical to SEQ ID NO: 9507

SEQ ID NO: 10476 - DNA, 1454 bp, Lotus japonicus; identical to SEQ ID NO: 9510

SEQ ID NO: 10477 - DNA, 1143 bp, Lotus japonicus
atgtcgaccacagctggtcaagtcatcaaatgcagagccgcggtttcatgggaggcagggaagccactagtgattgaagaagtggaggtggcgccgccgcaggccggtgaagtgcgtctgaagatactctacacctccctttgccacactgatgtttacttctgggaagctaagggtcagactccattgtttcctcgtatatttggtcatgaagctggaggcattgtggagagcgtaggcgaaggtgtgactcatctgaaaccaggggaccatgctctcccagtattcacaggagaatgtggtgaatgcccacattgcaaatcagaggagagcaacatgtgtgatcttcttaggatcaacactgataggggtgtcatgatcagtgacaaccagagtagattctccataaaaggaaaacccatataccattttgttggtacctcaacattcagtgaatacacagttctccatgctggatgtgttgcaaagatcaaccctgctgccccacttgacaaagtttgtattctcagttgtggaatatgcacaggttttggtgctactgtcaatgttgcaaaaccaaaacctggttcttctgttgccatctttggacttggagctgttggccttgctgctgcggaaggggcaaggatttctggtgcatcaagaatcattggggttgatttagtttccagccgatttgaaggagccaagaagtttggagtcaatgagttcgtgaacccaaaagatcacgacaaacctgtacaagaggtaattgctgaaatgaccaatggaggtgtggatcgtgctgttgaatgcactggcagcatccaggccatgatctctgcatttgaatgtgtccatgatggttggggtgttgctgtacttgttggagtgccaaacaaagatgatgcattcaaaactcatcctgtgaatttcttgaatgagaggactcttaagggcaccttctatggcaactacaaaccccgcactgatcttcctaatgttgtagagatgtacatgagaggggaacttgaactggagaaattcatcacccacacagtttcgttctctgagattaacaaagcttttgattacatgctgaaaggggagtccatcagatgcatcatccgcatggaggagtaa

SEQ ID NO: 10478 - DNA, 1456 bp, Glycine max
ccaacatttgtcacagattagtagtatatgctttcaacaatggaagattagaaagcgccagtgtgcgcacgttagcacccaaccccatggattcctctcccccaattcgtaagggaaggaaactataacggaggagggggcaataaacaataagaaaatgttgcggataacgagattctcggggtttttctccgccgcaatgttcgtgactgttcttgttattctctccccctccttccaatccgaagccattcgatcctcccaccgattttccttccggaaagcccctcctttccgcaatgccgccgaatgcgcttctgtttccggccaaaccaccaccgtctgcgacccttccttggtccacgtggccataaccctcgacgtcgactacctccgcggctcaatcgccgccgtgcactccatcctccacaactccctctgtccggagaacatcttcttccatttcctcgtctccgacaccaacctccaaaccctagttgagtccacgttcccaaacctgaaattcaacgtctatttcttcgatccgaacatcgtcgctcacttgatctcctcctccgtgcggcaggcgctggagcagcctctcaattacgcgagaaattacctcgttgaccttctggagagttgcgtggagagggtgatttacttggactccgatctggtggtagtggatgacgtggcgaaactgtggagcgcgagtctggactcgcgtgccatcggcgcgccggagtactgccacgcgaacttcaccaagtatttcacggcggggttctggtctgagtcgaggttgtcggggacgttcgcgcagcggagggcgtgctacttcaacacgggggtgatggtgatggatctggtgaagtggaggaaggaaggatacacgaagagaattgagcgttggatggagattcagaagagtgataggatctatgagcttggttctctgccgccgtttttgctggtgttcgcgggacacgtggcacctattgagcaccggtggaaccagcacggtttgggcggggataacgtgaagggtagttgccgtgacttgcaccctggtccggttagtttgttgcattggtccggtagcggtaagccatggctccgtttaagctccaaacggccttgccctctggattctctatgggctccttttgacttgtatacacacccatcgtcttaactaattcttgctgcatgctacatacatacattcattagtcattcctgatttgaaaataaattgttgaattttattaagttaagtttgtttattataataaatactaattgttagaagaaaaaataaatatttaaagaacactagctggttatatatgttgaagccgtcgtaattagattcaggtgtctagtttgtaaaagttattgttagtactgttctggctgatgttcgagtgagtagttagttgattttgattct

SEQ ID NO: 10479 - DNA, 1351 bp, Glycine max
atgtttcggataacgagattctcggggtttttctccgccgcaatgtttgtgattgttcttgttattctctccccctccttccaatccgaagccattcgatcctcccaccgattttccttccggaaagcccctccgttccgcaatgccgccgaatgcggttcaatttccggtgaaaccaccaccgtctgcgacccttccttggtccacgtcgccataaccctcgacgtcgactacctccgcggctcaatcgccgccgtgcactccatcctccacaactccctctgtccggagaacatcttcttccatttcctcgtctccgacaccaacctccaaaccctagttgaatccacgttccctaacttgaagttcaacgtctattacttcgatccgaacatcgtcgctcacttgatctcctcctccgtgcggcaggcgttggagcagcctctcaattacgcgagaaattacctcgttgaccttctggagagttgcgtggagagggtgatctacttggactccgatctggtggtagtggatgacgtggcgaaactgtggagcgcgagtctggactcacgcgccatcggcgcgccggagtactgccacgcgaacttcacgaagtatttcacggcggggttctggtcggagccgaggttgtcggggacgttcgcgcagcggagggcgtgctacttcaacacgggggtgatggtgatggatctggtgaagtggaggaaggaagggtacaccaagagaatcgagaggtggatggagattcagaagagtgataggatctacgagcttggttctctgccgccgtttttgctggtgtttgcgggacacgtggcgcccattgagcaccggtggaaccagcatggtttgggcggggataacgtgaagggtagttgccgtgacttgcaccctggtccggttagtttgttgcattggtctggtagtgggaagccatggatccgtttaagttccaaacgcccctgtcctctggattctctatgggctccctttgatttgtatgcacactcttcctcttaaactaattcttccctctcatttaattcaatttctctttgcttgtcatttttcgctagttagatgttattcatctatttcttctccctaaactttttctccggaaaatttgtatgtcatttctattctattattttcctgtcattcctgatttgaaaataaaagaaaaagaaaagaaagcggattttctaatttcttgttgtatataaaatggtgtagtatccaactatccatttgttgtgttatttgtaatttattagtaatcggtggcatttaggtccgaagcatgaactgggctagtatccaataataa

SEQ ID NO: 10480 - DNA, 1765 bp, Glycine max
tataatgaaatgtgttctgggggccgtgaaaacatttatatggtggaaatcgcgaagctaagctggaaagaaagaaaaaagcccacctgtgtgtccgtgcaactgcaacgtgcttaccccttttgttccgaattccaatattagagagaaagaaaacattggttaaagagaagcggtgcaagaggagaggaagaagagaagaggaggcggtgcgcaccttagcatggattcctctccgtcctcttctctctcctctctcgcttcgtccccacggcaccaacatcctctctccatttgagaaaggcaccgattcccattctcattctcactctgcctcacatattgccaacccttgcttctctctcttccatcctcaccaccgatttcactttcaacaataagaacaataaggccagggtctgcttttgattccgccacgtcaaaatgttgtggctcatgagattctcgggcttcttctccgccgcaatgctcgtcattctcctctccccttcccttcaatccttccaccccgccgaagccatccgctcctcccaccacctcgacggcctcctccgcctccctccgcctcgcctttccttccgccccgcccctcgtttccgcaatgccgccgacgccaacaaatgcgcctcctcctccgtctccacctccgtctgcgacccctccctcgtccacgtcgccatcaccctcgacgtcgagtacctccgcggctccatcgccgccgtccactccatcctccaacactcccagtgcccggagaacatcttcttccacttcctcgtctccgaaaccaacctcgaatccctcgtcaaatccaccttccctcaattgaacttcaaggtctattactttgatcccgagatcgtccgcaacctgatctccacctctgtcagacaagccctcgaacaacccctcaactacgccagaaattatctcgctgacctcctcgaaccctgtgtcgaaagagttatatacctagattccgatctggttgtagtcgacgacattgccaagctctggagcaccagcttaggttctagaaccatcggcgcccctgaatactgccacgccaacttcaccaagtacttcaccgcagcgttctggtcggacacgcgcttcgcgagggcgttcgccgggcggaggccatgctacttcaacacgggcgtgatggtgatagatctggtgcggtggcggagaatcgggtacagcaagaggatagagaggtggatggagattcagaagaacgatcggatctacgagctgggttctctgcccccgtttctgttggtgttcgcgggacacgtggcgccaattgagcacaggtggaaccagcatgggttgggtggcgataacgtgaaggggagttgccgggacctgcacgctgggcctgtgagtcttttgcattggtccggtagtggcaagccctggactcgattggactccaaacagccctgtccgcttgatgcactttgggctccttatgatttgtacggtcacgctcactgatttgggttgctggtcgccggtaaattccccccttcactgtttttgtcacttctgttcatttaatttaattctcatttcggtcaattttattattattttgttctctcttctccttctctctactatgaacagatacatcagatatttactttacccatttttattagacttcgttacccagtccatcatttgtattctatgatctttctgttttgtgcttcgtgctctagaaataaataag

SEQ ID NO: 10481 - DNA, 1810 bp, Glycine max
gctatgctatgctaagctaagctggaaagaaaaaaggccctctgagtgagtgagagtgtgtggttaaagaggagaggaagaagagaagaggaggcggtgcgcaccttagcatggattcctctccgtcatcttctctctcctctctcgcttcgtccccacggcaccatcgtcctctctccaattgagaaaggcaccgattcccattctcattctcactctggctgacataaaggcaacccttgcctctctctcttccatcgatttcaatttctacggcaacaggaaaagcaagaagaagaaggccaggctctgctttggtttccgccgcgtcaaaatgctgtggctgatgagattctcgggcttcttctccgccgcaatgctcgtcattctcctctccccctccctccaatccttccaccccgccgaagccatccgctcctcccaccatctcgacggcctcctccgcctccctccgccgcgcctctccttccgccccgccgctccattccgcaatgccgccgacggtaaatgcgcctcctccgttcccacctccgtctgcgacccctccctcgtccacgtggccatcaccctcgacgtggagtacctccgcggctccatcgccgccgtccactccatcctccaacactcccagtgcccggagaacatcttcttccacttcctcgtctccgaaaccaacctcgaatccctcgtcaaatccaccttcccgcaattgaacttcaaggtctattacttcgatccagagatcgtccgcaacctgatctccacctccgtcagacaagccctcgaacaacccctcaactacgccagaaattacctcgctgacctcctcgaaccctgcgtcgagagggttatatacctcgactccgatctggttctcgtcgacgacattgccaagctctggagcaccagtctaggttctagaaccattggcgcccccgagtactgccacgccaacttcaccaagtacttcaccgcagggttctggtcggacatgcgcttcgccagcgcgttcgcggggcggaggccgtgctatttcaacacgggcgtgatggtcatagatctggtgcggtggcggaaaatcgggtacagcaagaggatagagaggtggatggagattcagaagaacgatcggatctacgagctgggttctttgccgccgtttctgttggtgttcgcgggacgcgtggcgccaattgagcacaggtggaaccagcatgggttgggtggcgataacgtgaaggggagttgccgggacctgcacgctgggcctgtgagcctgttgcattggtccggtagtggcaagccctggacaagattggactccaagcacccctgtcctcttgatgcactttgggctccttatgatttgtacggacacgctcactgattagcctttgccttctccctgctcgccggtaaattcccttctctgtcacttctgttcatttaatttaattctcattccgcccaatttttattttttcttattattttcttccctcttctcttctctttactatcaacagacagatcagatattttacttcacccatttttattagtcttcgttacccaggccatttgtattctacagtatcttctattttgtgcttcgtgctctggaaataaataagataataaaataaaggaatgggtggatcttctattttcttcttgtacgtatttcaagtatgaactaagcttatgcttaactttctgtatggtgtaaagtatatggacattaggatataataattgtgctttattaagaaatgcgttaatttaaatg

SEQ ID NO: 10482 - DNA, 1957 bp, Arabidopsis thaliana
gacaaaatgaatagagataatatataaacacaagcattaggctgtcgagaaaacataaattttctatgattaggccatacaaatcataataagtagtagaaatacaaaaaaatctgtttgttggctaaagagaaatcgaaggaattagtcttttcacccatttttctctctctgtgtggcttcttcttcttcttcttcttcctatcaaaatcatcatcatcatcttctctatattactaaaatagagagagccaacaaaagagaggagagggcgtaaaacagcagacggtggcgcaccgtagcaccgccccctcctaacctgcgcctttcttccttctctttcattttttttttttccggtttcaggaattattcctctcctcctctctcaggtcgcttcgatcccaaggcaaaatagtttcctgatttttgattcttaccttcgattttggcttcttcttcttcttcttcagatgcattcacctagaaaactctggcggacatcaaaggaaccctagcttttctccggtcttgttatatcgcctctatcgccgccgatcggtggtttgatttcaaatccaagagaaagaaacgcagaggttcatttctcaggatgctttggatcatgagattctccggtttattctccgccgctttggttatcatcgtcctctctccttctctccaatcgtttcctccagctgaagctatcagatcctctcatctcgacgcttacctccgtttcccctcctccgatccaccgccgcatagattctccttcagaaaagctcctgttttccgcaatgccgccgattgcgccgccgcagatatcgattccggcgtctgtaacccttccttggtccacgtcgcgattactctcgatttcgagtacctgcgtggctcaatcgccgccgttcattcgattctcaagcactcgtcgtgtcccgagagcgtcttcttccatttcctcgtctccgagactgacctagaatccttgattcgttcgacttttcccgaattgaaattaaaggtttactacttcgatccggagattgtacggacgctgatctcaacctccgtgagacaagcgctcgagcagccgttgaattacgctagaaattacctagctgaccttctcgagccttgcgtgcgtcgcgtgatctacctagattccgatctaatcgtcgtcgacgacatcgcaaagctctggatgacgaaactgggatcgaaaacgatcggagctcccgagtactgtcacgcgaacttcacaaagtatttcacaccggcgttctggtccgacgagaggttctccggagctttctccgggaggaaaccgtgctacttcaacacgggagtgatggtgatggatctagagagatggaggcgcgtagggtacacggaggtgatagagaaatggatggagattcagaagagtgataggatttacgagctgggatcattgccgccgttcttgttggtgttcgccggagaagtagctccgatagagcatcggtggaaccagcatgggcttggtggagataacgtgagaggaagctgtagagatttacatcccggtccggttagcttgcttcattggtccggtagtggtaaaccgtggtttcggttagattcgagacggccttgtccacttgatactctttgggcaccttatgatttgtatggacactactctcgctgatgatgattgatgatctctgttattacatattattatagtctcagtctcagctggtaaattctctcatctcctttgacaaaaaaaaaaacattctttcttctctcttttgattttaccaacttttggttggaatttgtttcgttactctgtattctattcgattgttctgtgcatcaaaccataggatacaatcagatttgttgttgtacaaacttttttaccatatgtttctttaatataattctgtcatctttttta

SEQ ID NO: 10483 - DNA, 1067 bp, Arabidopsis thaliana
gattctccggtttattctccgccgctttggttatcatcgtcctctctccttctctccaatcgtttcctccagctgaagctatcagatcctctcatctcgacgcttacctccgtttcccctcctccgatccaccgccgcatagattctccttcagaaaagctcctgttttccgcaatgccgccgattgcgccgccgcagatatcgattccggcgtctgtaacccttccttggtccacgtcgcgattactctcgatttcgagtacctgcgtggctcaatcgccgccgttcattcgattctcaagcactcgtcgtgtcccgagagcgtcttcttccatttcctcgtctccgagactgacctagaatccttgattcgttcgacttttcccgaattgaaattaaaggtttactacttcgatccggagattgtacggacgctgatctcaacctccgtgagacaagcgctcgagcagccgttgaattacgctagaaattacctagctgaccttctcgagccttgcgtgcgtcgcgtgatctacctagattccgatctaatcgtcgtcgacgacatcgcaaagctctggatgacgaaactgggatcgaaaacgatcggagctcccgagtactgtcacgcgaacttcacaaagtatttcacaccggcgttctggtccgacgagaggttctccggagctttctccgggaggaaaccgtgctacttcaacacgggagtgatggtgatggatctagagagatggaggcgcgtagggtacacggaggtgatagagaaatggatggagattcagaagagtgataggatttacgagctgggatcattgccgccgttcttgttggtgttcgccggagaagtagctccgatagagcatcggtggaaccagcatgggcttggtggagataacgtgagaggaagctgtagagatttacatcccggtccggttagcttgcttcattggtccggtagtggtaaaccgtggtttcggttagattcgagacggccttgtccacttgatactctttgggcaccttatgatttgtatggacactactctcgc

SEQ ID NO: 10484 - DNA, 2581 bp, Glycine max
atggttctaataccttccgtgtgtcaaagtgattcaactacagctgtttacattgttactctgagacaagctcctgcttctcactatcatcatcatgagttaatcacagtgggcaacaactctaaacatggttcatctgggagaagaagaactagagttcacaaacaaagacatcagaatgtttcaaagccagttatgaaacgtggttcgtactttgcccgagttcacgactcattgttgaataaagtgtttaatggggagaaatatctgaagctctatagctatcattacttgattaatggatttgctgtgctggttacccaacaacaggcagaaaaactttcaaggagaagagaagtgtccaatgtggctttggatttttctgtgagaactgcaaccacacacactccacaatttttgggtctgccacagggagcttggttgcaagcaggtgggtttgaaactgctggagaaggaatcgctattgggtttgttgacactggcattgatcctacacaccctagttttgcagatgataaatctgaacatccattccccgttcctgctcatttctctggcgcctgtgaggttacgccagattttccgtccggttcttgcaataggaagcttgttggggctagacattttgccgcttctgctataaccagaggaatatttaactcatcccaggactatgcttctccctttgatggcgatggccacggcacgcacacagcttctgttgcagccggaaaccatggaattccagtgattgttgctggccaagtttttggaaatgctagtgggatggctcctcattcacacattgccatttacaaggcactatacaagagatttggaggatttgcagcagatgttgttgcagctattgaccaggcagctcaggatggggttgacataatatgcttgtcaatcactcctaataggcgtccttctggcatcgcaactttcttcaatccaatagatatggcattgctatcagctgtgaaagctggtatttttgtagtgcaagctgctggcaatactggaccatcacctatgagcatgtcctccttcagtccatggatttttactgttggtgccacctctcatgatcgagtttatagcaactccctatgtcttggaaataatgtgaccatacctggtgttggacttgcacctggaacatatgagaacacgatgtttaaactgattcatgcaagacatgctttgaacaaaaacacaacagttactgatgatatgtatattggtgagtgtcaagatgcaagtaagttcagtcaggatttggtccagggcaacctcctgatctgtagctattcagtccgatttgtgcttgggctctccaccattcaacaggcattagaaacagccatgaaccttagtgcagttggtgttgttttctccatggacctttttgtgactgcttttcagcttaacccagttcctatgaaaatgcctggcataataattccatctgcaaatgattccaagatattactgcaatactacaattcttcactgcaaatagatggggattcaaataaaattgttaaatttggggctgttgctagcattggtggtggattagaagccaactacaataatgaggccccaaaggttgtgtattactctgccagaggaccagatccagaggacagtcttcctcatgaagctgacattatgaaacccaatttggtagctcctggaaattttatatgggctgcttggagttctgttgccactgattctgttgaatttctaggcgagaattttgcaatgatgtctggcacaagcatggctgcacctcatgttgctggtcttgctgcactaattaagcaacagtttcccaattttagtcctgcagccattggatctgcactatccactacagcttctctgtatgacaacaatgggaggccaataatggctcagcgatcatatccctccatagaccaaaacctatctccagcaactccctttgacatgggaagtggttttgtgaatgctactgcagcattaaatccgggattgctttttgattctagctatgatgactacatgtcattcctatgtggtatcaatggttcaactcctacagtgctaaactacaccggtcaaaattgctggacttataattcaacactatatggccctgatctgaacttgccctcaatcacaatagcaaggttgaaccaatctagagtggtacaaagaataatccaaaacattgctggaaatgaaacatacaatgttggttggagtgctccatatggcacttctatgaaagtatctcctaattatttctctcttgcaagtggggagagacttgtcttgtctgtgatcttcaatgtaaccaacaacagttctgctgctagctatgggagaattgggctgtatggtaatcaaggtcacgttgtcaacattcctgtggcagtcatttttaaaatcttataaccagctaattaacatgattagtgtctttaatttcttcttcagtaattcattttttattttgctttgttttcttaatctaatctttgtttaaaaaatgtattaagct

SEQ ID NO: 10485 - DNA, 2475 bp, Glycine max
atggttctaataccttcctcgtgtcaaagtgatgcaactacaactgtgtacattgttactctgagacaagctcctgcttctcactatcatcaacatgagttgatcacagtgggcaacaactctagacatggttcatctgggagaagaagaactagagttcacaaaccaagacatcagaatgttacaaagccagataggaaacgtggttcatacttttcccgagttcacgactcgttgttgaataaagtgtttaatggggagaaatatctgaagctctatagctaccattatttgattaatggatttgctgtgctggttacccaacaacaggcagaaaaactgtcaaggagaagagaagtgtccaatgtggttttggatttttctgtgaggactgcaaccacacacactccacaatttttgggtctgccacagggagcttggtcgcaagcaggtgggtttgaaactgctggagaaggaatcaccattgggtttgttgacactggcattgatcctacacatcctagttttgctgacgataaatctgaacatccattccccgttcctgctcatttctctggcatctgcgaggttactccggattttccgtcccgttcttgcaataggaagcttgttggggctagacattttgctgcttctgctataaccagaggaatatttaactcatctcaggactatgcttctccctttgatggcgatggccacggcacgcatacagcttctgttgcagctggaaaccatggaattccagtggtcgttgctgggcaattttttggaaatgctagtgggatggctcctcattcacacattgccatttacaaggcactatacaagagatttggaggatttgcagcggatgttgttgcagctattgaccaggcagctcaggatagggttgacataatatgcttgtcaatcactcctaataggcgtccttctggtattgcaactttcttcaatccaatagatatggcattgctatcagctgcgaaagctggtatttttgtagtgcaagctgctggcaatactggaccatcacctatgagcatgtcctccttcagtccatggatctttactgttggtgccacctctcatgatcgagtttatatcaactccctatgtcttggaaataatgtgactatacctggtgttggacttgcacctggcacatacgagaacacattgtttaaattgattcatgcaagacatgctttgaacaaaaacacaacagttactgatgatatgtatattggtgagtgtcaagattcaagtaagttcagtcaggatttggtccagggcaacctcctgatctgtagctattcagtccaatttgtgcttgggctctccaccattcagcaggccttagaaacagccatgaatcttagtgcagttggtgttgttttctccatggatccttttgtgacttcttttcagcttaacccagttccaatgaaaatgcctggcataataattccatctgcaaatgattccaagatattactgcaatactacaattcttcactgcaaatagatggggattcaaataaaattgttaaatttggggctgttgctagtattggtggtggattagaagcgaactgcaataatgaggccccaatggttgtgtattactctgccagaggaccagatccagaggacagtcttcctcatgaagctgacattatgaaacccaatttggtagctcctggaaattttatatgggctgcttggagttctgttgccactgattctgttgaatttctaggtgagaattttgcaatgatgtctggcacaagcatggctgcacctcatgttgctggtcttgctgcactagttaagcaaaagtttcccaactttagtcctgcagccattggatctgcactttccactacagcttctctgtatgacaacaataggaggccgataatggctcagcgatcctatccctccatagaccttaacctatctccagcaactccctttgacatgggaagtggttttgtgaatgcaactgcagcattaaatccaggattgctttttgattctggttatgatgattacatgtcattcctatgtggtatcaacggttcaactcctacagtgctaaactacactggtcaaaattgctggacttataattcaacactatatggccctgatctgaacttgccctcaatcacaatagcaaggttgaaccaatctagagtagtacaaagaacaatccaaaacattgctggaaatgaaacttacaatgttggttggagtgctccatatggaacttctatgaaagtgtttcctaatcacttctctcttgccagtggggagagactagtcttgtctgtgatcttcaatgcaaccagcaacagttctgctgccagctatgggagaattgggctgtatggtaatcaaggtcatgttgtcaacattcctgtggcagtcatttttaaaatcttataa

SEQ ID NO: 10486 - DNA, 2708 bp, Medicago truncatula
caccactttgcacttccacttcaggctagtggtccagaagagactgcaaaaccaaaactcattggttttttcaaagatcaagtctttacacttgaggatagactaactatgcatgctactgaagatttgttgttgttgtaagtttcttgatcatgtttggtggagctttgcattccaaaactcaaatggagaagaacacatattgtgtacatttagtggtactgttgtgtttcttcgggatgcttctaataccttcttcttgtcaagttgatgcaactactgctgtgtacattgttactctcaaacaagcccttacttctcattatcagggtgagttgagtagagtttataaccacttccgacgcggttcttctgggagaactagacttgacaaaccaagacatcgaaatgttacaaagacagataagagacatggttttaacattgcacaagttcatgattcgttgttgaggaaggtgtttaaaggggataagtatctgaaactctatagctatcattacttgatcaatggatttgccgtggttgttaatcaacagcaggcagagaagctatcaaggagaagagaagtgtccaatgtggttttggatttttctgtaagatctgcaacaacacacactccacagttcttaggtctgccacagggagcttggtttcaatcaggtgggtttgaaactgctggagaaggaatcactattgcatttgttgacactggcattgatcatacacaccctagttttgctgatgataaatccgaacatccattcaatgctcctgctcggttttctggcacctgtgaggttactccggattttccatccggttcctgcaataggaagcttgttggagcccgtcattttgcagcatctgctataaccagaggaatgtttgactcaactgaggatagtgcttctccctttgatggtgatggacatggcacgaacatagcttctattgcagctggaaaccatggaattccagtggttgttgccgggcatcattttggaaatgctagtgggatggctcctcgttcgcacattgctgtttataaggccttatacaaggattttggaggatttgcggctgatgttgttgcagccattgaccaggcagctcaagatagagttgatataatatgcttgtcaatcactccaaataggcgtcctcctgatattgcaactttcttcaatccaatagacatggcattgttgtcagctacaaaagctggtatttttgtagtgcaagctgctggaaatactggaccttctcctatgagcatgtcctccttcagtccatggatctttacaattggtgccacctctcacgatcgagtttatagcaactcactatttcttggaaataatgtgactatacttggagttgggcttgcacctggtacacctgagaacacaatgtacaaattgattcatgcacatcatgctttgaatgatgatactacaattgctgacgatatgtatgttggtgagtgtcaagatgcaagtaaattcaataaagatttggtccagggaaaccttttaatgtgcagctattcaatgagatttgtgcttggtctctccagtatcaaccaggccttagaaacagccaagaatctgagtgctgctggtgttgtttttcccatgaatccttctgtgaatggttttcagcttaacccagttccaatgaaaattcccagcataataattccatttgcaaatgattccaagatattactagaatactacaattcttcactagaaaaagacggtacttcagaaaaaattgttaaacttggggctgttgccagcattaatggtggacttacagcgagctatagtaatgttgccccaagtgttatgtattactctgccagaggcccagatccagaggacagtcttcctcatgaagctgacattttgaaacccaatctggtcgctcctggaagtttaatatgggctgcttggagttcggttgccactgattcagatgaatttctaggtgaaaattttgcaatgatgtctgggacaagcatggctgcacctcatgttgctggtcttgctgcactaatcaagcaaaagtttcccaatttcagtcctgctgccattggatctgcgctttccaccacagcgtctctgtatgacaacagtgggaagccaataatggctcagcggtcatatccctcaccagagctaaaccaatctccagcaactccctttgacatggggagtggttttgtgaatgcaacttcagcattaaatccagggttgctttttgattcaagttatgatgattacatgtctttcttatgtggtatcaatggttcagcttctacagttctagactacacgggtcagaattgtttgaattttaactctattggatatggctctgatctaaacttgccctcaatcacaatagcaaggttgaaccaatctagagtagttcagagaacattacaaaacattgctgaaaatgaaacttatagtgttggttggagttctccatacggggtttcagtaaaagtatctccaacccgcttctctcttgccaatggagagagacaagtcttatctgtgatcttcaatgcaaccagcaacagctcaactgccagctttggaaggattggattgtttggtaatcaaggtcatgtagtcaacattcctgtgtctgttatcgttaaaatctcacagtga

SEQ ID NO: 10487 - DNA, 3059 bp, Glycine max
aggtgcttgctttgtcattgtctctcacttggggtgttctgttttccttcactgaactgaaaaaaaaacactgaagggaaaaaaggcttgaacttgagaatggagcatgtgggtcggtgaggaattgttgttgttattgttcacttttggtggggtggtttcggatccaactgggtcttctgcttttgtgcttttgtttccctagaaaatccttatggggaacatttatgtggcacatttggtggtggtggtggtggtgttttgctttttgccatgcttgtgtcaaggtgattcagatgatgctactacctctgatgtgtatgttgttactctgagacatgctcctgtttctcattactatggtgggttgagaagagaggttaatggcttcaaagatgctgctgctgcacctggcagaactcaatttaacaaaccaagaaggtatggcaatattactaagacagataagagatatggctcttacatttctcgggttcatgattctttgttgaagaaagtgttaaatggagagaaatatctgaagctctatagctaccattacctgataaatggattcgcggtgctggttacccaacaacaggcagagaaactatcaaggagtagtgaagtgtccaatgtggttttggatttttctgtaaggactgcgactacgcatacaccacagtttttgggtctgccacagggagcatggtttcaagatggtgggtttgagactgctggagaaggagttgttatagggttcgttgacaccggcatagatccaacacatcctagttttgatgataacaaatatgaaaagccgtatcccgttcctgctcatttttctggcatctgtgaggttactcgcgactttccatctggttcttgcaataggaagcttgttggggcccgtcattttgcagcttctgccataaccagaggaatatttaattcgactcaggactatgcttctccctttgatggtgatggccatggaacgcacacagcatctgttgcagcaggaaaccatgggattccagtgattgttgctggacatcactttgggaatgctagcgggatggctcctcgttcacacattgctgtttacaaggcactatacaaaagctttggaggatttgctgcagatgttgttgcagctattgaccaggcagctcaggatggggttgacataataagcttgtctattactcccaatagacgtcctcctggtgttgcaaccttcttcaacccaatagacatggctttgctgtcagctgtgaagcaaggtatttttgtagttcaagcagcaggaaatactggaccatcaccaacaagcatgttctccttcagtccatggatctatactgttggtgctgcctctcatgaccgggtttatagcaactccatatttcttggaaataatgtgaccatacctggagttggtcttgcacctggcacagatgaaagcaaactttataaactgattcatgcacatcatgctttgagcaatgacaccacagttgctgatgatatctattcaattcgatttgtgctgggactctccaccatcaaacgggcctcagaaacagccaaaaacctgagtgcagctggtgttgtgttctatatggatccctttgtgattggttttcagcttaaccctgttccaatgaaaatgcctggcataataattgcttccacaaatgattccaaggttttaacgcaatactacaattcttcgttggaaatagatgcagtttcaaagaaaattgttaaatttggggctgttgccactatctgcggtggactgaaaccaaactacagcaatgttgccccaaaggttatgtattactctgccagaggaccagatccagaggacagtcttcctcacgaagctgacattttgaaacctaacctgttagctccgggaaattttatatgggctgcttggagttctgttggcactgattcagttgaattcctaggtgagaattttgcattgatgtctggcacaagcatggctgcaccacatgttgctggtcttgctgcactaattaggcaaaagttccccaatttcagtcctgcagctattggatctgctctttctactacagcctctctgtatgacaagagtggtgggccaataatggctcagcgatcatatgcctctccagatcaaaaccagcctccggcaactccttttgacatgggaagtggttttgtgaatgcaagtggagcactgaatccgggtttggtttttgattctggttatgatgattacatgtcatttctatgtggaatcaacggttcagctcccgtggtgctaaactacacgggccaaaattgcgcgctctataacttgactgtctatggtcctgatctgaacctgccctcaatcactatatcaaagctgaaccaatccagaatagtgcagaggacagtccaaaacattgctcaaaatgaatcttacagtgttggttggactgctcctaatggggtttcagtgaaagtgtctccaactcacttctgtattggcagtggtgagaggcaggtcttgtctgtgctcttgaatgcaacccttagcagctctgtggccagctttgggagaattgggctgtttgggaatcaaggtcatgtggtcaacattccactttcagtcatggttaaaatctcatctaacactactactagctaactggggatgtcacgtattcttgttaaaagtaaattcattttgggacaaaatttggatgaagttttttaggtgcttttagtgtttttgaatcagagttagagtttcatctcgataatttgcctaataaagtatttgcattaaatgttaatatagattattgaggtgaaattctaatttggattggagaacaatactaaaatcatctaatgaattgcattttagttttgttcttcattttgttttgtatgtgattttttctttctttcttgggtccgaagatgcattagctattttttcattcattataatgtaaagaagctaaaggttcttgtaaagatatagatgtgaccagtccttgattagtgtt

SEQ ID NO: 10488 - DNA, 2644 bp, Glycine max
atgtgggttggtgaggaattgttgtcgtcgttgttgttgttgttcacttttgctggtgtggttttcgatccaactgggtcttcagcttttgtgcttttgtttccctataaaatccttatgggtaacattaatgtggcacatttggtggtggtggtgctgttttgctttgggctgtttttgccatgcttgtgtcaaggtaactcagatgatgctaccactgatgtgtatgttgttactctgagacatgcacctgtttctcattactatggtgagttgagaagagaggttaatggcttcaaagatgctgctgctcctgggagaactcaatttaacaaaccaagaaggtatgacaatattactaagacagataagagatatgactcttatatttcccgagttcacgattctctgttgaagaaagtgttaaatggagagaaatatctgaaactatatagctaccattacctgataaatggattcgctgtgctggttacccaacagcaggcagagaaactatcaaggagcagcgaagtgtccaatgtggttttggatttttctgtaaggactgcgactacgcatactccacagtttttgggtctgccagagggagcatggtttcaagatggtgggtttgagactgctggagaaggagttgttatagggttcgttgacactggcatagatccaacacatcctagttttgatgataacaaatatgaaaaaccgtatcccgttcctgctcatttttctggcatctgcgaggttactcgtgactttccatctggttcttgcaataggaaacttgttggggcccgtcattttgcagcttctgccataaccagaggaatatttaattcaactcaggactatgcttctccctttgatggcgatggccatggcacgcatacagcatctgttgcagcaggaaaccatgggattccagtgattgttgctggacatcactttgggaatgctagtgggatggctcctcgttcacacattgctgtttacaaggcattatacaagagctttggtggatttgctgcagatgttgttgcagctattgaccaggcagctcaggatggggttgacataataagcttgtcaattactcctaatagacgtcctcctggtgttgcaactttcttcaacccaatagacatggctttgatgtcagctgtgaagcaaggtatttttgtagtacaagcagcaggaaatactggaccatcaccaacaagcatgttctccttcagtccatggatctatactgttggtgctgcctctcatgatcgggtttatagcaacgccatatttcttggaaataatgtgaccatacctggagttggtcttgcatctggcacagatgaaagcaaactttataaactgattcatgcacatcattctttgagcaatgacacaacagttgctgatgatatctattcaattcgatttgtgctgggactctccaccatcaaacaggcctcagaaactgccaaaaaccttagtgcagctggtgttgtcttctatatggatccctttgtgattggttttcagcttaaccccgttccaatgaaaatgcctggcataataattgcttccacaaatgattccaaggttttaatgcaatactacaattcttcattggaaatagatgctgtttcaaataaaattgtgaaatttggggctgttgccagtatctgtggtggactaaaagcaaactacagtaatgttgccccaaaggttatgtattactctgccagaggaccagatccagaggacagtcttcctcatgaagctgacattttgaaacctaacttgttagctcctggaaattttatatgggctgcttggagttctgttggcactgaatcagttgaattcctaggtgaaaattttgcattgatgtctggcacaagcatggctgcaccacatgttgctggtcttgctgcactaattaggcaaaagttccccaatttcagtcctgcagccattggatctgctctttctagtacagcttctctgtatgacaagagtggtggaccaataatggctcagcgatcatatgcctctccagatctaaatcagtctccggcaactccttttgacatgggaagtggttttgtgaatgcaagtggagcactgaacccgggtttagtttttgattctggttatgatgattacatgtcatttctatgtggtattaatggctcagctcctgtggtgctaaactacaccggtcaaaattgcgggctttataattcgactgtctatggtcctgatctgaacttgccctccatcactatatcaaagctgaaccaatctagaatagtgcagaggacagtccaaaacgttgctcaaaatgaatcttacagtgttggttggactgctccttatggggtttcagtgaaagtttctccaactcacttctgtattcccagtggtgagagccaggtcttgtctgtgctcttgaatgcaacccttaacagctctgtggccagctttgggagaattgggctgtttgggaatcaaggtcatgtggtcaacattccactttcagtcatggttaaaatctcatataacactactactagctagctaactgggatgtatcccacttatttttgttgaggtaaattcattttgg

SEQ ID NO: 10489 - DNA, 2687 bp, Vitis vinifera
atggagagcgtttattgggtgcatttaatggtggtgctttgcttggggacgtttatgggtatagtttgtcaggatggtgcagatgaggttacagctgtttatattgttactctgaagcaaactcctacttctcattactatggtgagctgagaaaggggaccaatgttttcaggcatggtgttcctgggaagttggatagacttcacacaccaaggaggaatatttcaagatctgatcctcattataattcgtatatttcccgagttcatgattcattgctgaggagggcattgagaggagaacaatatctgaagctgtatagctaccactacttgattaatggatttgcggtgtttgttacttcccagcaggcagagaagcttgcaaagaggagagaagtggcaaatgtggttttggatttctcggttagaaccgcaaccacccacactcctcaattcctgggtctacctcaaggggcatgggtccaagaaggtggatatgattctgctggggagggaattgtgattggatttattgatacaggcattgatcctacacatcccagctttgctgttgatagatctgaagttgcctatccagttccagctcatttttctggcatctgtgaagtgacccctgatttcccatctgggtcctgcaacagaaagcttgttggggcccgccattttgcagcatctgcaataaccagaggaatatttaatgcaagtcaggactatgcttcaccatttgacggtgatggccatggaacgcacacggcatccattgcagcagggaaccatgggattccagtggtggtggccgggcatcactttggaaatgcgagtggaatggctcctcgtgcacacattgctgtttacaaggcactctacaaaagtttcggaggctttgctgcagatgttgttgctgcgatagaccaggcagctcaggatggagttgacatagtaagcttgtcaatcactcccaacaggcgtccccctggaattgcaactttttttaatcccatagatatggccttgctgtcagctgtaaaagctggtatttttgttgttcaagcagctggaaatactggaccatcaccaaagagcgtttcttcctttagtccatggatcttcactgttggtgctgcagctcatgatagagcctacagtaactcgattgtcctaggcaacaacgttaccattcctggagttggacttgcacccggaacacatagaggtagaatgtatacgctggtttctgctcttcatgctctaaacaatgacacaacaattgccaatgatatgtatgtgggtgaatgccaagactccagtagcttgaagcaagatctggtacaagggaacctcttgatctgtagctattcaattcgatttgtgcttgggctctccaccatcaagcaggcattgcaaactgcaaaaaacctcagtgcagctggtgttgtattctacatggatccttttgtaattggatttcagcttaatccaattccaatgaaaatgccgggcataataatttcatccccagatgattcaaagatttttctgcaatactacaatcattctttggagaggcaagggtctacaaaggaaattgttaaatttggggcagctgctagcatttcaggtgggctaaagccaaattacagcaactctgctccaaaggttatgtactattctgctagaggaccagatccagaagacagtttccttgatgatgctgacataatgaaacccaacttggtagctcctgggaattttatatgggctgcttggagttcccttggcacagattctgttgaattcctaggagagaactttgcaatgatgtctgggacaagcatggctgctcctcatgtttctgggcttgcagcattgattaagcagaagtttcccaagttcagtccgtcggccattggatctgcactttccactacagcttctctatacaacaggaatggtgggcctataatggctcagcgtgcttatgcaaatccagatttaaaccagtctccagcaacaccctttgacatgggaagtggctttgtgaatgcaactgcagcattagaccctggtctgatattcgatgcaagttatgatgattatatgtcattcctttgtggcatcaatgggtcagctcctatggttctgaactacactggtgagatgtgtggagtttccaccatgaatggcactgacataaacttgccctcaatcacaatagcgagactagaacagactagaactgtccaaagaagagtgacaaacgttgacagcaatgagacttacatagttggttggagtgctccttatggggtttcagtaaatgtagttccaactcacttctttatagcatgtggggaaacacagaccttgactgtaaccttgagtgctacaatgaacagcacagctgctagctttggaaggataggactggttggaaagggaggtcacattgttaacattccagtagcagtcatctttaaagccaaatataacaatactaacaggtgaagacgaggagctgggtggggattatgattttcattttgtttagttttgattttgggtgttgatcgattttttcatttgtcatgtaaatgctgaagcatgtatttgaaatgtagatacagtgagttgagtaattaatgatagtagtgctttgttttctc

SEQ ID NO: 10490 - DNA, 2110 bp, Glycine max
gaaggcccgaaatcaagtctttttactgtttttccccagttcgcccatgccgtagatggcgctctcccttctttgatataaaggacaatgcgcatcaagataaccacccaggattttccaacgttagaatctcagcaattttagatgtttctttctttctgccttgagcctcacctcttgtgatatgcagcattctagactttccagtaaaaaagaaagacgagaattctgcgcaatccgaggagctagcgacacttaggccaaaagacaccaacaaacaaatccagcaccgcttccacgttttcttaataaaatggttacatcggaactctctaatcaccaaaacaacaactctcccatgatggcgaagccccacagaaacaaaacctcctctgtatttctctccgatggatctctcttcctcggaggagcattctccgctctcatcctcgtctggggtttctcctccttcaccaccaccatccctaaggaaacccccaatttcgaatctcttaccaaaaacgacgctgttccgcaccacggtactcccgatttcaacttcgacccccccgacagaacattctacgacgacccgcaaatgggttacaccatggacaagaaagttcgcaactgggacgagaagcgcgaggagtggctgaagctccacccttccttcgccgccggagctagagagagggttttcatggtgaccggttctcagccaaagccgtgccggaaccccataggagaccacctcctcctgcggttcttcaagaacaaggtggactactgtcgtctccacgggtgcgacgttttctacaacaacgcactgttggacccaaagatgtttgcgtattgggccaagtaccctgtggtgcgggccgcgatggtggcccacccggaggcggagtggatctggtgggttgactcggacgcgttgttcaccgacatggagttcaagctcccccttgagcgttacagggagcacaatctcgtggttcacggctgggcccacctcatacacgagaagcgaagctggacgggactcaacgccggcgtcttcctcatcagaaactgccagtggtcgttggacttcatggaggcgtgggccagcatgggcccacagacccccaattacgaaaagtggggccagacgctgcggtcaactttcaaggacaagttcttcccggagtcagacgatcagacgggcctggcttacttaatcgccatagaaaaagataaatgggcggacaggatttacttggagagcgagtactacttcgaagggtactgggaagagatcttaggaacgttccagaacattaccgagaaatataatgagatggaaaaaggggtgagtaggttaaggaggcgtcacgcggagaaggtgagtgagacttacggtgagatgagggaagagtatttgaaggatgctgggaatggaaaagggagttggaggagaccattcataactcacttcacagggtgtcaaccctgtagtggaaagtataatgccatgtattccgctgatgattgctggaacggaatgcagaaggctttgaattttgccgacaatcaagtcatgcgtaaatttggttacatgcgcccggatctactggataacgccatttcccctgtcccttttgattatccccgttcacttcgtcattgatcatcagtgtgaaggacccgctgagcttggatagattttactgcggcccactatttaagatggatagatgaaccatgtgcatgcgtacagaactttcatggacctgtattatcgtcggggttgtggggtcatgctcacatagtagcatatccaaccatgttaatacactacttgctacagtaaaaagataccctgcggccattctagttacatctaccctttgtttttttccctcccttttcctctcatggcttgaaatcttacatatatagaagcataacaaaatagcagtgctaaggtttatgacgttgttatgaccaatgttctagtgtacccaacatcaagatggcccaataaacttgtagacatgtgagttgtgacgtgcattttcacatgagtattacttggtttaattacgaaagtgggttgatttttaaa

SEQ ID NO: 10491 - DNA, 1749 bp, Glycine max
ggtgctgtcccttctttgatataaacaacaatgcgcatcaagatagcccctctagagtttccaacgttagaatctcagcaatttgagatgtttatgcgttactctttctttctgccttgagcctcacctcttctaatttgtaaaaaaaaatggccagaattctgcgcaatccgacgagcgacacttaggccgaaagacaccagcaaacaaagccagcaccgcttccacgttttcttcttaacatggttaaatctgaactctccaatcactaccacaacaacaacaagtctcccatgatgatggcgaagccccacagaaacaaaagctcctctttatttctctccgatggatgtctcttcctcggaggagcattctccgctctcatcctcgtctggggtttctcctccttcaccaccaccatccctaacgacacccccaacttcgaatctctttcaaaaaacgacgccgcttcgcaccacatcgctcccgatttcaacttcgacccacccgacagaacattctacgacgacccgcaaatgggttacaccatggacaagaaagttcgcaactgggacgagaagcgcgaggagtggctgaaactccacccttccttcgccgccggagcgagagaaagggttttcatggtgaccggttctcagccgaagccgtgccggaaccctacaggcgaccaccttctcctgcggttctttaaaaacaaagtggactactgtcggctccacgggtgcgacattttctacaacaacgcgctgttggaaccgaagatgttcgcgtactgggcaaagtacccagcggtgcgggccgcgatggtggcccacccggaggccgagtggatctggtgggttgactcggacgcgctgttcaccgacatggagttcaagctcccccttgagcgttacagggagcacaatctcgtggttcacggctgggcccacctcatacacgagaagcggagctggacgggcctcaacgccggcgtgttcctcatcaggaactgccagtggtcgttggacttcatggaagcgtgggccagcatgggcccacagagccccaattacgaaaagtggggccagacgctgaggtcaactttcaaggacaagttcttcccggagtcagacgatcagacgggcctggcatacttaatcgccatggagaaggataaatgggcggagaggatttacctagagagcgagtactacttcgaagggtactgggaagaaattcagggaacgttcaagaacataacggaaaaatacaaggagatggaaaaaggggtgcagaggttaaggaggcgtcacgcggagaaggtgagtgaaacatacggggagatgagggaagagtatttgaaggatgctgggaacgctaaagggagttggaggagacccttcattacgcacttcaccggctgtcaaccttgtagtggaaagtataatgccatgtattcagcccatgattgctggaacgcaatgcacaatgctctcaattttgccgataaccaagtcatgcgtaaatttggttacagtctactggataacgccgtttcccctctcccttttgattatccccgtcattgattcaccaatgtccactcagattccctatctataatattttattcccagtttaaggtatcttttctcctgcactggaggggtttggagggataatttcattctaccccaatccctaaatgcctgccttgtttttttactaaacaattcttctttttta

SEQ ID NO: 10492 - DNA, 1601 bp, Medicago truncatula
cttcccaaaccaaacttcactcaactcactcactcaccttttagtccttccttcaaagtttcaatcaatctcagccatttttagctacattttctcctttcacaaacctcaactattttgttttcttcatagttcatatacttgtcactcacactacaaagaacctacgtcacaaaacaaaccaccgtttacacgaaaagctaattaatatggttacaacagaactctcacactctcatttttcttccatcatggcaaaacccattcccagaaacaaatcttcttctatatttctctctgatggcttcctcttccttggaggagcattttcagctcttctacttgtttggggtttctcttccttcacaaaccccatcccaaacgacaacctcactttaaaatctcacaaaaacaacgttgtttcatactcaacacctgatctacgctttgatccaccagaccaaacattctacgatgatcctgaaatggagtataccatgtccgttaaattagaagactgggacgagaagcgtgaggagtggctaaaacatcatccatctttctctgccggagcaaaggagagagttttgatggtcactggatcacaaccttctccgtgcaagaacccaataggtgaccatttgttgttaagattcttcaaaaacaaagtggattactctcgtattcatggttatgacatcttctacaacaacgctcttttgcatcctaagatgtttgcttattgggctaagtaccctgttgtgaaagctgcaatgatggcacacccagaagcagagtggatctggtgggttgattcagatgcattgttcacagacatggatttcaagcttcctctcaaacgttacaaggatcataaccttgttgttcatggctggcctcacttgatccatgagaaacggagctggaccgggttaaacgctggtgtgtttttgatcaggaactgtcaatggtcattagattttatggaggcttgggctggaatgggcccacaaagtccagattatgaagaatggggtaagactctccggtcaacttttaaagataaattctttcccgagtcagacgatcagacaggcttagcctatctgatcgcgatcgagaaagaaaaatggggtgacaagatttatctagaaggggaatattactttgaaggatactgggaagagatagtagaaactttctcaaacattagtaagaaatatgaagatattgaaaaagttgagcctaagttaagaaggcgttatgctgagaaagtgagtgaagcttatggtgttattagagaagaatatttgaaagatgctggttatggtaaaggaagttggagaagaccatttgttacacattttacaggttgtcaaccatgcagtggaaagtataatgaaatgtacactgctgatgcttgttggaatgggatgaaaaaagcacttaattttgctgataatcaagttatgcgtaaatttggttttgtgcataaagatcttggggataatggtgtttcttctttaccttttgattatcctcaaccatgattatgcttcatgactatgactatgactatgatatgaatatgatcatgaccc

SEQ ID NO: 10493 - DNA, 1350 bp, Senna occidentalis
atggcgaaatcggtaagaaacaaatcctccctctggttttccgatggctgcctcttcctcggcggagcattctccgctctccttctcgtttggggattctggtccttcatagccccaattcctattactgaccctaatttcgactccgtctcaacaaaattgaaaaccctaaaaaatccccgaaccgtcccttccaccgtaatctgctccacctccgccgccgaaaccaccaccgttccgaatctccgacacgacccgccggaggcaacgttctacgacgacccggagacgagctacacgctggacaaaccgatgaagaattgggacgagaagcggcaagagtggctgaatcgtcacccgtcattctccgccggagcaaaatcgagaatccttctggtcaccggatctcagccgacgccgtgcaagaatcccatcggcgaccatctccttctgcggttcttcaagaacaaagtcgactactgccgcctccacggctacgacatcttctacaacaacgcgctgcttcagcccaagatgcacacatactgggccaaatacccagtggttcgggccgcgatgatggcccacccggaagccgagtggatctggtgggtggactcggacgcgttgttcaccgacatggagttcaaactccccctaaaccgctacaagaatcataacctcatcgttcacggatggcccactctaatccacgaagccaaaagctggacaggcttaaacgccggcgttttcttaatcagaaactgtcagtggtcgttggacttcatggacgtgtgggccagcatgggcccacagacaccgagctacgagaaatggggtgagaaattaagaacaacgttcaaagacaaggcgttccccgaatcggacgatcagacggggctggcgtatttgattgcggtggagaaggagaaatgggcggacaggatttatttggagtcggagtactatttcgaagggtattggaaggagatagtggagacgtacgagaatataacggacaagtaccatgaggtggagaggaaggtgaggagtttaaggaggaggcatgcggagaaggtgagtgagagttacggtgcggttagggaaccgtacgtgatggtggccggatccggtagggggagttggaggaggccttttattacgcacttcacgggatgccagccgtgcagtgggaatcataatgccatgtattctccggacgcgtgttggaatgggatgaataaggccctcatttttgcggataatcaggtgctccgtaagtttggttatgtgcacccggatctacaggataactccgtctcacctataccctttgattatcctgcctga

SEQ ID NO: 10494 - DNA, 1351 bp, Glycine max; identical to SEQ ID NO: 10479

SEQ ID NO: 10495 - DNA, 1456 bp, Glycine max; identical to SEQ ID NO: 10478

SEQ ID NO: 10496 - DNA, 1083 bp, Medicago truncatula
atgtcgtcgattatcaaattttcacggtttttctctgccgttatgaccgtaatcatcatctccccctccctccattcatctcattacccagctttagccataagatcttctatcattcatcatattcctcaccatgattaccgtttctactttcacacatctccgttttttcgtaatgccgatcaatgcgaaccgatttcaagggaaatcggtgcatgtcatccaagtttggttcatgtagctattacactcgatgtcgagtatcttcgtggttcaatcgctgcggtgcattccattctttatcacgcttcttgtccagagaatgttttttttcactttcttgttacagatacggatctggaaacattggttcgaacaacttttccgcagttgagattcaaggtgtattatttcgatcggaatattgttaagaatttgatttcaacttctgtgagacaagcgcttgaacagcctttgaattacgctagaaattatctagcggatctgttagaaagttgtgtgaaaagagtgatttacttggattcagatcttgttttacaagacgatattgcgaagctgtggaatactgatttagggttgaatacaatcggagcaccgcaatattgtcatgctaatttcaccaagtattttacggcggcgttttggtccgacccggtgttttctacgacgtttgagaagagaaaagcttgttacttcaacactggggtgatggtgatggatctagtgaagtggaggaagaaagggtacacggagaggattgaacggtggatggaaattcagaaggtagaaaggatctacgagcttgggtcactaccaccgtttctgttggtttttgcaggacacgtggcggcaattgagcataggtggaatcaacatggtttaggtggtgataatgtgaaaggtagttgtagagatttgcatcctggtcctgttagtttgttgcattggtctggtagtggaaaaccatggaggagacttgatgaatcaaaaccttgtcctcttgatgcactttgggaaccctttgatttgtatggacatagacgcagatatgaatcattatag

SEQ ID NO: 10497 - DNA, 1408 bp, Glycine max; identical to SEQ ID NO: 10471

SEQ ID NO: 10498 - DNA, 1505 bp, Glycine max; identical to SEQ ID NO: 10469

SEQ ID NO: 10499 - DNA, 2688 bp, Phaseolus vulgaris
tcccattgtaccatattgattatcacaattacaattaattacatttccatacacgaaattacacatcccataagcaattgggctaaattaaaagagagaataataaacaacaagtacgattttcagcagaggaaattggaattaagcacaggcgcaagaagtgtcaatgataagggaatcttcgccctcgttcctgaagaagaagtaaccaacagcgagacccacgacgatggccaggaagacccctccattgaaggacataaccgacaacatcaacaaatacccgatcgcggagctcagcccaaagagaaacgctccagcgaccttcacgcccaacttggcgccgtttccggtgagcttccgccgcaagagaggggtctcgatctccgccggaaaggactttccggcaccgatgagcttgaggcgaatacggcgattctcaataaactggtagaaagcggaaacaacgaggcatgcaaggagggtgaggagatagtcggtccaatcgacggtcttccatgaatcgatcaggagattgaccttccggctccagtaaaaggtcatgtgcatcatcttcgccggtcaactttgtatttcaagggtttgtaaaaaacgatatgtatgaacaacaagaacaacaacaattctgataagtttccctttactttgatttgtaggaaccatgatggaagaggagcaaaagctggttaaggggggcacaaatttggaggggagtgaggccaaacttgagctcactgtggatgaggtggtggaggaatatgtggggtccctggggttctctcagctggtgcatgtgctcttggtgtcattggcatggatatttgatgctcagagtactttggtgacaatcttcagtgatgctcaaccttctgcttggaggtgcaaaagtggattttgtaacaacagcagcagcagcagcagcactggttctgtatgtgagttggtaccagggacttgggaatgggttggtggccataccagttccatcatagcagagtggaatcttatatgtgatagaaggtttcttgctgctgtgcctgcttcagtctacttccttggctctctcatagggtctggtgtgtatggccacctatctgatacatggttaggaagaaaaagatcagtgcaactttcctgcatcttaacttccatcacagcctttgccacctctctttctccaaacatttggacctatgccttcttcaggtttaccaatggctttgcaaggtcaggaattggcatatgctgccttgtgctcaccacagaatcagtaggccgcaagtggcgtggccaagtgggccaatacggttttttcttcttcacaataggcttcctcacactcccccttgtggcctatccaaccagaacacattggaggagcttgtacaaactcttgtcccttcttccactagcatactctgtcttaatccttcctttggtctcagaatccccacgttggctcctcataagagggagaaccaaagaggcccttcaggttttggacaggtttgcaagactcaatgggaagcaaaaactccccaccaacctcactttaaccaatcctagtggatcttcaaatgttgcaccatgcactactagtgaaggtggtgaaagaactccaaacaataaagaaaacctttggaccacaaaatgggcagccataagaatggtcactgttatgttagctggctttggagttggctttgtttactatggagttcaactcaatgtagaaaacttgaacttcaacctttatgtctcagtagcactgaatgcactaatggagattcctgctgtggtgattggtacctttctcctggggtttactaatagacgtttgttgttatctgtgtcctcttacatagctgcagtgtcctctatcctatgcacatttttttcacacagaggaaaaacatcaaaagtacacagcaatcatggaggtagctgggcccagttgatcattgaagcaattggattcatgggggcttccacaacatttgatattttgtacatatattgtgtggaactttttcctaccaatgtcaggaactttgctgtgtcaatgttgcgccaggccataatgttgggggcttctgtggcccctttgctggttgtgctgggccgtttgagcccatctctttctttctttgtctttggagccttttcaatttctagtggagttttgagcctttggctacctgagacaagaaatgctcctctctatgagactttgaaacagcaagaggaggaagagaaacacaattgggtgtctcataatgattgtgcccttgagctaggacaatagctcaagaacctcttcatgttaatttatatacactattaatctaaagtatttttgtgcatgtatctgataagatttaaccattttatcatgccatcataatctgatgtgctgatataaggtaaagtcttgttagatatctgcatggaaaatattttacattgaaaatgtatataagttaaactcttgtagaaatagggtagaagggtccatggatggagtcaggagcaatgaaaatcacagtgtagaagtggcctcatgttgtgttctggtgtaattgctatcataactgtagcatctgatgaaaaaaaaaaaaaaaaaaaaaaaaaaaaaaaaaaaaaaaaaaaaaaaaaaaaaaaaaaaaa

SEQ ID NO: 10500 - DNA, 1841 bp, Glycine max
atggccgagatgtcagccattttttcagtatattgagaaaagcatgccaagtctctagctctgttgaactaacaactttcatataacaaccttgcagcagtcatttgattcaaaaggaatcatcataatggaagaggagcaaaaactagttaaggagggcacaaatttggagggaagtgaaagtgagaccaaacttgagctcactgtggatgaagtggtggaagagtatgtggggtccttagggttctctcagatggtgcatgtgctcttggtgtcattggcatggatatttgatgctcagagtactttggccacaatctttagtgatgctcaacctcctgtttggagatgcaaaactggattgtgccaaggtaacaacaacaacaatagcactggttctgtctgtgggttggttcctgggacttgggaatgggttggtggcaacacaagttccatcatagctgagtggaatcttgtatgtgatagaaggtttctggctgctgttcctgcttctgtctacttccttggctctctcataggttctggtgtctatggccacctatctgattcattgctgggcagaaaaaaaacagtgcaactttcctgcatcttaacctccataacagcctttgccacatctctctccccaaacatttggatctatgctttcttccgttttgccaatggttttgccaggtcaggaattggcataagctgccttgtcctaaccacagaatcagtaggttgcaagtggcgtggccaagttggccaatacggtttctttttcttcacaatagggttcctcacactccctcttgtggcctatccgacaagaacatgttggagaaacttgtacaaactcttgtcacttcttccactagcatattctgtcctattactccctttggtctcagaatccccacgttggcttctaataagaggaagatccaaagaggcccttcaagttttggacaagtttgctagactcaatggaaagaaaaaactccccgataacctctctttggttaacccttgtggatcacaaaatggtgaaagtgatgaaacaagtcctaataacaacaaagagaacctttggaccacaaaatgggcagctattagaatggtcactgttatgttatctggctttggagttggctttgtttactatggagttcaactcaatgttgaaaacttgaacttcaacctctatgtctcagtggcaatcaatgcacttatggagattcctgctgtggtgattggtacctttctattgggatttactaataggcgtttgttgttatctatgtcctcttatatagctgcagtgtcctctatactatgcacatttttatcacacaaaggaagtacatcaaaagtgcataataacaatagtggtaactggggtcaattgattattgaagcaattggattcatgggtgcttccacagcatttgacattttgtacatatattgtgtggagctttttcctactaatgttaggaactttgctgtgtcaatgcttcgccaggccctaatgttgggggcttctgttgcacctttgcttgttgtgttgggccgtttgagcccatctatctcttttcttgtgtttggtgtcttggcaatttcaagtggtgttttgagcatttgcctacctgagactagaaatgctcctctctatgagaccctgaagcagcaagaggaggaggagaaacacaattgggtgtctcataatgattgtgcccttgagatgggaaaataactcattttaatttatatgcactattgatctaaagtgtatttttatgtagacatctagtgagatttaaccattttgccatgtc

SEQ ID NO: 10501 - DNA, 2104 bp, Glycine max
tttcagcattttttcagtatcttgagataagcaagccaaatctttagctcttctgaaccaactttcatataacaaccttgcagcagtcatttgattcaaaaggaatcataatggaagaggagcaaaaactggttaaagggaccacaaatttggagggaagtgaaagtgaggccaaacttgagctcacagtggatgaagtggtggaggagtatgtggggtccttagggttctctcagatggtgcatgtgttcttggtgtcattggcatggatatttgatgctcagagtactttggccacaatcttcagtgatgctcaaccacctgcttggaggtgcaaaactggattgtgtcatggtaacaacaatagcactgggtctgtctgtgggttggtgcctggtacttgggaatgggttggtggcaacacaagttccatcatagctgagtggaatcttgtatgtgatagaaggtttctggctgctgttcctgcttctgtctacttccttggctcgctcataggttctggtgtctatggccacctctctgattcatggctaggcagaaaaaaaacagtgcaactttcctgcatcttaacctccataacagcctttgccacatctctctctccaaacatttggacctatgtcttcttccgttttgccaatggctttacaaggtcaggaattggcatatgctgccttgtcctaaccacagaatcagtaggtcgcaagtggcgtggccaagttggccaatacggcttctttttcttcacaatagggttcctcacactcccccttgtggcctatccaacaagaacatgttggagaaacttgtacaaactcttgtcacttcttcccctagcatattctctcctattactccctttggtctcagagtccccacgttggcttctaataagaggcagagacaaagaagcccttcaagttttggacagatttgctaggctcaatggcaagaaaaaactccccaataacctcactttggttaacccttgtggatcatcatgtgatgaaacaagtcctaataacaacaaagagaacctttggaccacaaaatgggcagctattaggatggtcactgttatgttagctggctttggagttggttttgtttactatggagttcaactcaatgttgaaaacttgaacttcaacctctatgtctcagtggcaatcaatgcacttatggagattcctgctgtggtgattggtacctttctattgggatttactaatagacgtttgttgttatctgtgtcctcttatatagctgcagtgtcctctatattatgcacatttttttcacacaaaggaggcacatcaaaagtgcataacaacaatagttatggtggtaactggggtcaattgattattgaggcaattggattcatgggtgcttccacagcatttgacattttgtacatctattgtgtggagctttttcctactaatgttaggaactttgctgtgtcaatgctgcgccaggccattatgttgggggcttctgtggcacctttacttgttgtcttgggccgtttgagcccatctctctctttcctagtgtttggtgtctttgcaatttcaagtggtgttttgagcatttggctacctgagactagaaatgctcctctctatgagaccctgaagcagcaagaggaggaggagaaacacagttggatgtctcaaaatgattgtgccctagagatgggaaaataactcaaaatggtcttcattttaatttatatgcactactaatctaaaatgtttttgtgtagacatttgataagatttaaccattttgccatgtcatatgatgggatgataagctaaattcttattgggtgtgtgtacaaatattttagattgagaatgtgtgtaaattaaactctaatagaagtagggtaatgtgacccaaagggaatggaattaggggaaatcaaaattatcatgttggaatgaccacatgttgcttcctaatgtaatagattgatgattatcataacgataacatctgattagtaatgtatccttacttcttgtgctgtcaaagaggcagaatataagactgtccatgtgccatatcaagt

SEQ ID NO: 10502 - DNA, 2475 bp, Glycine max; identical to SEQ ID NO: 10485

SEQ ID NO: 10503 - DNA, 2581 bp, Glycine max; identical to SEQ ID NO: 10484

SEQ ID NO: 10504 - DNA, 2644 bp, Glycine max; identical to SEQ ID NO: 10488

SEQ ID NO: 10505 - DNA, 1749 bp, Glycine max; identical to SEQ ID NO: 10491

SEQ ID NO: 10506 - DNA, 2110 bp, Glycine max; identical to SEQ ID NO: 10490

SEQ ID NO: 10507 - DNA, 487 bp, Glycine max
ggtatggggggattggggaagaccacgccgtgtggagcagagagacagagatcgtcggggaagagagtgcgccagggaacagaggggttgagagagggaagaacctcgtcgagagattcttgttcggaggaatccaaaggtggttgctggtgggagagtgaaaaaaaggtgcttgtcacgacaaaagaaaacatcatcgtccataagacaagacccatatttgttggaatggaggtgctgctcatactcgacgatgtcgcggggatgaagtgtaaggtgctgctcatactcagacaagtttataaaaggtggaaggaaaggtgcataagagatgccaaaaataactggcgaagggtgcagaggggaaaggacaacagatgttggatgtgtgagacaacaaaacctgctaacaaaacacgcgacagtagcgcgccgcactcgccgacttgttctgtcgtttttgccacttctggcctccctctcgcca

SEQ ID NO: 10508 - DNA, 336 bp, Glycine max
ggaatgggtggtgtggggaagacaacacttgctcgagcaatttacaatttgattgctgatcaatttgaagtattgtgttttcttgataatgtgagagaaaactcaattaaaaatggattggtgcatctccaagagacacttctttctaaaacaattggagagaagggtattaagttaggaagtatcaacgaagcaattccaataataaagcataggctccaccgaaagaaggttcttttggttctggatgatgttgacaaaccagatcagttgcatgcaattgctggagggatggattggtttggttctggtagcaaaatcatcatcacaactagg

SEQ ID NO: 10509 - DNA, 431 bp, Arachis hypogaea
ttcgattgggatggggggggtggggaaaactactcttgctcgagcagtttataatctgattgcagaccaatttgaaggattatgttttcttgaacatgtgagagaaaattcaatcaaatatggattagcatatctccaagagatacttctttctaaagtacttggaaaaaaggatattaagctagcaagtgttggtgaaggaacttcaacaataaggcaaaggttctcaagaaagaagattcttttggttcttgatgatgttgacaaactcgagcaattgcgaatgattgccggaggacttgattggtttggttatggtagcagagtcatcataacaactaggaacaaacatttgctagcagcacatggggtggagaggacctatgaggtagatgacctaactatggaagaatcactcgagttgctcaatt

SEQ ID NO: 10510 - DNA, 1380 bp, Glycine max
catacataatatccttctccctcaaaccaaaccatacctattctcaagtttctctctgtttcttcctacttcatgctatagcacttacaatactcaacaataacctaaccaaaccaaaccaaaccaaaacccttatctgcactcacttcacacaaaccaaagttaattaattaccaacacaaaatggatggaggctgtgtcacagacgaaaccaccacatccagcgactctctttccgttccgccgcccagccgcgtcggcagcgttgcaagcgccgtcgtcgaccccgacggttgttgcgtttccggcgaggccgaatcccggaaactcccttcgtcgaaatacaaaggcgtggtgccgcaaccgaacggtcgctggggagctcagatttacgagaagcaccagcgcgtgtggctcggcactttcaacgaggaagacgaagccgccagagcctacgacatcgccgcgctgcgcttccgcggccccgacgccgtcaccaacttcaagcctcccgccgcctccgacgacgccgagtccgagttcctcaactcgcattccaagttcgagatcgtcgacatgctccgcaagcacacctacgacgacgagctccagcagagcacgcgcggtggtaggcgccgcctcgacgctgacaccgcgtcgagcggtgtgttcgacgcgaaagcgcgtgagcagctgttcgagaaaacggttacgccgagcgacgtcgggaagctgaatcgattagtgataccgaagcagcacgcggagaagcactttccgttaagcggatccggcgacgaaagctcgccgtgcgtggcgggggcttcggcggcgaagggaatgttgttgaactttgaggacgttggagggaaagtgtggcggtttcgttactcttattggaacagtagccagagctacgtgcttaccaaaggatggagccggttcgttaaggagaagaatcttcgagccggtgacgcggttcagttcttcaagtcgaccggaccggaccggcagctatatatagactgcaaggcgaggagtggtgaggttaacaataatgctggcggtttgtttgttccgattggaccggtcgttgagccggttcagatggttcggcttttcggggtcaaccttttgaaactacccgtacccggttcggatggtgtagggaagagaaaagagatggaactgtttgcatttgaatgttgcaagaagttaaaagtaattggagctttgtaacattacatagtttttgagtttcttttgtgaattttgtaactgttgaattcatgaggtagagatggtgatggtgttgttgcaagttgccactcacaaaaggtgtatagtctcaaaaaaaaaaaaaaaaaaaaaaaaaaaaaa

SEQ ID NO: 10511 - DNA, 1208 bp, Glycine max
tatagctcttaaaatactcaacaataaccaaacctaatcaaaacccttatctacactcacttcacacaaaccaaagttagttcgttaaccgttacaaacacaaaatggatggaggcagtgtcacagacgaaaccaccacaaccagcaactctctttcggttccggcgaatctatctccgccgcctctcagccttgtcggcagcggcgcaaccgccgtcgtctaccccgacggttgttgcgtctccggcgaagccgaatcccggaaactcccgtcctcgaaatacaaaggcgtggtgccgcaaccgaacggtcgttggggagctcagatttacgagaagcaccagcgcgtgtggctcggcaccttcaacgaggaagacgaagccgccagagcctacgacatcgccgcgcatcgcttccgcggccgcgacgccgtcactaacttcaagcctctcgccggcgccgacgacgccgaagccgagttcctcagcacgcattccaagtccgagatcgtcgacatgctccgcaagcacacctacgacaacgagctccagcagagcacccgcggcggcaggcgccgccgggacgccgaaaccgcgtcgagcggcgcgttcgacgcgaaggcgcgtgagcagctgttcgagaaaaccgttacgcagagcgacgtcgggaagctgaaccgattagtgataccaaagcagcacgcggagaagcactttccgttaagcggatccggcggcggagccttgccgtgcatggcggcggctgcgggggcgaagggaatgttgctgaactttgaggacgttggagggaaagtgtggcggttccgttactcgtattggaacagtagccagagctacgtgcttaccaaaggatggagccggttcgttaaggagaagaatcttcgagctggtgacgcggttcagttcttcaagtcgaccggactggaccggcaactatatatagactgcaaggcgaggagtggtaaggttaacaataatgctgccggtttgtttattccggttggaccggttgttgagccggttcagatggtacggcttttcggggtcgaccttttgaaactacccgtacccggttcggatggtattggggttggctgtgacgggaagagaaaagagatggagctgtttgcatttgaatgtagcaagaagttaaaagtaattggagctttgtaacattacatagttttt

SEQ ID NO: 10512 - DNA, 1155 bp, Medicago truncatula
atggaattaggaggaagttccacagatgaaactgtcacaagcaatgactctctttcggcgaacttatctacaccgccgccaacgctgaactcactaagccgcgttggcagtgctgctagctccgtcgtggatccagaaatctacggcgtctccggtgaggcggagtctcgtaaacttccatcgtcgaaatacaaaggcgtggtgccacagcctaacggacgttggggagcacagatttacgagaaacaccagcgtgtgtggcttggtacgttcaatgaagaagacgaagcagccagagcctatgacatagccgccttgagattccgtggaaaagatgctgttacaaattctaaaagtctcactggcgttggtaacgacgccgacgaaggtgaaactgagtttctgaattcacattctaagtcggagattgttgatatgcttcggaaacacacctacgatgacgagcttaagcaaagcatgcgtgacatgagcggtggaagacagcggcgtaacggagaattgaatggtgcggtttcacgtggcgcgtgtgatgctaaagcgcgtgagcagttgtttgagaaaacggttacgccgagtgacgtggggaagttgaatcggttggtgataccgaaacagcatgcggagaagcattttccgttgaatgcagttgctgttgccgtcgcatgcgacggagtctcgacggctgctgcggcggcgaagggtttgcttttgaatttcgaagacgttggagggaaagtgtggcgatttcgttattcttattggaatagtagccagagttatgttttgaccaaaggatggagccggttcgttaaggagaagaatctccgagccggtgatgcggttcggttttttaggtcgactggaccggaccggcagctttacattgactgtaaagcaaggagcattggtgttgtcggtggtcaggttgataataataataataatactggtggtttgtttattacggttcgaccggtagttgaaccggttcagatggttcggctttttggggtgaatcttttgaaactacctggttcagaaggagttggtggtagttgcaatggaaagaggaaagaaatggaattgttcgccttagaatgcagcaaaaagccaaagataattggagccttataa

SEQ ID NO: 10513 - DNA, 1626 bp, Galega orientalis
acgcggggacacctaccttttctcaactctcttctttctcttcacatactataaccattttacaatactcaaaaccaaaaaccaaaaaccaaagttagttattattagtttgttacaaatagaaaaaacaaaaaccaaagttagttaattataacagaacaacagaaaaaatggaaggaggtagttgcatagatgaaacaaccaccactagcaatgactcactttctgtatctatttttccggcgaaactatcaccaccgccgacgaacacactcagtcgcgttggcagtggtgctagcgccattttcgatccagaaatttgtgccggctccggcgaggccgaatctcgtaaactcccgtcgtcgaaatacaaaggcgtggtgccacaaccaaacggacgttggggagctcagatttacgagaaacatcagcgtgtctggcttggtacgttcaacgaagaagatgaagctgcaagagcttacgatatcgctgctttgaggttccgtggaaaagacgctgttacaaactccaaaactcttgccggcgccggaaacgataacgatgaagccgaaactgagtttcttaactcgcattccaaatctgaaatcgttgacatgcttcgtaaacatacttacgacgatgagcttcgtcagagcatgcgtgatacgtgtggcgggagacagcggcgtaacggagaatcatctgctgcggcatcacgtggcgcgtgtgattctaatgcgcgtgaacagttgtttgagaaaacggttacacctagtgacgttggaaagttgaatcggttagttataccgaaacagcacgcggagaagcattttccgttaggtgctgtcgctgccgccgtttccgtcgcagtcgacggtatctcaccggccgtttcggcggcgaagggtttacttttgaatttcgaagacattggagggaaagtgtggcggtttcgttattcatattggaacagtagccaaagctacgttttaaccaaaggatggagccggttcgttaaggagaagaatcttcgagccggtgatgcggttcagttttgcaggtcgaccggaccggaccggcagctatacattgattgcaaagcaaggagcgttagtgttgtcggtgttggtattggtaatacttacactgacaatttgtttattccggttcgaccggtagttgaaccggttcagatggttcggctttttggagtcaatcttttaaaactacctggttctgatggtgttggcggtagctgcaatgggaaaaggaaagaaatggatttgtttaccttagaatgcaccaaaaagccaaagataattggagcattataacattatattaaaaagctattttatattttatgtttaaagttttttttatgtgaattttttaaagttttgtgactgatgaaatgatgaggaaaagaattagaagaattaatggtggtgtagttgcaacgcaacttgcaagaatgcacgttgtaaaaagctgaattgtacattattagaccaacaattgtgatattagggccaacaataattgttgtgtataccaaaagaaggtttttgaaagtgaaatgaaggaagacaactgttaattttgcaaaaagaaaaacctatagtg

SEQ ID NO: 10514 - DNA, 1627 bp, Glycine max
ccaaactcatctctctttgctacctcttagtcaaacaaagtaacaaaccatcctcccctctcttctcttcttttgttctctagatttcttctctcttgtttcttagaatccgtacaatctaatcaacataacaaaaatggatgcaattagttgcatggatgagagcaccaccactgagtcactctctataagtctttctccgacgtcatcgtcggagaaagcgaagccttcttcgatgattacatcgtcggagaaggtttctctgtccccgccgccgtcaaacagactatgccgtgttggaagcggcgcgagcgcagtcgtggatcctgatggcggcggcagcggcgctgaggtagagtcgcggaaactcccctcgtcgaagtacaagggcgtggtgccccagcccaacggccgctggggtgcgcagatttacgagaagcaccagcgcgtgtggcttggaacgttcaacgaggaagacgaggcggcgcgtgcgtacgacatcgccgcgcagcggttccgcggcaaggacgccgtcacgaacttcaagccgctcgccggcgccgacgacgacgacggagaatcggagtttctcaactcgcattccaaacccgagatcgtcgacatgctgcgaaagcacacgtacaatgacgagctggagcagagcaagcgcagccgcggcgtcgtccggcggcgaggctccgccgccgccggcaccgcaaactcaatttccggcgcgtgctttactaaggcacgtgagcagctattcgagaaggctgttacgccgagcgacgttgggaaattgaaccgtttggtgataccgaagcagcacgcggagaagcactttccgttacagagctctaacggcgttagcgcgacgacgatagcggcggtgacggcgacgccgacggcggcgaagggcgttttgttgaacttcgaagacgttggagggaaagtgtggcggtttcgttactcgtattggaacagtagccagagttacgtcttaaccaaaggttggagccggttcgttaaggagaagaatctgaaagctggtgacacggtttgttttcaccggtccactggaccggacaagcagctttacatcgattggaagacgaggaatgttgttaacaacgaggtcgcgttgttcggaccggtcggaccggttgtcgaaccgatccagatggttcggctctttggggttaacattttgaaactacccggttcagatactattgttggcaataacaataatgcaagtgggtgctgcaatggcaagagaagagaaatggaactgttctcgttagagtgtagcaagaaacctaagattattggtgctttgtaacgttacgttaggttttttttttctttttttttttcgggagtttttgtgactgatgaaagaaagaaggtacaagaacggcggtgtagtggcatggcaagttgctgcaaagtgcaaaaggtgaattgtatattacttaatattattagatgttgaaattaggtgtaatgtaacaaaaactgtacaagaagaagaaaaaaggttttaagaaggggagaagaaaaataaaaataaaagatatcatatgaaaactgtttaatggtatatgttgataatattgttgaatgt

SEQ ID NO: 10515 - DNA, 1602 bp, Glycine max
acccaaactcatctatctttgcttccccttagtcaaacaaagtaacacaccatccatcctctctctcttctcttcttctgttctctagtttcctgctcttgtttcttagaatccgtacggtctaatcaacacaacaaaatggatgcaattagttgcctggatgagagcaccaccaccgagtcactctccataagtcaggcgaagccttcttcgacgattatgtcgtccgagaaggcttctccttccccgccgccgccgaacaggctgtgccgcgtcggtagcggtgctagcgcagtcgtggattccgacggcggcggcgggggtggcagcaccgaggtggagtcgcggaagctcccctcgtccaagtataagggcgtcgtgccccagcccaacggccgctggggctcgcagatttacgagaagcaccagcgcgtgtggctgggaacgttcaacgaggaagacgaggcggcgcgtgcgtacgacgtcgccgtgcagcgattccgcggcaaggacgccgtcacaaacttcaagccgctctccggcaccgacgacgacgacggggaatcggagtttctcaactcgcattcgaaatccgagatcgtcgacatgctgcgtaagcatacgtacaatgacgagctggaacaaagcaagcgcagccgcggcttcgtacgtcggcgcggctccgccgccggcgccggaaacggaaactcaatctccggcgcgtgtgttatgaaggcgcgtgagcagctattccagaaggccgttacgccgagcgacgttgggaaactgaaccgtttggtgataccgaagcagcacgcggagaagcactttcctttacagagcgctgctaacggcgttagcgcgacggcgacggcggcgaagggcgttttgttgaacttcgaagacgttggagggaaagtgtggcggtttcgttactcgtattggaacagtagccagagttacgtcttgaccaaaggttggagccggttcgttaaggagaagaatctgaaagccggtgacacggtttgttttcaacggtccactggaccggacaggcagctttacatcgattggaagacgaggaatgttgttaacgaggtcgcgttgttcggaccggttgtcgaaccgatccagatggttcggctctttggtgttaacattttgaaactacccggttcagattctatcgccaataacaataatgcaagtgggtgctgcaatggcaagagaagagaaatggaactcttttcattagagtgtagcaagaaacctaagattattggtgctttgtagcgttacgttactttttttgagttttttttttttttgagttttgtgactgatgaaagaaagaaggtacaagaagaacggcggtgtagtggcatagtggcatcgcaagttgctgcaaaaggtgaattgtatattacttaatattagatgctgaaatattaggtgtaatgtaacaaaaaactgtacaaggagaagaaaaaaggttctaagaaggggagaagctagaagaaaaaaaatgatgtcatcatgggataactgtttaattgtatatgttgataatattgttgaatgttgattattatgttcacggca

SEQ ID NO: 10516 - DNA, 1298 bp, Medicago truncatula
catatctctcttattttgactcatacaacaaacacaaactatttcattttctaccaaaaatggatggaggtagttgcatagacgaaagcactacaactgaatcattttcaataacaatatcgccaacaaagaaaccgtcaacgccgccacctcccaacagcctatgccgcgttggcagcggcgcaagcgctgttgtggactctgatggcagcggcgttggcgaagctgagtcacggaagcttccttcttcgaagtacaaaggtgttgtaccacaaccaaatggtcgttggggagcacagatttacgaaaagcaccagcgtgtgtggcttggaacatttaaccaagaagacgaagctgctaaagcttatgatgttgccgcacaacgtttccgcggcaaagatgctgtaacaaactttaaaccactctctgaccacaacaacgatgacatggaactcgagtttctcaactcgcattccaagtcagagattgtggacatgttaagaaaacatacatacaatgacgaactggaacagagcaagcgcagtcatggcttcgtcagcagacgaagccatggctgttctgactctgttaactttgccagctcggcatacaataccgataaaaaggcacgtgaagctctgttcgaaaaggttgttaccccgagcgacgttgggaagttaaatcggttagttataccgaaacagcatgctgagaagcactttccattacagaaagccgattgcgtccagggaagcgcatcggcagctggtaagggagtgcttttgaattttgaagacattggagggaaagtgtggagatttagatactcttattggaacagtagtcaaagttacgttctaacaaaaggatggagccggttcgttaaggagaagaatctgaaagccggtgatacggtttgttttcaacggtctactggaccggagaagcagctgtttattgattggaaagcaaggaagaatgttaatgaggttgggttgtttgttccggttggaccggttgttgagccggttcagatggttcggttatttggggttaatattttgaaacaactccctggatccgatgttaatagtaatggtaatgttattgctgggttctgcaatggaaagaggaaggagttgaatatgtttacttttgactcttgcaagaagcctaagattattggagcttttaaaatagcaagcaaagaggctggaagtagagacttagagatgcctctctgggtccttccttccggcctctttgccaaagaaaatgtgaaaacaacacaaagttga

SEQ ID NO: 10517 - DNA, 2703 bp, Glycine max
atggatttcatagggccagtgttggagctcataattcgcatgtgggactgttgtgcctgcgtccgcgagtttgaagagaacctttcttgtttgagggacatagcatctgaccttcgaggtgtttggattgatgtgagtgtgagggttgaagtggctgaggcacagtacctgaggcgtctgaatgaagtgaatgattggttggataaagttgaagccatgcaaagggaagtcgaagctattcagcagaaagtttctcaagttcaagaaacgcatagtagatgtttgggaagtttctgtcccgggaattttccaactagctgctggatgggaagggttatagctcaaaaaattggcgagattcgtgaactaattgataaagggcattttgatgtagtggctcaggaaatgccacatgctttggtagatgaaatacctctagaggccacagtaggtctagaatcaacctttgatgaacttggtgcatgttttgatgacaatcatgttggagttattggcttgtatgggatggggggtgtaggaaagacaaccctgctcaaaaagttcaataatgagttccttcccacagcattctatgatgtggtcgtttgggttgtggtgtctaaagaagcagatgtagggaatgttcaacaaagcatactggaaaaattaaaagttcccgatggtaaatgggttggtaaggccattaatgagagagctattgttttatacaacatcttgaaaaggaagaagtttgtgttgctgctagatgatttatgggagcgcatagatcttctgaagttggggattcctcttcctgatacgaacaacggatctaaagtgatattcacaacgcgatccatggaggtttgcaggtacatggaagccaacagatgtatcaaagtagaatgtttagcaccaaaggcagcatttgaattgttcaaagagaaagtgggtgaagaaactctcaactctcatcctgaaatatttcatttggctcaaattatggccaaggggtgtgagggacttccactggctcttatcactgttggaagacctatggctagaaagtctctccctgaatggaaacgagcaatacgaactttgaagaattatccatcaaaattttcaggtatggttaaagatgtctattgtttgcttgaatttagctatgacagtttgccaagtgccatacacaagtcttgtttcttgtactgttccatcttccctgaggactatgatattagagaagatgaactcattcaactgtggattggggaaggtctcttagctgaatttggtgatgatgtctacgaagcacgtaatcaaggagaagaaatcatagcaagcttgaagtttgcttgtttgttggaggacagcgagagagaaaacaggattaagatgcatgatgtgatcagagacatggctttgtggctagcatgtgatcatggatccaacaccaggtttttggtgaaagatggtgcaagcagcagttcagctgaagcatataatcctgcaaagtggaaagaagtagagatagtatcactctggggacctagcattcaaaccttctcaggaaaaccagattgctcaaatctctcaactatgattgtcagaaataccgagctaacaaactttcctaatgagatctttctgactgcaaacactcttggagtgttagacttgtcaggtaataaaagattaaaagaactacctgcaagtattggggagttagttaacttgcagcatttggatatatcaggtactgatatacaagaattgccaagggagctccagaaattgaaaaagttgaggtgcttgctgctaaattatatttgcaataggattgtcttcccgaggagtttgatatcaagtttgttgtcattgcaagtgtttagcaaattaccttgggaagatcaatgcattcttcctgacttaagggagcctgaggaaactgttttgttgcaagaattggaatgcttggaattccttcaagacataagcattgctctcttttgcttttcttctatgcaagtattacagaaatctcccaaattacaaagattcattagactgagagtaatttctcatttcaattcaatgccacatgttatattattctcattattgagaaaaatgcaacatctagaggttttgtccatatcaatttcttcatctccaagtttagtttctgacatgaaaaaggagtctccatcgcatgattctatgtctgagtgtattccaatgagttcgaagcttactgagcataattatactgttaatcttcgtgagttatcccttgaagggtgtggcatgttcaacttgaattggctcacttgtgctccaagccttcagctccttagattatacaattgtccctcattggaagaagtcataggtgaagaatttggacatgcagtaaatgttttttcgagtcttgaaattgttgatctagattctctaccaaagttaaggagcatatgctcacaagtattgcgatttccttgtctcaaggagatctgtgtggcagattgtccaaggctgctaaagctcccttttgattccagtagtgcaaggaacagtctgaagcacatcaatggacaaaaaaattggtggcgtaatttgaagtgggaagatgaagctacaagggatctctttcgttcaaaatatgtacctttccgtagtaaaattcgccgaaaaaattga

SEQ ID NO: 10518 - DNA, 3739 bp, Glycine max
gccatcatcatcatcatcaataacagcaccgtttccgtccacagaacctgttggcaatttgcgtggcgcacttaccgacatccactcgccgccgatctgctatgcttctcacgccaaacctctcacgtaccgataatttttagttgaagaaggttgttgtgtctgtcgcggtacttgagctgagctaggtttgtgttactctagttgacttgggaaattggaagtgttggtggtggccatgcggattcgactgaattggaatcatggttgcgtgggtttgctatttttgggactgttgggggtgaagtaaggttaattgattgtgattccgtgttgttgatttcgtactgtaactgaatttagttgtgtagtttgtgtttttgaccatggaagctaaatttggagctgaggcttatcatttttacggtgtgggtgcttcctcggatttgaggggtgtggggaagaggtcctcagagtgggatttgaatgattggagatgggatggtgatctgttcatcgctagccggctgaatccggtgccggccgatggtgttggagtgggacagcaatttttccctattgggtccgggatcccggtggccggaggcccctccaacagttcttccacctctgaggaagtagatcctagggatcccaaggcgaacaaggaaggggacaagaaaaggagagttattgtgctggaggatgatgggttgaatgaggaagggggtactcttagtttaaagcttggtggccatgcttctgcagtggtggatagggaagttgggagctgggacggtacgaatgggaagaaaagtagagtgtcgggaagtacttcaaatcgagctgtttgtcaggtggaggactgcagtgctgatctgagcaaagctaaggattatcacagacggcataaagtttgtgagatgcactccaaggccagtagggcgcttgtgggaaatgcaatgcagagattctgtcaacaatgtagtaggtttcacctacttcaagagtttgatgaaggaaagagaagctgccgaagacgcttggcagggcataataaacgaagaaggaaaacaaatcatgaagctgttcctaatggaagttcattaaatgatgatcagactagtagctatctgttgataagtttattgaagatactttcaaatatgcattctgacaggtcagatcagactacagatcaggatctactaactcatattctgaggagtcttgctagtcagaatggtgaacaagggggcaagaacatagctaaccttttgcgagaaccagagaatttgttgagagaagatggttcatcaaggaagtcagagatgatgtcaactttattctccaatggttctcaaggctctccatccaatataagacaacatgaaactgtatctatggctaaaatgcagcaacaagtgatgcatgcacatgatgctggggcttctgatcagcaaattacatcttctataaagcccagcatgtcaaacagtcctccggcctactcagaagccagagacagtaccgctggacagatcaagatgaataattttgatttgaatgacatatatattgactcagatgatggtatggaagatttagaaagattgcccgtctctacaaatcttgtgactagctctcttgattacccatgggcacaacaagattcccatcaatcaagtccacctcaaacaagtggaaattctgattctgcatctgcccagtctccttccagttccagtggagaagctcagagtcgcacagatcgaattgtttttaagctcttcggtaaagagccaaatgattttcctcttgtacttagagcacagattcttgactggttatctcacagtcctactgatatggagagctacatacggcctggttgtattgttttgaccatttatctgcgtcaggctgaggcgttgtgggaggaactttgctatgatctgacttccagtttgaataggctgttggatgtctcagatgatactttttggagaaatggatgggttcacatcagggtgcagcatcagatggccttcatttttaatggtcaagttgtcatagatacctccttacctttcagaagtaacaattatagcaagattttgactgttagtccaattgctgtaccagcatcaaagagagctcaattttctgttaagggtgtcaacctgatacgccctgccactaggttaatgtgtgctttagaagggaaatatctggtctgtgaagatgatcatatgtcaatggatcaatgctccaaagaacctgatgaacttcagtgcgtccagttttcatgttctgtccctgtgatgaatggaagaggatttattgagattgaggaccagggtttgagtagcagcttttttcctttcattgttgtggaggaggatgtttgctcagaaatctgtacacttgagcctcttctagaattaagtgaaactgatccagatattgaagggacaggaaaaatcaaagccaaaaatcaagccatggattttattcatgaaatgggttggcttcttcacagaagccagttgaaattaaggatggtttctagtgtggatctctttccattgaaacggttcaagtggcttattgagttttccatggatcatgattggtgtgcagcagtgagaaaactgttgaacctactgtttgatggaactgtaaatacaggagatcatccttccttgtatcttgcgctttcagagatgggtctccttcacaaagctgtaaggagaaatagcaagcatttagtggagttgcttttgagatatgttcctgagaatatttctgataaactaggacctgaagagaaggcactggttgatggagagaatcagaccttcttgtttagacctgatgttgatggtactgctggtttgacaccactccatatagcagccgggaaagatggttctgaggatgtacttgatgctttgactaatgatccttgcatggttggaattgaagcgtggaaaaatgctcgtgacagcacaggttcgacacctgaggattatgcccgtttacgtggccattatgcttacattcacttggtgcagaaaaaaattaacaagaaacaaggagcagctcatgtggtggttgagattccaagcaatatgacagagaacaatacaaacaagaagcaaaatgagttatccactatctttgagattggaaagcctgaagtaaggcgtggccaagggcactgtaagctttgtgacaacagaatttcttgcagaactgcagtaggcaggtctatggtatacagacctgcaatgctctcaatggtggcaatagcggcagtctgtgtctgtgtggcccttctgtttaaaagctcacctgaagtcatatgtatgttccgacccttcagatgggaaaatttggactttggaacaagctaaggttcattaacttgcaactcaataaaacttgataggtaatgtaaggatgcgttcatagactgaatgaccgagatttcctgtaggactggttctttgtattagcgaaactgtgcaattttatttgcgtatttgttatccttaaatggccatccttgtacaatgtatgtagatgcaactctacttcaaactttatttggctggatatttatattttagtgtaatacttgtgtggaatcttacactcttgtcttgactcttgattaaatgacgagttcgtttatatggtaattaaattgaaatattgaatgtcaaggtttgta

SEQ ID NO: 10519 - DNA, 3868 bp, Medicago truncatula
ccaaaacaaaaaacaacaataaaatatcatttcaaccgtaattcttcttcgtcatcatcatcaacaataacgccgtttccatccacagaacctcttgtccatttgcgtgccacacttgccgccgatctactttctttccaaccccacctctctgacgtacacctctctcagttcaacacttcccgttttcataaatttttacgtttttttttttggaaaagcttgttttttagtactactttgagctcagctagttttttctgttacataattgttgatttgtaaaattggaagagttcatgattagttgcttgtactgttgtacttgattatgtggattgctcttaattggaaccatggttgtgtccgtgtgctctttttggattgttggggatgaattaaggcttaatcactttgatttgtattttaattaattcattaattttgtttttaagctaaatttagggttaattatttgtgttgaggagtaataattagattgagataccttaattgtgaattgtgatcatgggggaaagattgggtgctgaaaattatcatttttatggtgttggtggttcatctgatttgagtgggatggggaagaggtcaagagagtggaatttgaatgattggagatgggatggtgatttgtttatagctagccgtgtgaatcaggtgcaggccgagagtttgcgagtgggacaacaatttttcccactcgggtctgggatcccggtggttggaggttcgtccaatacgtcttcttcatgctctgaggaaggagatcttgagaaagggaataaggaaggcgagaagaaaaggagagttattgtgctggaagatgatggtttgaatgataaagctggtgcactcagcttaaatcttgcaggacatgtttcaccggtggtggaaagggacggaaaaaagagtagaggagctggaggaacttcgaatcgagctgtttgtcaggttgaagactgtggtgcagatctgagtagaggcaaggattatcacagacgtcataaagtttgtgagatgcattctaaggctagtagggctcttgtgggaaatgcaatgcagaggttttgtcaacagtgtagtaggtttcacatacttgaagagttcgatgaaggaaagagaagctgtcgaagacgcttggctggccataacaaacgtagaaggaaaacaaatcaagaagctgttcctaatggaagtccaacaaatgatgatcagactagtagttatctgttgattagtttattgaagatactttcaaatatgcattctgacaggtcagatcagcctacagatcaggatctattaactcatcttctaaggagtcttgcaagtcagaatgatgaacaagggagcaagaacttgtcaaaccttttacgagaacaagagaatttgttgagagaagggggttcttcaagaaattcagggatggtatcagctttattctccaatggttctcaggggtctccaactgttataacacaacatcaacctgtatctatgaatcaaatgcaacaagaaatggtgcatacacatgatgttaggacctctgatcatcaactcatatcttcaataaagcccagcatttcaaacagtcctccggcttactcggaaacaagagatagtagtggacaaacaaagatgaataattttgatttgaatgacatatacgttgactcagatgatggcacagaagatctagaaagactgcccgtctctacaaatcttgctactagctctgttgactacccttggacacaacaagattctcatcagtcaagtccagctcaaacaagtggaaattcagattctgcatctgcccagtccccttctagttctagcggagaagcccagagtcgcacagaccgaattgtttttaaactcttcgggaaagagccaaatgaatttcctcttgtacttagagcacagattctagattggttatcccagagtcctactgatattgagagctacatacgccctggttgtattgttttgaccatatatctgcgtcaggctgaggctgtgtgggaggaactttgctgtgatctgacctccagtttgattaagctactggatgtctcagatgatacgttttggaaaactggatgggttcatatcagagtgcaacatcaaatggcattcattttcaatggtcaagttgtcatagatacatcactacctttccgaagcaacaattatagcaaaatttggactgttagtccaattgctgtaccggcatcaaagagagctcaattttctgttaaaggtgtcaacctgatgcgccctgccacaaggttaatgtgtgctttagaaggaaaatatctggtctgtgaagatgctcatgagtcaacggatcaatactccgaggagcttgatgaacttcagtgcatccaattttcatgttctgtacctgtgtcaaatggaagaggatttatcgagattgaggaccagggtttgagtagcagcttctttcctttcatagtggcagaagaggatgtttgcacagagatccgtgtgcttgaacctctactagaatcaagtgaaactgatccagatattgaagggactggaaaaattaaagccaaaagtcaagctatggatttcattcatgaaatgggctggcttcttcacagaagccaattgaaatataggatggttaacttgaactctggtgtagatctctttccattacaacggttcacgtggcttatggagttttcaatggaccatgattggtgtgcagtggtgaaaaaactgctgaacctactccttgatgaaactgtgaataaaggagatcaccctacattgtatcaagcactttcagagatgggtcttcttcacagagctgtaaggagaaatagcaaacagttagtggagctgcttttgcgatatgttcctgacaatacatctgatgaactaggacccgaagacaaggcgcttgttggtggaaagaatcatagctacttgtttagacctgatgctgttggtcctgccggtttgacaccacttcatatagcagcgggaaaagatggttccgaggatgtactggatgctctgactaatgatccttgcatggtgggaattgaggcatggaagaatgcccgtgacagtacaggctccacacctgaggattatgcgcgattacgtggccattatacttacattcacttagtgcagaaaaaaattaacaaaacacaaggagcagctcatgtggtggttgagattcccagcaatatgacagagagcaataaaaacccgaagcaaaatgagtcattcactagcttagagatcggaaaagctgaagtaagacgtagccaagggaactgtaaactttgtgatactaaaatttcttgtagaactgcagtaggaaggtctatggtatacagacctgcaatgctctctatggtggccatagcagcagtctgtgtttgtgtggctcttctgtttaagagctcacccgaagttctatacatgttccgacctttcagatgggaatcattggatttcggaacaagctaaggttctttgacttgcaactaataaaacttgataggtcatgtatggatgtgttcataaactaaatgaccgagatttaggactggttcttttctttgtattggctaaattgtgcaaatgctatttacatattattattatccttctatggacatacttgtacaatggatgtgaagacctcttttgttaaaactcaatttgttaggatccttcgtactgtaatatttggatataatattcagtggaatacctgcctttgaattatgactatgtcattaagaagagtaaaactaagtgaattaatttattagaacataacaattttggatgt

SEQ ID NO: 10520 - DNA, 3647 bp, Medicago truncatula
gtcacgcaaagaattcatcacattcattcactcattcatcttccatctccatcacacacacacacacacatcattttccttttccacccaaccgtacttcccgcactttcccaatttcactcgatccatccactcttcataattaacctcttcaattcaattcaactcaacttcttcttcttcttcttcaatctttaactgtaataatcttcaattctgtagttaacttatgcttaattagctcacttgttcattttacttaattttaattaactatggctgtgtcggtatactcttacttgatctataggtaacaagaacagagtatgtgtaattagttgtacttctttgtaattaagtttgcgaatcgtgtgattatggaagcttttcaattgtacggtaatggtggtggttcatctgatttaagggctatggggaaaaattcaaaagagtgggatttgaataattggaaatgggatagtcatcttttcatagctactagtaagttgactccggtgccggaacaccgccaatttttgcctattccggttggtggtggtggtggtggtggtggttctaactcaaatagttcatcatcttgttcagaacagttagatcttgggatttgtcaagtgaaggaaggtgagaggaaaaggagggttattgttgtcgaagatgaactaggtttaggtttgaataaggaaggtggtaatcttagtttaaaccttggtggtggtgttgctacatgggaaggaaataatgggaagaaaagtagagtagctggtggaggtagttctagtagagcattttgtcaggtggaggattgtcgcgcagatcttaacaacgcgaaagattatcaccgacgtcataaagtttgtgagatacattcaaaggctagtaaagcccttgtcggaaatgcgatgcagcggttctgccaacaatgtagtaggtttcacttgcttcaagagtttgatgaaggaaagagaagctgtcgaagacgtttggcaggccataataaaaggaggagaaaaacaaatcaagatgctgttcctaatggaagttcaccgaacgatgatcagactactgacaggtcaaatcagactgccgaccaggatctgcttactcatcttttaaggagtcttgctaatcagaatggcgaacaaggggggaggaacttgtctaaccttttacgggaacctgagaatctgttaaaagaagggtctttatcggggaagtctgagatggtttctactttagttaccaatggttctcaaggttctccaactgttacagtacagaatcaaacagtttctattagtgaaattcagcatcaagtgatgcattcacatgatgctagggttgctgatcaacaaaccacattttctgcaaagcccggtgtttcaaatagccctccagcttactcagaagcaagagatagtactgctggacagaccaagatgaatgattttgatctgaatgacatctatattgactcagacgatggcatagaggacatagaaaggttgcctgtcactacaaatcttggtgctagctctcttgattacccgtggatgcaacaggattcacatcagtcgagtccacctcaaacaagtggaaattcagattctgcatctgcccagtccccttctagttccactggcgaaactcagaatcgcacggatcggattgtttttaaactcttcggtaaaggaccgggcgattttcctcttgtacttaaagcacagattcttgattggttatcccacagtccaactgatattgaaggatatatacggcctggttgtgttgttttgactatttatctgcgtcaggctgaggttgtgtgggaggagctttgctttgatctgacttccagtttgaataggctcctgggtgtctcagatgatgatttttggagaactggatgggttcacatcagggtgcagcatcagatggccttcattttcaatggatctaactgcaccttttctgctgcaggccagattgtcatcgatacaccccttcctttcaggagtaataattatggtaagattttgagtgttagtccaattgctataccatcatcaaagacagctcaattttctgtgaagggtatcaacctgactcgccctgccacaaggttattgtgtgctttagaagggaattatttggactgtgaagatactgatgagcctatggatcaatgctccaaggatcttgatgagcttcagtgcatccaattttcatgttctgtccctgcgatgaatggacgagggtttattgagattgaggaccagggtttgagcagcagtttttttcctttcatagttgtggaggaggatgtttgctctgaaatctgtgtgcttgagcctttactggagtcaagtgatacttatccagataatgaaggggctggaaaaattcaagcaaaaaatcaagccatggatttcattcatgaaatgggttggcttctccacagaaggcagataaaatctagcgttcgtttgaattctagtatggatctgtttccattagatcgattcaagtggctcatggagttctctgtggaccatgattggtgtgcagtagttaaaaagctattgaacctcatgcttgatggaacagtgagtacaggagaccacacatccctgtatcttgcactttcagagttgggtctccttcacagagctgtgaggagaaatagcaggcagttggtggagcttcttttgagatttgttcctcaaaatatttcagataaactaggacctgaagacaaggcgctggttaatggagagaatcaaaacttcttgtttagacctgatgctgtgggtcctgctggtttgacaccgcttcatatagcagccgggaaagatggttctgaggatgtactagatgctttgactaatgatccttgcatggtgggaattgaagcatggaatagtgctcgcgacagcacagggtcaacacctgaggattatgcacgattacgtggtcattatacttacattcatttggtgcaaaagaaaatcaacaagagccaaggaggggctcacgtggtggttgatattcctagcattccgacaaagttcgacacaagccagaagaaagatgaatcgtgcactacctttcagattggaaatgctgaagttaaaaaggttcgaaaggactgcaaactttgtgatcataagctgtcgtgtagaactgctgtacgaaagtctttcgtatacagacctgcaatgctgtcaatggtggctatagcagcggtctgtgtctgtgtggctcttctattcaaaagctcgccggaagttctgtatatattccgacctttcaggtgggaatctttggattatggaacaagctgatacttgtcaacctacaaggctacaacgtaaatttgacggacaatttaatagtatgcgttcatatactggctaaactgggtatttttattttttttactaaagctaaaaactataatggtttttacatatttattgttgataagcttccttgtgagactgcatgtgtggatttgcttgtattgtattctcaaactacatttgtttaaatccttgttgttgttgtacaatagcataatacgtgtatgctgcagtgcagccttctcttttataatgagtttattcatc

SEQ ID NO: 10521 - DNA, 336 bp, Glycine max; identical to SEQ ID NO: 10508

SEQ ID NO: 10522 - DNA, 1977 bp, Medicago truncatula
atgggtaggaaagaaagaaggagaaggaaatcggatgattctgcatccgagtcaacttcttcgcaatccaatgattccgatagaagccggagaagcggtcaccgtagtgatcggcagtcacgtcggagacggagccgacatgaatcagactcggataattctacttctgatgataatagtagtgatagggatgggaggaagagaaagtcctcaaggaaaattactgaagaggaaatagctcagtatttggcgaaaaaggcgcagagaaaggcgttgaaagttgctaagaaattgaaagctcatactgtgtctggatattcaaatgactcgaatccatttggtgattccaatcttaatgagaagtttgtttggcgtaagaagattgagcgtgatgttgttcaaggtgtgcctattgatgagttttcagttaaagctgagaaaaagagacagagagaaaggatggcggaaattgaaaaggtgaaaaaacgaagagaagagagggcacttgagaaagcacgacatgaggaagaaatggcattgttagctagagaacgtgctcgagctgagttccaggactgggaaaaaagagaagtggagtttcattttgatcaaagcaagtttaggtctgaaattagattgcgtgaaggacgtgccaagccaattgatatccttaccaaacatcttgatggctctgatgatttggatatagaaataaatgaaccatacatggtcttcaagggtttgacagtgaacgaaatggaagagctccgtgatgatatcaaaatgcatttggactttgacagggccacgccaacccatgtagaatattgggaggcactccttctggtgagtgattgggagttagctgaagctagaaaaaaagatgcaattgatcgagctagggtgcgtggagaagaacctccagctgaggtgcttgctgaacagagaggtctgcataacagtgttgaaccagatgtgaagaagcttttgcaggggaagacacatgcagaattggaagctttgcaggcgcatattgagtcagaaatgcgtactggtgcagcaaagcttgttgagtactgggagactgttttaaagtacctccgcatatataaagccaaggcttgtttaaaggaaatccatgccaaaatgttacgcaagcatttgctacgccttaagaaaccattagagggtgaagataaattggaagatgctcatgttatgaaatctgaggaggatattgaggattatgttaaattccaatatgcaaatagatcactttctcccgaacccattaaagcagagggtcaagaaggtgaagaagtagaagatgaggctgggtccttgtcaccagaactgtttcatggtgatgaaaatgaggaagctattgaccctgaagaggacagagctctactggaacaaaaacgtttggctgtaaaggaagagcagcagagacgaattcaggaagcaatggcatccaagcctgctccatctgaagataattttgagatgaaagccatgaatgctatgggagctattgaagaaggagatgtaatgtttggctctggtgcagaagtaaatctggattcacaggtctattggtggcatgacaaatacaggcccaggaaaccaaagtatttcaaccgtgttcatactggatatgagtggaacaaatataatcagactcactatgatcatgacaatccacctccaaaggttgtacaagggtataaatttaatatattctacccagaccttgtagacaagacaaaagctccaacttacactattgagaaggacggcagcaatggcgagacttgcatcataagattccatgcagggccaccatacgaagacattgctttccgcattgtaaacaaagaatgggaatattctcacaagaaaggttttaagtgcacatttgaacgtggaattctacatgtatacttcaatttcaaacgccaccgctaccgcagataa

SEQ ID NO: 10523 - DNA, 2554 bp, Glycine max
ggaagattgaagagtttgtagaggtttggaattaacagggccgacataacacagttatcctctctctgagttttggttagagaatggggaagagtagcggaagagaccgaagacgaagaaggtcagatgactctgaatccgaatcaccttcggattctgactccgacagacgccgcggtagcagtagtcgccgctcgcggcgggactccgacggcgacaggaagaagaagtccacgaagtctgaatccgagtcacattccgattccgactccgactccgacagacgccaccgtagcagcagccgccggcctcggcgggactctgacggcgataggaagaagaagtcctcgaggagcatcacagaagaggaaattacgcagtacatgaccaaaaaggcccaatcgaaggcaatgaaagtcgcaaaaaagttgaaaaccagtacggtgtcgggctattccaacgattcgaatccgtttggtgactccaatctcaacgagaagtttgtttggcggaagaagattgagcgcgatgtttcacaaggtgtgtctattgaagcgttttcaaagaaggcagagaaaaagaaacagagagaaaggatggcagaaattgaaaaagtaaaaaagagaagagaggaaagggcacttgagaaagcacgacacgaggaagaaatggcactgttagctagagagcgtgctcgagctgagtttcaggactgggaaaaaaaagaagaggagtttcattttgatcaaagcaaagttaggtcagaaattagattgcgtgaagggcgtgccagaccaattgatgtcctaaccaagcatctcaatggctctgatgatttggatatagaaataaatgaaccatacatggttttcaagggtttgactgtgaacgaaatgagtgagctacgtgacgacatcaaaatgcatctagaccttgacagggcaacaccaactcatgtagaatattgggaggcactccttctggtatgtgattgggagctagctgaagcccaaagaaaggatgcacttgatcgagctagggtgcgtggagaagaacctcctgctgagctgcttgcagaagaaaggggtctgcattccagtgttgagccagatgtgaagaagcttttgcaggggaagacacatgcagagttggaggctttacgggttcacattgaatcagaaatgcgtactggtacagcaaaggtggttgagtactgggaggccattttaaaacatctccacatttataaggccaaggcttgtttaaaggaaattcatgctaaattgctacgtaagcatttgcaatctcttgagagaccattggaggatgaagataaattagagaatgctcatgttatggtacctgaggaggaagatactgaggatgatattaaagtccgatctgcagatgaatcattctcaccagagcccattagagaggatcaagaagctgatgatgaggctggatcattttcaccacaattgttgcacagtgatgaaaatgaggaagctattgacccagaagaagatagagctatgctggagcggaatcgtaaggctgtattagaagagcagcaaagacgagttcaggaagcaatggcatcaaagccagctccttctgaagataattttgagatgaaggccttaaaagctatgggggatatggaagatggagattctgtgtttggatctggtgctgaagttaacctggattcccaggtttattggtggcatgacaaatacagacctaggaagccgaagtatttcaaccgtgttcacactggatatgagtggaacaaatataatcagactcactatgatcatgacaacccacctccaaagattgtccaaggttacaaatttaatattttctatcctgatcttgtagacaagacaaaagctccaacctacaccattgagaaggatggcagcaacggggagacttgcattataagattccatgctgggccaccatacgaagacatagctttccggatcgttaacaaagaatgggaatattctcataagaaaggttttaagtgtacatttgaacgtggaattctgcacgtgtacttcaatttcaaacgccatcgctaccgaagataattttacacaagacaatggttcactttctgtaaaattccttctaatagaaaggctatgtggctctgccattttaagagtaaattttattcgatggtgttgacactagagatagatggccaggaaatttacaggttagattgagaccaagaagaaattataaggtactatcagagtgatactccaaccggttacagtttgatctaaatcttgtcatgatattttaaatttatgctgttctcatctgctgattatgtttttaatggattgagtgtagtactcctgtgcataagaatatggagaccaagggtctttccaaatgccgagatactaattacatgtcttttctttttttagtgtacacactaatcacaattctgtgaccctgtttggattatctacgctttcttttattattggagaatgtcaaattgtccaactgtttctttagc

SEQ ID NO: 10524 - DNA, 2389 bp, Glycine max
cgcgtgggaagattgaatgaagagtttgtggaggtttggaactaacagggccgacataacacagttctcctttctctgaatttttcgttagagaatggggaagagtagcggaagagaccgaagacgaagaagatcacatgactctgaatccgactcaccttccgattccgactccgacagacgccaccgtagcaatagtcgccggtcgcggcgggactccgatggcgacaggaagaagaagtcctcgaagtctgaatccgagtcgccttccgattccgactccgacatacgccaccgtagtagcagccgccggtcgtggcgggactccgacggcgataggaagaagtcctcgaggagcatcacagaagaggaaattacaaagtacatggccagaaaggcccaatcgaaggcaatgaaagtagcgaaaaagttgaaaaccagtacggtatcgggctattccaacgattcgaatccgtttggtgactctaatctcaacgagaagtttgtctggcgcaagaagattgagcgcgatgtttcacaaggtgtgtctattgatgcgttttcaatgaaggcagagaaaaagaaacagagagaaaggatggcagaaattgaaaaagtaaaaaagagaagagaggaaagggcacttgagaaagcaaggcacgaggaagaaatggcactgttagccagagagcgtgctcgagctgagtttcaggactgggaaaaaaaagaagaggagtttcattttgatcaaagcaaagttaggtcagaaattagattgcgtgaagggcgtgccagacccatcgatgtcctaaccaagcatctcaatggctctgatgatttggatatagaaataaatgaaccatacatggtcttcaagggtttgactgtgaacgaaatgagtgagctacgtgacgacatcaaaatgcatctagaccttgacagggcaacaccaactcatgtagaatattgggaggcactccttctggtttgtgattgggagctagctgaagctcaaagaaaggatgcacttgatcgagctagggtgcgtggagaagaacctcctgctgagctgcttgcagaagaaaggggtctgcattccagtgttgagccagatgtgaagaggcttttgcaggggaagacacttgcagagttggaggctttacgggttcacattgaatcagaaatgcgtactggtacagcaaaggtggttgagtactgggaggccattttaaaacatctccacatttataaggccaaggcttgtttaaaggaaattcatgctaaattgctacgtaagcatttgcaatctcttgagagaccattggaggatgaagataaattggagaatgctcatgttatgatacctgaggaggaagatactgaagatgatattaaagtccaatctgcagatgaatcattctcaccagagcccattagagaggatcaagaagctgatgatgaggctggatcattttcaccacaactgttgcacggtgatgaaaatgcggaagctattgacccagaagaagatagagccatgctggagcggaatcgtaaggctgtattagaagagcagcaaagacgagttcaggaagcaatggcatcaaagccaactccttctgaagatcattttgagatgaaggccttaaaagctatgggggatatggaagatggagactctgtgtttggatctggtgctgaagtgaatctggattcccaggtttattggtggcatgacaaatacaggcctaggaagccgaagtatttcaaccgtgttcacactggatatgagtggaacaaatataatcagactcactatgatcatgacaacccacctccaaagatagtccaagggtacaaatttaatattttctaccctgatcttgtagacaagacaaaagccccaacctacaccattgagaaggatggcagcaatggggagacttgcattataagattccacgcagggccaccatatgaagacatagctttccgcattgttaacaaagaatgggagtattctcataagaaaggttttaagtgtgcatttgaacgtggaattctgcatgtgtacttcaatttcaaacgccaccgctaccgaagataatttcacacaaggcaatggttcactttctgtaaaatttcccctaatagaaaggctatggactgcaatttttagagtaaattttatttgatggtgttgacactagagatagatggccaggaattttttacagcttagattgagaccaagaagaaattctaaggtactatcagagtgatactcccaccggttaaagtttgatctaaatcttgtcatatgatattttaaatttagttttaaggagatagtatggttatgctgttctcatctactgattatgttttt

SEQ ID NO: 10525 - DNA, 2013 bp, Medicago truncatula
atggcgagcggtagtagtagtagaaaatctcgaagacgaagaagatccgatgatgactctgcatctgactccgactccgaccaccgccggaaaactagtcgccggtcacgccgagattcagatgatgattcaagtgacgacaacgttaatagaactggaagaaagaagaaatcttccagaacaatcacagaagaggaaatttcacagtatatggctaaaaaagctcagagaaaggctacgaaagttgctaagaaattgaagacgaatacagtatcgggttattccaatgattctaatccgtttggtgatactaatctcaatgaaaagtttgtttggcgtaagaagattgagcgcgatgttactcaaggtgtatcgattgattccttttctgttaaagctgagaagaaaagacaagtggaaaggatggcagaaattgaaaaggtgaaaaagaggagagaggaaagggcacttgagaaagcacaacatgaagaagaaatggcattgttagctagagaacgtgctcgagctgagttccaggactgggaaaaaaaggaagaggagttccattttgatcaaagcaaagtcaggtcagagattagattgcgtgaagggcgtgccaggccaattgatgtcctaaccaagcacctcaatggctctgatgatttggatatagaaataaatgaaccatatatggtcttcaagggtttgacggttaaagaaatgagtgaacttcgtgacgacatcaaaatgcatcttgatcttgatagggcaacaccaacccatgtggaatattgggaggctctccttgtggtgtgcgattgggagctagctgaatctcgaaaaaaggatgcaattgatcgagctagggtgcgtggagaagaacctcctgctgagctgcttgctgaacaaaggggtctgcattccagtgttgagccagatgtgaaggaccttttacatggaaagacacgtacagagttggaagccttacaggctcacattgagtcagagatgcgtactggtacagcaaaggtggttgagtactgggaggccattttaaaacacctccacatatacaaggccaaggcttgtttaaaggagatccatgctaaaatgttacgtaagcatttgcaacgtcttgagcaaccattggaggatgaagataaaccggagcgtgctcttgacatgatacctgaggaggcatatactgaggatgaggaggatgaggatgctaaagtagtccgttctgcagatgaatcgttttcaccagagcccgttagagagaatcaagaagctgaagatgaggctggatcattttcaccacaactgttgcatgatgatgaaaatgaggaagctattgatcctgaagaggacaaagctatactggagcggaaacgtatggctgtaatggaagagcagcaaagacggattcaggaagcaatggcatcaaagccagctccatctgaagataatttagagttgaaagcctttaaagctatgggagctatggaggatggagacgcagtgtttggatctggagctgaagtgagccttgattcacaggtttattggtggcatgacaagtacagaccaaggaagccaaagtatttcaaccgcgttcacactggatatgagtggaacaaatataaccagactcactatgatcatgacaacccacctccaaagattgtgcaagggtacaaatttaatattttctatcccgatcttgtagacaagataaaagccccaaactacactatagagaaagacggcagcaatggggagacatgcattattagattccatgcaggaccaccatatgaagatatagctttccgcattgtaaacaaagaatgggaatactctcacaagaaaggttttaaatgcacatttgaacgtggaattctgcacgtgtacttcaatttcaaacgccaccgctaccgccgataatttcatatcaggcaatggttcactttctgtttagcttctccttttgatttgagcgaagctgtaact

SEQ ID NO: 10526 - DNA, 2265 bp, Vitis vinifera
atgggaacgcacggtagcagcagtaggagaaagaagagtcgaagaagatccgacgattccgacgattctgatacccctgactcctcgccggataggtcctccaccaaacgaagagaacgcagccgcagcagtcgccgccggagctcttcgcgacatttggatgattccgatagcagtggaaaaagtgatggtggcggaaagaagaggtcctccagaaacattaccgaagaggaaattgctgactatttggccaaaaaagctcagaaaaaagcgttgcgagttgctaagaagttgaagtcgcagaccgtttccgggtattccaatgattcaaatccatttggtgatgccaatctcaatgaaaaatttgtgtggcgaaagaagattgaacgtgatgtttctcaaggtgttccacttgacacgttttcagtaaaggccgagaaaaaaagacagagagaaaggatggcagagattgaaaaggtgaaaaagagaagggaggaaagggcaattgaaaaggcacaacatgaggaagaaatggcattgcttgctagagaacgtgctcgggctgagttccaagattgggagaagaaagaagaagagttccattttgatcaaagcaaagtcagatcagatattagattgcgcgaagggcgtttaaagcctattgatattctctccaatctgctcaatggctcagatgattttgatatggatataagcgaaccatatatggtcttcaagggtttgacagtaaaagaaatggaagaactccgtgatgacctcaaaatgcatctagatatggacagggcaacaccaacacatatagagtattgggaggcactcttggtggtttgtgattgggaactagctgaagctcgaaaaaaagatgcattggatcgagctagggtgcggggggaggaaccacctgccgagttgcttgctgaagaaaggggtctgcattcaagtattgaagcagatgtcaagaatcttctgcaagggaaaacatacagtgagttggaggtattgcaatcacatattgagtcacaaatgcgttctggcacagcaaaagtggtagagtactgggaggctgttctaaaacgcctccatatatacaaggcaaaggcttgcttgaaggaaattcatgccaaaatgctacacaagcatcttcaatatcttgagcctcattcagagagtgaagatgaattagaagcagaacctggtccagagcctaaagtggaggatagcatccaagatctagaagatgctcaaacattctctccagaacccattttgcatgaagaggctcatgaagcagaagaagaggctggttcattttcaccagagctgttgcatggtgacgaaaatgaagaagcaattgatcctgaagaggatagagctatactggaacggaaacgcattgcagtgttagaagaacagcaaaaacggattcaagaagcaatggcttcaaaaccaactccatctgaagacaacttggagctgaaggtcatgaaagctatgggagccatggaagaaggtgatgcagtatttggctctggtgctgaagtaaacctggactctcaggtgtactggtggcatgacaagtaccgacctaggaagccaaagtacttcaaccgtgttcatactggatatgagtggaacaaatacaatcaaactcactatgatcatgataacccacctccaaagattgtgcaaggatacaaattcaatattttctacccagacctggtggacaagacgaaggctccagtttataccattgagaaggatgggagcagtggggagacgtgcctgattagatttcacgctgggccaccctatgaagatattgcattccggattgtgaataaagaatgggaatattctcataagaaggggtttaagtgcacattcgaacggggtattttgcatgtttatttcaacttcaagcgctaccgataccgcaggtgagacgtgggtctgtggttttgagacccatcttttttcccacactaaatttgcaattgccccatggagggaactgaggattgtgaaagagttcttccaacttattggaggcgacctggaacttgccccatgtagttgtgctggatgaaaaaaggtttgcctactttctcgagttgtccttaattatactcagtatagtgtagactcgtgtactttattaatattgaaaaaataatattcagcatgatatagactcgtgtattctgttaatattgaaaaaaaaactaatattgataactaaaa

SEQ ID NO: 10527 - DNA, 1896 bp, Glycine max
atgtcctgtttccaatcaccggacgttgattggcaccgtcgtcttcatttcgcagccatcttctgcgccacaggtacctcggagagacgccggagagacggtcacctcggccaccgtcgattgtggcggggacggagcaggcaggactcagatagttcctctgatgagagtagtgataggggtggcaagaggaagaggtcctccaggcacgtcactgaagaggaaatagcacagtacttggccaaaaaggctcagaggaaggcattgaaagatgctaagaaactgaagactcgtaccgtgtcagggtattcgaatgactcaaatccatttggtgactccaatcttaacgagaagtttgtttggcggaagaagattgagcttgatgtcgttcaaggtgtgcctattgatgcattttcagttaaagctgaaaaaaagagacagaaagaaaggatggcagaaattgaaaaagtgaaaaaaagaagagaagaaagggcacttgagaaagcacgacatgaagaagaaatggcactgttagctagagaacgtgcacgagctgagttccacgactggcaaaaaagagaagaggagtttcattttgatcaaagcaaggttagatctgagattagattgcgtgaagggcgtgctaggccgattgatatcctaaccaagcacctcaatggatctgatgatttggatatagaaataaatgaaccatacatggtgttcaagggcttgacagtaaaggaaatggaagaacttcatgatgacatcaaaatgcatctggaccttgacagggacacacccacccatgtagaatattgggaggcactccttctggtttgtgattgggagctagctgaagctcgaaaaaaggatgcaattgatcgagctagggtgcgtggtgaagaacctcccgcagatctgcttgcagaagaaaggggtctgcattacagtgttgagccagatgtgaagaatcttttgcaggggaaaacacatgcagaattggaagcttatcaggtgcatacagagtcagagatgcgtactggtacagcaaaagtggttgagtactgggaggcagttttaaaacacctccacatatataaggccaaggcttgtttaaaggaaattcatgccaagatgttatgcaagcacttgcaacgccctgaacaaccattggaggatgaagatgaattggaagatgctcaagttagaaactctgaggacgatactgagcactatgctaaaggtataatccaatatgcagatgaatcattttcaccagaacccattaaaggagaagttcaagaagccaaagatcaggctggctcattttcaccggaactgtttcatggtgatgaaaatgaggaagctattgaccctgaagaggatcgagctctactggagcagaaacgcatggctgtaaaggaagagcagcaaagacaaattcaggaagcaatggcatcaaagcctgctccatctgaagataattttgagatgaaggccatgaaagctatgggagctatggaagatggggacgcagtgtttggctctggtgctgaagtgaatctagattcagaggtttattggtggcatgacaaatacagagccaggaagccgaagtatttcaaccgtgttcacactggatatgaatggaataaatacaatcagactcactacgatcatgacaatccacctccaaaggttgtacaagggtataaatttaacatcttctacccagatcttgtagacaagacaaaagctccaacttacactattgagaaggatggcagcaatggtgagacttgcatcataagatttcatgcagggccaccatacgaagacattacactggcttacattctggttttctctcctaccggttggcttccattttga

SEQ ID NO: 10528 - DNA, 1203 bp, Glycine max
actccttctggtcactcttgggagaagaggtcgagtttcacagcagcaatggtgtacgtcaaggctcagaaatcaaaagcctacttcaagagatatcaagtcaagttcaagagaagaagagagggaaaaaccgattaccgtgccaggattcggttgattaatcaggacaagaacaaatataacactccgaaataccgatttgttgttcgctttagcaacaaggacattgttgcacaaataatatctgctagcattgctggcgatattgttcttgctgcagcatatgcacatgagctgccacgatatggtcttgaagtagggcttacaaattatgctgcagcttattgcactggtctcctgttggcccgaagagtcctcaaaacacttgaaatggatgaggagtatgaaggaaatgttgaggctactggagaggattattccgtggaacctgctgagagcaggaggccattccgtgctctccttgatgttggtcttattaggactacaaccggtaaccgtgtgtttggtgcccttaagggagctctggatggggggttggatattcctcacagtgacaagaggtttgctgggtttgataaggagaagaaggagcttgatgcagaggttcatcggaaatatgtttttggtggacatgttgctgcctatatgaagatcttggcggaagatgaaccagagaaataccagtcacacttcagtgaatacatcaagcgtgggatagaagctgatggtattgaggcactgtataaaaatgttcatgctgccatccgggctgatcctactctcaagaaatctgataagcagaccccgaaggagcacaagaggtacaacttaaagaagctgacatatgaggagaggaaggctaagttgatttcacgtgtggcagctctcaactctgctgctgataatgatgaagatgatgagtgaaagttcattgcagatgccttctcatggctacactagtagaaactatcttatttggtatctacagaatcattttcttgaaaatttatttgcctgcctgtttatttctaggcccaaaatttggatactttttttggagttgagtaagccttaattttggtcaatttcgggttagtttgaatttgaagttttaccttgtttttatggttcactactttcactcgagcaatgttcgtataaaatcagtttttgttaacgtaa

SEQ ID NO: 10529 - DNA, 1244 bp, Glycine max
cactcctttccgtcacttttggggaagaggtcgagtttcacagcagcaatggtgtacgtcaaggctcagaaatcaaaagcctacttcaagagatatcaagtcaagttcaagagaagaagagagggaaaaaccgattaccgtgccaggattcggttgattaatcaggacaagaacaaatataacactccgaaataccgatttgttgttcgctttagcaacaaggacattgttgcacaaataatatctgctagcattgctggcgatattgttcttgctgcagcatatgcacatgagctgccacaatatggtcttgaagtagggcttacaaattatgctgcagcttattgcactggtctcctgttggcccgaagagtcctcaatacacttgaaatggatgaggagtatgaaggaaatgttgaggctactggagaggattattccgtggaacctgctgagagcaggaggccattccgtgctctccttgatgttggtcttattaggactacaaccggtaaccgtgtgtttggtgcccttaagggagctctggatggggggttggatattcctcacagtgataagaggtttgctgggtttgataaggaaaagaaggagcttgatgctgaggttcatcgcaaatatgtttttggtggacatgttgctgcctatatgaagatcttggctgaagatgaaccagagaaataccagtcacacttcagtgaatacatcaagcgtgggatagaagctgatggtattgaggcactgtataagaaggttcatgccgccattcgtgctgatcctactcttaagaaatctgataagcagcccccgaaggagcacaagaggtacaacttgaagaagctgacttatgaggagaggaaggctaagttgattgcacgtgtggcgtctctcaactctgctgctgataacgatgaagatgatgagtgaaagttcattcaagattccgtatcatcgttgcacaactagaaactatcttattttgcgtctagggaatcattttcttgaaaatttatttacatgtactgtttattttctaggtccgaaattttggatactatttttgaagttggagtagccgttttttttgtcagtttcgtgttagcctgaattgatgttttaccatactttgatgacatacgctttatttctagcaggaagtgttttggttttacgaacggttgccctttttttttatcggcaattaaaaaatatacagctataatttt

SEQ ID NO: 10530 - DNA, 1234 bp, Glycine max
accccaaagagactcaggcgctgctgcccttcagtccttcagcaatggtttacgtgaagtcacagaaatcaaaagcctacttcaagaggtatcaagtcaagttcaagagaagaagagagggaaaaaccgattaccgtgccaggattcggttgattaatcaggacaagaacaaatataacaccccgaaatatcgctttgttgttcgtttcagcaacaaagacattgttgcacaaataatatctgctagcattgctggcgatattgttcttgctgcagcatatgcacatgagctgccacgatatggtcttgaagtagggcttacaaattatgctgcagcttattgcactggtctcctgttggcccgaagagtcctcaaaacacttgaaatggatgaggagtacgaaggaaatgttgaggctactggagaggactattcagtggaacctgctgagagcaggaggccattccgtgctctccttgatgttggtcttattaggactacaactggcaaccgtgtctttggtgcccttaagggagctctggatgggggtttggatattcctcatagtgacaagaggtttgctgggtttgataaggagaagaaggagcttgatgctgaggtgcatcgcaaatatgtttttggtggacatgttgctgcctatatgaagatcttggcggaagatgaacctgagaaatatcagtcacacttcagtgaatacatcaagcgtggaatagaagctgatggtattgaggcactgtacaagaaggttcatgctgccatccgtgctgatccttctctcaagaaatctgagaagcagcccccgaaggaacacaagaggtacaatctgaagaaactcacttatgaggagaggaaggctaagttgattgctcgtgtggcggctatcaactctgctgctgataatgatgaagatgatgagtgaaagttcattgcagattccatgtcatcgttgcacaactaaaactctcttattttgcgttcagtcaatcattttatttacatgtgctgtttattttctaggtccaaaattttggatactttttgaagttgagtaagccgtatttttggtcaatttcgtgtcaacatgaattgatgtcttaccttattttatgatatacgctttgtttctagcaggaagttgtttagtttaacgaactgtgcttgttttttttttcgacaatgaaagaatgtaccactttaatttgttaggttaaa

SEQ ID NO: 10531 - DNA, 1310 bp, Glycine max
gagtatccagcagcaatggtgtacgtcaaggctcagaaatcaaaagcctacttcaagagatatcaagtcaagttcaagagaagaagagagggaaaaaccgattaccgtgccaggattcggttgattaatcaggacaagaacaaatataacactccgaaataccgatttgtggttcgctttagcaacaaggacattgttgcacaaataatatctgctagcattgccggcgatttagttcttgctacagcatattcacatgagctgccacgatatggtcttgaagtaggacttacaaattatgcagcagcttattgcactggtctcctgttggcccgaagagtcctcaaaacacttgaaatggatgaggagtatgaaggaaatgttgaggctactggagaggattattcagtggaacctgccgagagcaggaggccattccgtgcactccttgatgttggtcttgttaggactacaacaggaaatcgcgtctttggtgcccttaagggagctctggatgggggtttggatattcctcacagcgacaagaggtttgctgggtttgataaggagaagaaggagcttgatgctgaggttcatcgcaaatatgtttttggtggacatgttgctgcctatatgaagatcttggcagaagatgaaccagagaaataccagtcacacttcagcgaatacatcaaacgtgggatagaggctgatggtattgaggcactttacaagaaggttcatgctgccatccgtgctgatcctactctcaggaaatctgataagcagcccccgaaggagcacaagaggtacaacatgaagaagctgacttatgaggagaggaaggctaagttggttgcacgcgtggcagccatcaactctgctgctgataatgatgaagatgatgagtgaaagttcattgcggatgctgtctcatagctgcacaagtagaaactatgttatttgcctgtactgtttattttctatgtccaaaatttggatactttttggagttgagagccttatttttggtcaattttgtgttaagcttgaattaatgttttaccttatttttatgattcactatacccaagtaatgttcgtataaaatcaggttttgttaacgtttgatcataagttgtctggtaaatggtaactagtatgcgccgttgccgttgttaaatcgagtaaattcatttatgtagcactaccaagagaaaagttcaattggagtgtgtagttacagtgtatcagtgacaattgaagtggatttatgaaatgtgagttaaaaagttgttatgtctttgtag

SEQ ID NO: 10532 - DNA, 1312 bp, Glycine max
gcaaaggctaaccctaaattgcgctgtctctcgtcactatcgggagaagtaatcgagcttcagcaatggtgtacgtcaaggctcagaaatcaaaagcctacttcaagagatatcaagtcaagttcaagagaagaagagagggaaaaaccgattaccgtgccaggattcggttgattaatcaggacaagaacaaatataacactccgaaataccgatttgtggttcgctttagcaacaaggacattgttgcacaaataatatctgctagcattgccggcgatttagttcttgctacagcatattcacatgagctgccacgatatggtcttgaagtaggacttacaaattatgcagcagcttattgcactggtctcctgttggcccgaagagtcctcaaaacacttgaaatggatgaggagtatgaaggaaatgttgaggctactggagaggattattcagtggaacctgccgagagcaggaggccattccgtgcactccttgatgttggtcttgttaggactacaacaggaaatcgcgtctttggtgcccttaagggagctctggatgggggtttggatattcctcacagcgacaagaggtttgctgggtttgataaggagaagaaggagcttgatgctgaggttcatcgcaaatatgtttttggtggacatgttgctgcctatatgaagatcttggcagaagatgaaccagagaaataccagtcacacttcagcgaatacatcaaacgtgggatagaggctgatggtattgaggcactttacaagaaggttcatgctgccatccgtgctgatcctactctcaggaaatctgataaggagcccccgaaggagcacaagaggtacaacatgaagaagctgacttatgaggaaaggaaggctaagttgattgcacgcgtggcggctatcaactctgctgctgatagtgatgaagatgatgagtgaaagttcattgcagatgctgtcccatagcctgcccaagtagaaactatcttattttgtgtccatgaatcattttctttaaaatctatttgcctgtgctgtttattttcttggtccaaatttttttctatatatgcttttgccttccagaaaaaataaattctaggtccaaaatttgtatactttttggaattgagtaggtcttatttttggtcagctttgtgttagcttaaattgatgttttaccttataaaatcagtttttgttaacctgaggtgtgatcgtaatttgtgattgtctggtattttctctagtctcaagtataagaagaagaaaaaaatacatttttcttt

SEQ ID NO: 10533 - DNA, 1174 bp, Glycine max
tttttttttttttttttttgctagaaacaaagcgtatatcataaaataaggtaagacatcaattcatgttgacacgaaattgaccaaaaatacggcttactcaacttcaaaaagtatccaaaattttggacctagaaaataaacagcacatgtaaataaaatgattgactgaacgcaaaataagagagttttagttgtgcaacgatgacatggaatctgcaatgaactttcactcatcatcttcatcattatcagcagcagagttgatagccgccacacgagcaatcaacttagccttcctctcctcataagtgagtttcttcagattgtacctcttgtgttccttcgggggctgcttctcagatttcttgagagaaggatcagcacggatggcagcatgaaccttcttgtacagtgcctcaataccatcagcttctattccacgcttgatgtattcactgaagtgtgactgatatttctcaggttcatcttccgccaagatcttcatataggcagcaacatgtccaccaaaaacatatttgcgatgcacctcagcatcaagctccttcttctccttatcaaacccagcaaacctcttgtcactatgaggaatatccaaacccccatccagagctcccttaagggcaccaaagacacggttgccagttgtagtcctaataagaccaacatcaaggagagcacggaatggcctcctgctctcaacaggttccactgaatagtcctctccagtagcctcaacatttccttcgtactcctcatccatttcaagtgttttgaggactcttcgggccaacaggagaccagtgcaataagctgcagcataatttgtaagccctacttcaagaccatatcgtggcagctcatgtgcatatgctgcagcaagaacaatatcgccagcaatgctagcagatattatttgtgcaacaatgtctttgttgctgaaacgaacaacaaagcgatatttcggggtgttatatttgttcttgtcctgattaatcaaccgaatcctggcacggtaatcggtttttccctctcttcttctcttgaacttgactcgatacctcttgaagtaggcttttgatttccgtgacttcacgtaaaccattgctgaaggactgaagggcagcagcgcctgagtctctttggggtttcc

SEQ ID NO: 10534 - DNA, 1144 bp, Medicago truncatula
gactcttcccatcaactcttgcggatccagctgcgtctgcaacaatggtttatgttaaggctcagaaatccaaggcttacttcaagcgttaccaagtcaagttcaagagaagaagagaggggaagactgattatcgtgctcgtattcgcctgattaaccaggataagaacaagtacaacacccccaagtaccgatttgttgtccgatttaccaacaaggacatagtggcacaaatagtgtctgctagtattgctggtgatattgttcttgctgctgcatattctcatgagctgccacactttggtctgaaagtaggccttacaaattatgctgcagcttattgcactggactcctcttggcccgtcgtgttctgaagacacttgagatggatgaggagtatgagggcaatgttgaggctactggagaggattattcagttgagccagctgagtctaggaggccgttccgtgctctccttgatgttggtcttgttaagaccaccactggaaaccgtgtctttggtgccttgaagggagccctagacggtggtttggatattcctcacagtgacaaaaggtttgctgggtttgacaaggagaagaaagagctcgatgctgaggttcaccgcaagtatatttttgggggacatgtttctgcctacatgaagacattgattgaggatgagcctgagaaataccagactcactttagtgagtacattaagaaaggaatcgaggcagatggccttgaggagctttacaagaaggttcatgctgcaattcgtgcagatcctacaatcaagaaatccgagaagcagcctccaaaacaacacaagaggtataatctgaagaagcttacctatgaggagcggaaagctaagttggtttcacgcttggcagctcttaatgctgctgttgatgatgaggacgaggacgaggatgacgatgagtgaaagacattgtgtttgcagcccaagtgatggatatctagaactttttatgaatttgcaattagataaacgtttttttgaaaatttttgttgcctgtactgtttatttttgaggttaaaattttggataattacatgttggcctttcactggttcaaaaaaaaaaaaaaaaaaaaaaaaaaaaaaaaaaaaaa

SEQ ID NO: 10535 - DNA, 1172 bp, Medicago truncatula
atgattattgttattcttccaatttttcaaagaaacgaggctcaagtatccatccaaagtacagacagccgcggtcgaaggtgcccattcggaatggcatttgttaaggctcagaaatcaaatgcgtacttcaagcgatttcaagttaaattcaagagaagaagagagggtaagactgattaccgagccagggtgagtttgattactcaagacgctaacaaatacggcactcccaaataccgttacgttgttcgattgacaaacaaagacattgtctgtcaaattgtctctgctaccattgctggtgatattgttcttgctgctgcttacgcacatgagcttcctcaatttggcctccacgtaggccttactaactatgctgcagcttattgcactggtctccttctggctcgccgtgttcttaaaactcttgaaatggatgacgagtatgaaggcaatgttgtggcaaccggagaggattattcagtggaaccagctgactccaggaggccattccgtgctctcctcgacgttggtctcgttaagaccacaaccggaaaccgcgtctttggtgcactcaagggagctttggatgggggtttggatattcctcacagcgacaaaaggtttgctggttttgacaaggagaaaaaagagcttgatgctgaggttcaccggaagtacatctttgggggacatgttgctgcctacatgaagacattgatggaagacgaacctgaaaaatatcaaacccatttcagtgaatatatcaagcgtggaattgaagcggatggaatcgaggaactatacaaaaaggttcatgctgcaattcgtgcagatccctcaatcaaaaagcctgagaagcagccaccaaaggaacacaagaggtacaacctgaagaagctcacctacgaggaaaggaagacaaagttggtctctcgcttgcaagctctcaattctgcagccggagatgatgatgaggatgacgaagagtgaaattgagttgggaatgcagtccattgtttagcttgaatttccttaatcttcaaattttttgttgcttaccatttactttagattatcatttttggataatatggattatcctggatagacttgtttcgattcacatgatttgtttccaaaatccagaatataatttcttgctgttg

SEQ ID NO: 10536 - DNA, 1310 bp, Glycine max; identical to SEQ ID NO: 10531

SEQ ID NO: 10537 - DNA, 1203 bp, Glycine max; identical to SEQ ID NO: 10528

SEQ ID NO: 10538 - DNA, 1280 bp, Glycine max
ggtttcttattattttgattttcattacatcacgtaacaataataatacagccaagcacgcacgcacgcacccacaggcacaagtctctccaactcaacttcttccactctcactaatggctctcaccaatgctttcctcgctccttccttcgccgtccacggtgttggtagggtttccgatccgcgctccattcctctcttctctcttccctccgacgccttcttccgctccccaacctccctctccagggacaagaactttctaaaagcttctgcttatgatttgaatgcagttggttctgcttcactgcaatctggtgacaatcctgatagtgttcctatgccaatagttctaatagatcaagaatcagattctgaagcaacaattgtgcagcttagctttggggatcgccttggagctcttcttgacacgatgaaagcattaaaagatttgggattggatgtttcaaagggaactgtctccacagagggattagtcaagcaaacaaaatttttcattacacaatcagacactgggcgcaaagttgaagatcctgatatgttagagagaattcgacttaccattattaacaatctgttgaaatatcatcctgagtccagtgaactactagcgatgggtgaagtgtttggcataaaggctccaaagaaaaagcttgatgatgatatcaaaactcgtatacaagttaaggaagatggacccaagaggagcttgctatatatagagacagcagataggccgggattgctggttgaaatcatcaaagtcattgcagatgtaaacattgatgttgaatcggctgagattgatacagagggtttggttgctaaggatacatttcatgttagttacggcggggctgcattgaacagttcaatggctcaggttttggtgaattgtctgcgttactacctgcgaacgccagagacagatattgacagttactgaagaaaccacccttgtgaaataagccaatacaatggttctttcttataccaattccccagttagctcgatatcacctgcgaatcatatggtagctttactgctaccacattatggaatgagttatgagtacgtgttgcctatggaatgaatgaatacctgtaactaactatggaatgaatacatgttgcctatggcatggaatctaggataccagaaactcactgatcatccgtcaaatcttatatgaaagctaaaaaatcgaaaatgaattttgcctcatttcctaaatggtttatgtgattgttatgattt

SEQ ID NO: 10539 - DNA, 1187 bp, Glycine max
aacttccactctcatcaatgactctcaccaatgctttcctcgctccttccttcgccgttcacggtggtagggtttccgatccgcgctccattcctcttttctctcttccctccgacgccttcttccgctccccaacctccctctccagggacaagaacattctatatgcttctgcttatgatttgaatgcagttggttcagcttcactgcaatctggtgacaatcctgatagtcttcctatgccaatagttctaatagatcaagaatcagattctgaagcaacaattgtgcagcttagctttgggaatcgccttggagctcttcttgacacgatgaaagcattaaaagatttgggattggatgtttcaaagggaactgtctccacagagggattagtcaagcaaacaaaatttttcattacacaatcagacactggacgcaaagttgaagatcctgatatgttagagaggattcggcttaccattattaacaatctgttgaaatatcatcctgagtccagtgaactactagcgatgggtgaagtgtttggcataaaggctccaaagaagaagcttgatgatgatatcaaaactcgtatacaagttaaggaagatgggcccaagaggagcttgctgtatatagagacagcagataggccgggattgctggttgaaatcatcaaagtcattgcagatgtaaacattgatgttgagtcggctgagattgatacagagggtttggttgctaaggatacatttcatgttagttacggcggggctgcattgaacagttcaatgtctcaggttttggtgaattgtctgcgttactacctgcggacgccagagacagatattgatagttactgaaggaaccacccttgtaaaataagccaatgcaatggttctttcctataccaaatcgccagttactgctaccacattatggaatgagttatgagtacctgtaactaactatggaatgaatacgtgttgcctgtggtatggaatctatgaatacctgaaactcactgaacgtccgttaaatctgatatgaaagctaaaaaaattgaaaatgaattttgcctcatttcctaaatggtttatgagagtataactgggaggtgaaatttcaaatttgataaaaatgaaaagtagaatatcatataagtgaatataagacctataaat

SEQ ID NO: 10540 - DNA, 1128 bp, Vitis vinifera
ccaagaagctttaacaattctccatggccgcaactgtacacgccgtcctttcctctccctcctccatccttcgatttagggcttccgctttccacttcaacattcccccaatccgcttcgcctttgctcaaccccgattcactctctccgcaagcacgagtgctctacatgcttctaatgatggcatagattcagttccttcaatatcactgagttttgacccagattctgattatgttccaactccgatggttctgatagatcaagattcagattctgttgcaacaattgtacagcttagttttggagatcgacttggggctcttgttgacacgatgaaggctttgaaaggtttagatctagatgtgcaaaagggaactgttacgactgagggatcagtcactcaaacaaaatttttcattacccgaattgatggacgcaaagttgaagatcctgacatgttagagagaattcgacttacaatcatcaacaaccttttgaagtatcatccagagtccagtgagcaacttgctatgggtgaagcttttggaatcaaagctccagaaaagaagcttgatgttgatgttgcaactcatatacatgtcaaagatgatggggcaaagaggagcttgctttatatcgagacagcagatcgaccaggattgctattggaaattgtcgagatcataactgatgtgaatgttgatgtggaatctgcagagattgatactgaagggcttgtggccaaggataagtttcatgtcagctacaggggggctgcattgagcagctccttgtctcaggtaatgataaactctctgcggtactatcttcgaaggccagaaaccgaggtggatagttactgactacacagtttttttttgtaccaaatcaatcctcccaaagtaatatttgactagatactgtgatgatgttcgtttctgggatgtggattttgtcctgaatggtacaatatgataataggaaatgaataatagaaaacaaataacacatgcctcagttttttgctccaccaatgttctcatggattagggtgtggacaagcctctagttgatttttgcttatgtcatttttcatgggtttggaatcctgaaattttttgctaa

SEQ ID NO: 10541 - DNA, 1234 bp, Glycine max; identical to SEQ ID NO: 10530

SEQ ID NO: 10542 - DNA, 1203 bp, Glycine max; identical to SEQ ID NO: 10528

SEQ ID NO: 10543 - DNA, 787 bp, Glycine max
ggcctcttctctcgcgtcgctccgcaccagtttcaccgcacgaatatcttgttgtttggagcgatccgagaaaaactctgtaaacatgttggtttaccaggacctccttacaggtgatgagcttctctctgactccttccgttacaaggaaattgagaatggaatgctgtgggaagttgaggggaagtgggttgttaaaggagcagttgatgtagacattggtgcaaacccttctgctgagggtggaggagaagatgagggagttgatgatgcagctgttaaggttgttgacattgttgacacattcagacttcaggagcaacccgcattcgataagaagcagtttgttaccttcatgaagaggtttatcaagaatttgactcccaagctcgatgcagagcaacaggagttgtttaagaagcacatcgagggagcaactaaatacctgctctctaagattaaagatttccaattttttgttggtgagagcatgggtgatgatgcttgcttggtctttgcctactacaaggacggcgctgctgatccaacattcctgtactttgcatatgccttaaaggaggtcaagtgctaagtgacttaatgtaccgagctatctactcattttatctagtttttttttacgttctgtcctaagttacttgaaactttgacctggtattttgattttaatggtgagacgtgtgctactgctacatcataattcccatcaaatttaattatcgatgggttagaatttcattaatttatgattttggtcgtgctagat

SEQ ID NO: 10544 - DNA, 765 bp, Glycine max
ggccctcttgctctcgcgtcgctgctccgtaccagtttcactgcataaatttgagagaaaactctgcaaacatgttggtttatcaggacctccttacaggtgatgagcttctctcggactccttccgttacaatgaaattgagaatggaatgctgtgggaagttgaggggaagtgggttgttaagggagcagttgatgttggcattggtgcaaacccttctgctgagggtggagaagatgagggagtcgatgacgcagctgttaaggttgttgacattgttgatacatccagacttcaggagcaacccgcttttgataagaaacagtttgttaccttcatgaagaggtttatcaagaatttgactcccaagctcgatgcagagaaacaagagttgtttaagaagcacattgagggagcaactaaatacctgctctctaagattaaggatttccagttttttgttggggagagcatgaatgacgatgcttgcttggtctttgcatactacaaggatggtgctgctgatccaacattcttatactttgcatatgccttaaaggaggttaagtgctaagtgacataatgtaccaagttatctactctcattttacctagtttttttttttaagttctgtcctaagttacttaaaacttcgacttgttattttgattttaatggtgagacattttgtgctacatcataattcccatcaatttaattatcgatgggttagatttcattaatttatgattttggttgtgct

SEQ ID NO: 10545 - DNA, 507 bp, Elaeis guineensis
atgctcgtctaccaggatcttctcacaggcgatgagcttttgtcggactcatttccgtacaaggaaatacacaatggtatgctgtgggaagttgaaggaaagtgggtcattcaaggagcagtaaatgtcgacattggtgcaaacccttccgccgaaggtggtgaagaagatgaaggagttgatgaccaggctgttaaggtggtcgatattgtggatacttttaggcttcaggagcaaccggcattcgataagaaacaatttgtgaccttcatgaagagatatatcaaaaatttgactcctaaattggatgccgagaagcaggagctatttaagaaacacattgagggagctaccaagtttttactttcaaagcttagtgacctgcaattttttgtaggggagagtatgcacgatgatgggtgcctagtctttgcatactacaaagatggtgcaactgatccaacattcttatattttgcctatgggctgaaggaggtcaaatgctga

SEQ ID NO: 10546 - DNA, 504 bp, Elaeis guineensis
atgctcgtctatcaggatcttctcacaggagatgagcttttgtcagactcatttccatacaaggaaatagagaatggtatgctgtgggaagttgaaggaaagtgggtcattcaaggagcaattgatgtggacattggtgcaaacccttccgccgaaggtggtgaggatgaaggagttgatgaccaggctgttaaggtggttgatattgtggatacctttcggcttcaggagcaaccagcatttgataagaaacaattcgtgaccttcatgaagcggtatatcaaaaatttgactcctaagttggacgccgagaaacaggagttatttaagaaacacattgagggagctaccaagtttttactttcaaagcttaaggacctgcaatttttcgtaggtgagagcatgcatgatgacggcggcttggtctttgcttactacaaagatggtgcaacggatccaacattcttgtattttgcctatgggttgaaggaggtcaagtgctaa

SEQ ID NO: 10547 - DNA, 507 bp, Elaeis guineensis
atgctagtctaccaggatctgctcacaggtgatgagctcctttcagactcattcccctacaaggaaattgaaaatggaatgctgtgggaagttgaggggaagtgggttgttcaaggagctgtaaatgtagatattggtgcaaacccttctgctgaaggtggtgaagaagatgaaggggttgatgatcagactcagaaggtggttgatatcgttgacaccttccgccttcaggaacaacctgcctttgacaagaagcaatttgtgacctttatgaagcgttatatcaagcagttgacacccaagctggatgccgagaagcaagagctcttcaagaagcatattgagggagctaccaagtatttactctcaaagctcagtgacctacaatttttcgtgggcgagagcatgcatgatgatggcagcatggtctttgcatactacaaggagggtgccactgatccaacatttctgtacttggcttatggattgaaggaggtcaagtgctaa

SEQ ID NO: 10548 - DNA, 887 bp, Brachypodium distachyon
gaaccctctctcgccgccgcacgccgcaactccctgctgccgtccctcaagagctcgattcggcttcgattcgagcgaaatcttctcccaggggagctaaatctcgagcggcggcgccatgttggtctaccaggacaagctcaccggcgacgagcttctgtcggactcgttcccctacaaggagctggagaacggcgtcctctgggaggtcgatggccattgggtggtccaaggggctgtggatgtggatatcggtgccaacccatctgctgagggtggaggtgaggatgagggtgtcgatgaccaggctgtgaaggtggttgacattgttgacaccttccgtcttcaggagcaacctgcttttgacaagaagcagtttgtcgcctacattaagcgctacatcaagaacctgactcccaagctggaagcggatgagcaagaagtcttcaagaagaacgttgaaggtgccaccaagttccttcttagcaagatcaaggaccttcagttctttgttggtgagagcatgggtgatgatgccagcgtggtgtttgcgtactacaaggaaggagccactgacccgacattcctgtatttcgcgcatgggcttaaggaggtcaagtgctaagcgcactgtatgctaaaactatcagttgtccgtatttttgatctggtctgtggttgtcagtagactcaccaatgttggtggcgtaactgttatcagatgttgagtgtcttggaaacttttcgataattgtggtgtttgctttctgtaatggatccgtgaaattggtgtgacgttagtatttctgtgttctgcatgaacagtacctttcttttgcttgacaagtggaatcaaaggaatcaaagataaaagattttggccttcc

SEQ ID NO: 10549 - DNA, 842 bp, Hevea brasiliensis
ggcacgaggacttgttgctgctttcttctctcctttttgtggatcgatccgagagaaactcagcgatcatgttggtctatcaggatttgcttaccggtgatgagcttctctctgactcgttcccatacaaggaaattcataatggcattctgtgggaagttgaggggaagtgggttgttcaaggggctgttgatgtagacattggtgcaaatccttctgctgaaggtgctgatgaagatgagggtgttgatgaccaggctgttaaagtggtcgacattgtcgacacatttaggctccaggagcaacctgcttttgacaagaagcagtttgtcacatacatgaagaggttcatcaagttgttgacacctaagctggacgaggagaagcaagagtctttcaagaaaaacattgagggagcaaccaagttcctgctctcgaagctcagtgacctccaattttttgtgggggagagcatgcatgatgatggcagtcttgtgtttgcttactacagggaaggtgccactgacccaacatttttgtactttgcatatgctttgaaggaggtcaagtgctaagaagggaggatagctagcttcgaagtggaagttcttgctgtagtctagtttttgtctctgtactcttgcatttggtgccacgtgccttctattttgatttaattgtggttgattgactataacttgcttttctattttgcgttttagtgtcttgtttgacaagttatttaatctttcgttgagtgtattctaaatttatcaacaattggatatttagtttatatagttgttgttttgttctaaaaaaaaaaaagaaaaaaaaaaaaa

SEQ ID NO: 10550 - DNA, 685 bp, Glycine max
ggaaactctttaatctctcttctttcttgaatcaaactaaattcctttgttcagagacaaagaacaacaacaacaactgtaaccatgcttgtctaccaagatcttcttacaggtgacgagcttctctctgactcattcccgtacaaggaaactgagaatggaatgctgtgggaagtggaaggaaagtgggttgttcaaggagcagtcaatgtagatattggtgctaacccttctgcagaaggtggggatgaggacgagggagttgatgatcaagctgtcaaagtagttgatattgtcgacacttttaggcttcaggaacaaccaccctttgataagaaacaatttattacttatatgaagagatatattaagttgctgacggccaaattagagggtgagcagcaagagttgttcaagaagcacatcgagggagcaactaagtccctcctatcaaagctcaaagacctccaattttttgtgggggagagtatgcacgatgatggaagccttgtctttgcttactacaaggaaggtgctactgatccaacttttatctactttgcctatggattgaaggaaatcaagtgctgagcacatgcaatgcatgccccttagttatcttttatctgagttgaaaaattgtctttaattttagttcttgtgttttgggttttggttatgttat

SEQ ID NO: 10551 - DNA, 1516 bp, Glycine max
tcaaaaaaacgtgtctctctattttgaatctggatccagcgccttctattcagcattcacccaaaccctatttctctctctctttcttccctgtttggtatcagcgagcacaatgaggagaggagctaagagaaagacgaagcaggaccaagaagccaaacacgtcgcagccgaagataacaagaccgaagctcagcctcgagctaaacgggccaaaacctccaagcctcaatccgaacctgagtacttcgaagataagcgcaacttggaagatttgtggaaggaaacattccccgttggaactgagtgggaccaattggatactgtctatcaatacaagtgggatttctcgaatctagaaaatgcgtttgaagaggatggcgtgttgtatgggaaaaaggtttatctctttggttgcactgagcctcagctggtcatgtttaaaggggaaagcaaagttgtcttgatacctgctgtagtagctgttgtatcacctttcccaccatctgataaaattgggataaactcagttcaaagagaggctgaagagatagttccgatgaagcaaatgaaaatggactgggttccatatattcccttggagggcagagatagccaagttgatagactaaaatcccaaatatttatcttgagttgtacccaaagaaggtctgctttaaaacatctgaagttggatagattaaagaaatatgagtactgcttgccttatttctatcagccgtttaaggaagatgaacttgaacagagcactgaagttcaaattatatatccagctgagccaaagccggtcttttgtgaatttgattgggaattagatgaacttgaggagtttactgataagctcacagaggaggaggagttatccgaagatcaaaaggatgccttcaaggaatttgtcaagggaaaggttcgtgaagctaagaaagctaatagagaggcaagggaagctcggaaaaaagccattgaagaaatgagtgaggaaaccaaagctgcgtttgagagtatgagattttataagttctaccctgttcaatctccagatgcacctgatgtatcaaatgttaagtctccattcattaacaggtattacggaaaggctcatgaggttctgtgattggctccaagacaataatgacaatttttctggtttgttttgcccaacacgagatgttttgttattatgaactatgtagttcaggaggcaaccccctgatgtcccatcaaattgtctttgccagtgtagttgtctaaagtgacatataccatgtaaaactgtaggtcagagatcctagagaagtgaactagatgttgggaggaatttagacatgtttctggcttccttgttgaagagaatttctgaggttctggagctgcaatttgcgtggctctagcattcttggttttctcttaagattattctttttcccttcaaaatagatgtacgacagttttgactatgagctaaatgaaatcaattcattattgtttcgtttaa

SEQ ID NO: 10552 - DNA, 1441 bp, Glycine max
tccctgtttggttatagccagcacaatgaggagaggagctaagagaaagaccaagcaggaccaagaagccaaacaccacgcacccgaagataacatgcccaaagctcagcctcgagctaaacgagccaagacctccaagcctcaatccgaacctgagtacttcgaagacaagcgcaacttggaagatttgtggaaggaaacattccccgttggaactgagtgggatcaattggattctgtctatcaatacaagtgggatttctcaaatctagaaaatgcgtttgaagagaatggcgtgttgtatgggaaaaaggtttacctctttggttgcactgagcctcaattagtcatgtttaaaggggaaagcaaagttgtctgcatacctgttgtagtagctgttgtatcacctttcccaccatctgataaaattgggataaactcagttcaaagagaggctgaagagataattccgatgaagcaaatgaaaatggactgggttccatacattcccttggaggacagagatagccaagttgatagactgaaatcccagatatttatcttgagttgtacccaaagaaggtctgctttaaaacatctgaagttggatagattaaagaaatatgagtactgcttgccttatttctatcagccatttaaggaagatgaacttgaacagagtactgaagttcaaataatatatccagctgagccaaagccggtcttctgtgaatttgattgggaattagatgaacttgaggagtttactgataagctcatagaggaggaggagttatcagaagatcaaaaggatgcatttaaggaatttgtcaaggaaaaggttcgtgaagcaaagaaagctaatagagaggcaagggaagctcgaaaaaaagccattgaagaaatgagtgaggaaactaaagctgcgtttgagagtatgagattttataagttctaccctgttcaatctccagaggcacctgatgtatcgaatgttaagtctccattcattaacaggtattatggaaaagctcacgaggttctgtgattggctccaagacaataatgacaatttttctgtggcttgttttgcctaacacaagagatgttttgtttattatgaactatgtagttcaggaggcaaccccctggtgccccatcaaattgtctttgacagtgtagttgtctaaagtgacatataccatgtaaaactgtatgtaggtcagagatcctagagaagtgaactaggtgttgggaggaatttaagagatgtttctggcttccatggtgaagagaatttctgaggttctggagctgcaatttgggtggctcttgcatgtcttggttttctcttagattattctttttcccttcaaaattagatgtacgacagttttgactaatagctaaatgaagaaatcaattcattattgtttcgttt

SEQ ID NO: 10553 - DNA, 1626 bp, Vitis vinifera
ctcttcaaattcggaccgcccgcgttaatttcacgcgtgtctacctctcacccccaaaccctacattttttcacagaccgcccaaagtatattctcttcaaattttctaccttctctcttctccatatctccaaatcctaattctctctctacaatccacctcaaacaatgaagagaaaagttaggcgacagccaactcagaaggaagaatccaattcttccaaagcccccaccagagctaagcgggtcaaagcttctaagcctgaatcggagcccgagttcttcgaggagaagcgcaacatggaagatctgtggaaagagacatttccagttgggacagagtgggatcaattcgacttgctttaccaattcaagtggaacttctctaaccttgaaaaagcattcgaagaagggggaaaactatatggcaagaaagtttatctctttggctgttcagagcctcaattggtttcgtacaagggtgaaaataaagttatctgcatacctgctgtggtggctgttgtatctcctttcccgccttctgataagattggaattaactcagttcagagggaggctgaagaaatagttcctatgaagcaaatgaaaatggactgggttccatatattcctttggagaacagagaaagtcaagttgacaggctaaagacccaaatatttatcttgagctgcacccaaagaagggccgctttgaaacacttgaagatagaccgtgtcaagaagtatgaatactgcctaccatatttttatcagccattcaaggaagatgagctggagcagagtactgaggttcaaataatatttccagctgaatcaaagccggttttctgcgagtttgattgggagcttgatgaacttgaggagttcactgataagctgattgaggaggaggaattggatgtagatcaaaaggatgcatttaaggattttgtcaaagagaaagtccgagaggctaaaaaagccaatagacaggctagagaagcccgaaaaaaagcgcttgaagaaatgagtgaggaggctaaagcagcatttgaaaacatgaagttttacaagttctaccctgtgcagaccgaggatactcctgacatatcaaatgttaaggcaccgtttataaacaggtattatgggaaagctcatgaagttctgtgattgggctcatcaaccaccagtatttctactgcaagagatgccaagtggtttgcattggggactaaagctagctaatgatttcaggatatgtttcatgatgaaagttcataatggaaccctaaggtgcctcatctcgtggtcctttctcggtctcaagggattacaaggaaaagatgtaaactagtagttccaagatctttagaaaacagaactaggtgcttttgttaccatcggatgaaattgtaagaaatgttgttgagcctcccaatcatgggaatgatatttcttgagcatttctggaaagactaaaatttcccagtttctcaagtttgtcttagctttccaatttatgtactttgttagaggttctaattttgtcccttgaacattatttcttgtattcccaaaaggttcaattctgccaatgccatgaaataaaaatagttatttatcatt

SEQ ID NO: 10554 - DNA, 1463 bp, Glycine max
tgacactactccttctttctctctctacatttgaattcaatcgacccgccgctctttctctctctaaattcgcaatgagcaaaagagctaataagaggaaagcgaagcaagacgaacagcccaaacaacgcaagaagcgatccacaacaattaaacctgccgagcacgaagagtacttcgaggatcagcgcaacttggaagacttatggagggaaacattccctgtcggaacagagtgggatcaattggattctgtgtatcaatacaagtggaatttctctaacctggaaaatgcgtttgaagagggtggtgtacttcatgggaaaagggtttatctctttggttgcaccgagcctcaactggtctggttcaaagatgaaagcaaagttgtctgcatacctgttgttgtagctgttgtatcacctttcccaccgtctgataaaattgggattaactcagttcagagagagttcgaagagataattcccatgaaacaaatgaaaatggactggattccatatatcccccttgaggaccgagaaagccgagttgatagattaaagtctcaaatatttatcttaagttgcacccaaagaagggctgcattgaaacatctgaagttggatcgtgtaaagaaatacgagtattgcttgccttacttctaccatccgtttaaggaagatgaacttgaacagagcactgaagttcaaataatatttccagcagagccaaagccggttttctgtgaatttgattgggaattagatgagcttgaggagttcactgataagctcatagaggaggaggagttattggaagatcaaaaagatacctttaaggaatttgtcaaagaaaaagtacgggaagcaaagaaagctaatagagaggcaagggaagctcgaagaaaagccattcaagaaatgagtgaggaagctagagctgcatttgagaatatgagattttataagttctaccctgtgcaaagtccagatgcacctgatgtatctaatgttaagtctccattcataaacaggtattatggaaaggctcatgaggttctgtaattggattcaagacgatgccaacttcgtctgcaggcttgttttacctgacactaaggatttagtcatctatgacgttcagaaggcaacctcctggtgcctggttagaagtgtaggtgtctgaaggaacataccatgtaaaattaagctcagaaatcccagagaagtgcattagataggaggaatatatgggacgggtttctgatttccaatctgtggagaatagccgaagttcaggagctttaattggtgtggctcttgcttgtcttggtttcaaatttcagattctttgtccattctaagttgtacggcaaggtttgactataagctaaatgaaaatagatagttgtccttttaacatccaagaacgaaaatatatttgttgaaaggacaattttgttg

SEQ ID NO: 10555 - DNA, 3079 bp, Brassica rapa
agaaaggagcgaagagaaagggaccttcaaaagcagctcgcaaaggccctgctgctgacgagagtcagaacgatgaggtggttgccgagtctctcgaggcttccacgcaggaggagagtcagcagcctaacgcggaagcggaagctaaaccggagataaccgattcctcaaaccaggtcgacgaggtgaaagacgcgtctccttctcagcaacaagaggacgtcaaggccgaggaagttgatgaggataagaagaaacctggtcgtcctcgtggcggtaagcgaaagagagccacgaagaaggaagttgatgtgaaggacgagaagaaaccgcctccgagagctaagaaagcacgagtggccaagccacaggaagagcctgagtacttcgaggacgagcgtaatctggtaacaagattaatcgcttgattatatgcaatcatgatttggttacaatagggatttgttcatttgttgggttaatctcgttgagtacatttgtatactgcttatgccatatatggtatgtcacatagagcttttagttactggagggaaaattgttaatggaacggtgtgggaagatttcaatattgcaatttctaatcaaatatttgcttttgtttttgtgttttttttttcaggagggtttgtggaaagctgcatttcctgtgggaactgaggtatatatttttttttgtggaatttagctttacattttagttatttgtctcagttgatattctttgcttatggttgttaatttgtggtggcagtgggaccagttggatgcactttatgaatataattgggatttcaaacaccttgaagtaagttgattttgttacattgtccatttttgttttttttttgctgttgcgttcacaagttcttgagggttatttatgtttcttcatctgtatgttaggaagcattggaggaaggtggattcctctttgggaagaaagtctttcttttcggctgtacagaacgtaagctctttctcttgccctcttttttcttcttgttttgattattgatagttagaggcgagctgtttaatcctgtttaaaacatagtaagcaattgttctattttgtagaaagtttctgtcagactgtggagaataacctctgtaacatttacttctagttttcgttgaagttttttcttttgatcattacagcgcagttagtccccttcaaaggcgcaaacaagattctccacgtcccagcagttgttgctgtaagtttttgtttgaaacctctatcatcggttccttgttatcgttgatctctggattcagtatcagatatcatttctcactgtgaattttctccattctatatttgcaggttgaatcaccctttccaccttctgataagataggaatcacgtcggttcagagggaagtggaggaaatcattccaatgaagacaatgaaaatggactggcttccttacattccgcttgagaacaggtacttagaccatgggttccacttgcatctgaacacatttgttcggatggcctagaacaataagaggagaaacgcagatcacgtctcgtgctattcttgcttctgatgtctaccagcattaccttttatttgttcttcctgcagagctagacaagttgataggatgaactttcaaatttttgtcttgggctgtacgcggaggaggtaaataacatgtctttgtcttctattctgactcagtatcagacgactcgaagttaaaaatatcgatgtttgctgtgcagggatttagagttacattataaattgaaactagaatatgattaatgttactttgttagcgttgcatcatttgttccctactttctgcctagtaatttgttggtagggtgcagaattttatgtatgggtttttggcattgcagatctgtatcctcatacagatagtattgtttgattgctttatattatctgtagagctgctctgagacatatgaaggaagatctcgttaagaagtacgagtattgccttccttgtgagttatattcctctctaccaatacttgttaaaatctgcagattgaaaaccatttttacatggcagggtataaattttatttttgtgtggtaagcggcaacaaaatctaatctcttttttttctttctctttgctttatagatttctatcagccatttaaggaagatgaacttgaacagagtactgaggtccagataatgttcccctctgaaccgccggtaagtcttttggcatgtaatgaagtggtggttctacataaaatggctaggaaggggctcattgttttgggtattttttaatagtcgagctttgatgttctgtttgtgcaggttgtatgtgagtttgactgggagtttgacgaacttgaggtattcctttggcttttatttaacgatgaaacttgagaattacttcttcatttggtccacgacgttttcatcttctcactgctccttcctcgtgtgttctggcattcactgtatggctttttgtgctcctatctcaggaatttgttgataagctgatcgaagaggaagccttacctgcggatcaaaaggatgagttcaaagtgagtagagctgcataataacccaatagtcagttcatgccggttgatgatttttctaagttcttttgatttgtattttctcaggaatatgtcaaagtgcaagttcgagctgcaaagaaagctaatcgagaggtaaaccttaacccaaccaagatgaatgatatatctgagctccattcaatgaaactgttcgcttacggtattatatcattgcaggccaaagatgctcgaaggaaggcaatagaagaaatgagcgaagacacgaagcaagcctttcaaagcatgaagttctacaaattctatcctctgccttcatcagaaacaccagacgtctctggcgtcaaggtaagaacaaaagaaaagaaaaaaccagccttcttcagttagtttaatccggttttcagttagttatatgaaagtcttgtttgcttgttttaccctttttgcagtcgccattcatcaaccgatactatggaaaggctgatcaagtcctt

SEQ ID NO: 10556 - DNA, 3306 bp, Arabidopsis arenosa
atgaggaaaggagcgaagagaaagggtgtttcaaaagctggtcgcaaaggtgctgttgcggagactcagaccgatgaggtgatagaggagacgacgacgcaggaggagagtcaacagcctaaggaagaagtcgtcgacgagaagaaggagaatggggaagaagaagaggaggccaagggagatcaagaggaagaagaggaggcgaaacctgattccttagagaaggaggaggagaatcaggaagatgaggtcaaagctgacgaagttaaggaagaagatgagaagaaacctgttgctcgtcgtggtggtaaacgaaagagggctacgaagaaggaaactgagattaaagatgagaagaaaccggttccgagtgttaagaaacctcgagtggccaaagttaaggaagagcctgtctactttgaggataagcgtaatctggtatgcttttgataaccttagcttaggtttaagattcatcacttggattagatgcaatttggggttatttaagctgatttgataactcgaaatacgctgtgaaaacaacaatgagatacgtttttggacttgtatgtttatcttatagcttaacttataatgtggagctgtttagagttcttggttgcaataacaatacaaaagatattactttgttggtgggtttatctggagaacaattgtatgctattatagttcttttgtcagatatggtatctcgttatcaatatatcttgagcacttgagtatttgtaagttcaactaaacgggcttgttttcttgtcttattgctgctgtgtgcgttgcaaattaacatgtgcgcttgttttgtgtttccaggaggatttgtggaaggttgcatttccagtgggaactgaggtatattgttttgaggaattttggcttcaacatcagagctactgtgttcattgatgatccaatatattccttgcttatgtttgttaatttgtgatggcagtgggatcagttagatgcactttatgaattcaattgggatttccaaaatcttgaagtaagttgtttggattacattctctattgtttagtcaagggtttccagggttgacgagaatctgatatttatgtttcttcatctgttccaggaagcattggaggaaggaggaaagctctatgggaagaaggtttatgtttttggctgtacagaacgtaagctatttctctcgtttttttttcttaatcttgttttgattttaggtagttactgtcttcttatcgtttgacttgtttaaatcatctttggcacttgtggttctttttaatttacttagaaaatctatcaggttgtgcagtatgctctctacctttttttgaacatttgcttctagttcctgtttaagtttttgttttcaacgttacagctcaattagtaccctacaaaggtgcaaacaagattgtccatgtcccagctgttgttgtggtaagttcttgtttaaatatctgttaaagtttgcttgctatcactgatctctgaatttaagatcatatagtatctcattctctttctaaaattcgtcaattttatatatgcagattgaatcaccttttccgccttctgataagataggaatcacatctgttcagagagaagtggaggaaatcattccaatgaagaagatgaaaatggattggcttccttacattccggttgaaaaaaggtactatgagttccacgtgcatctgttagacatttggtgggatgtcctaaatcattgagaagagaaacagagattctttcttgggctattcttacttctgatgtttaccagcagttgctaactacttttgctttgttcttcttgcagagatagacaagtggataagatgaactctcaaatttttaccttggtttgtacgcagaggaggtacgtagcatgtgttctcttctcttctcagtgtgagatgcctgatagagttaaaaaattgattttggcttgctataaggggttttgagttacattacatatgtattgaaattagaacatgaaacatggcttcacgtagctactatgtgtgattagtcgggttgcattgtttgttccctcattcctgcttgtaatttttctttagagtgcagaaatttgatacatgggtcttttttgttgcaaatctgagtcttctacagatagtattgtttgaattctctagttctgttgtactcaatttgactttgtacattatctgcagatctgctctcagacatatgaaggaagatcaacttaagaaatttgagtattgccttccttgtgagttttattcatctactaccaatactagttaaatttgcagagtgaaccatttataacacatgacaggctgttggcagttgtatattcgtatgcaacaacaaattctaatatctctctctttttttttcttttttctttgcagatttctatcaaccctttaaggaagatgaacttgaacagagtactgaggtccaaataatgttcccctctgaacccccggtaagttttctggcatgcaatgaatgcgttggaagtggcaggtctacatgaaatggtctgataggggcacattgttttgggtattttctttgtaatcaagctttaattttctgtttgtgcaggttgtgtgtgaatttgactgggagtttgacgaacttcaggtgtgtgtttggcttttctgtaacaataaaatttgaattacttcttcatttgagtcatctttgcattgttcttttcttgtatgttcgaaatcgcattcgtcgtatgctgaatcttgagatggctttttttcatctatctcaggaatttgtcgataaactggtcgaagaggaaacattacctgctgaacaaaaggatgaattcaaagtaagagtgagctgtaatgcaattgtcagttcttgacgcttgagcatcttctctaattaccattgttctttttctcaggaatatgtcaaagagcaagttcgagcagcaaagaaagcaaatcgggaagccaaagatgctcgaaagaaagcaatagaagaaatgagcgaagatactaagcaagcctttcaaaagatgaagttttacaaattctacccccagccttcaccagatacaccagacgtctcaggtgtcaaggtaaagaactaagaacaaaaacagaaaactcaaaaatccacctccagtttgtttaatactttatatgataccgataggttttgattatagtttgttacaaagctctgattatgtgaatgatctggttatttgcagtccccgttcattaatcgatactacggaaaggctcatgaagtccttt

SEQ ID NO: 10557 - DNA, 1772 bp, Arabidopsis thaliana
gtagaacacatttggacaaaaagaaaagataaaataaaataaaaaacaaaacccccaaatttgtgtctcctccggaaaaaaaattcgaaattccggatccaccgccatcaatccctagctttctctctctttctctatcttcgccggcgaaaccagtagggttgctcaattcgttggtagagtactgtggcaatgaagaaaggagcgaagagaaagggtgtttcgaaagcaggtcgcaaagctgctgttgcggagactcagaacgatgaggtgatagaggagacgacgaagacgacgcaggaggagagtcaacagcatgaggaagaagtcgtcgacgaggtgaaggagaatggggaagaagaggaggctaagggagatcaagaggaagaagaggatgcgaaacctgattccttagaggaggatgaggagaatcaggaagatgaggtcaaagctgaggaagtaaaggaagaagttgagaagaaacctgttgctcgtcgtggtggtaaacgaaagagggctacgaagaaggatactgagattaaagatgagaagaaacctgttccgaaagctaagaaaccgagagcggccaaagttaaggaagagcctgtctacttcgaggagaagcgtagtctggaggatttgtggaaggttgcatttccagtgggaactgagtgggatcaattagatgcactttatgaattcaattgggatttccaaaatcttgaagaagcattggaggaaggaggaaagctctatgggaagaaggtttatgtctttggctgtacagaacctcaactagtcccctacaaaggcgcaaacaagattgtccatgtcccagctgttgttgttattgaatcaccctttccgccttctgataagataggaatcacatctgttcagagagaagtggaggaaatcattccaatgaagaagatgaaaatggactggcttccatacattccgattgagaaaagagatagacaagtggataagatgaattctcaaatttttactttgggttgtacgcagagaagatctgctctcagacatatgaaggaagatcaacttaagaagtttgagtattgccttccttatttctatcaaccctttaaggaagatgaacttgaacagagtactgaggtccaaataatgttcccctctgaacccccggttgtatgtgaatttgactgggagtttgatgaacttcaggaatttgtcgataaactggttgaagaggaagcattacctgctgaacaagcggatgaattcaaagaatatgtcaaagagcaagttcgagcagcaaagaaagcaaatcgagaggccaaagatgctcgaaagaaagcaatagaagaaatgagcgaagatactaagcaagcctttcaaaagatgaagttctacaaattctaccctcagccttcaccagatacaccagacgtctctggtgtccagtccccattcattaaccgatactatggaaaggctcatgaagtcctttgagatcagatgatcagatgtttgagaagccagaaagcttttcttggaagcttcagcagaaatcaaagttatttttaatcacaggtgctctcagaaactctttgagcttttatagttattaagccaagtttgtaggacaaaatgtcttttacttttatgagtttgtattctcctcgggagtacttgagatcttagaagagtcacgggaacccaattctttttgcggaaaatcgagacagctttttatctctctatgctttaagtttttcttaaattgc

SEQ ID NO: 10558 - DNA, 1924 bp, Glycine max
atagacagagatcggaagctgtgacatctttcttagcttcatggagagtactgctagtatttaagggctctgtgtgttttctttctttgcattatgaaggaggcaacaatggagaaggaaatggagctttgtacaagtgaagtggaaatggcttctcaacacagtccacaaccacagaagaaaaagggtggtattgttaccatgcctttcatcatggcaaatgaagcacttgcaagcgtggcgaatatcggtcttcagccgaacatgatattgtatttgatggggagttacaggtttcatttagccaaagcaactcaggtgtttctgttatcctctgcaacaagcaatctcacgccactcataggtgctttcattgctgattcttgtcttggtcgattcctagctgttgggttaggttctgccatctctttcctgggaatggcactcttgtgtctaacagcgatgatcccacagtctcggcctcctccttgcaaccctgcaactgaaagatgtaaaccagcaacagctggccaaatggcaatgttaatctcttcctttgctctcatgtcgattggaaatggtggcctttcatgctccatcgcatttggcgcagaccaggtgaataaaaaagataaccccaacaaccagagggccttagaaacatttttcagctggtattatgcttctacagctttttctgtcataattgccctcacagtcatagtatatatccaagatcattttggatggaaagtaggttttggagttccagcagcacttatgttcatgtccactttcttcttctttcttgcttctccgctttatgtaaagaataaaatacaaggcagcttaatcactggcttagcacaagtaattgtcgtggcctataagaaccggaagcttcctttaccacctaggaactcagctgaaatgtaccatcataggaaggactctgatcttgttgttcctactgacaaactaaggtttctgaataaagcttgcatcatcaaagatatagcctctgatggatcagcttcaaatccgtggagtctctgcacaatagatcaagtggaagaactaaaagctattattaaagttattccactgtggtctacagggatcatgatgtcagttaacattggaggctcgtttggaatactgcaagctaaatccctcaacagacatatcacttcacactttgaaattccagcaggttctttttctgtagtaatcgtatttatggtattcatatgggtggctctttatgatcgtgtcattattcctatagcatcaaagctcagaggcaaaccagttaggatcagtgccaagagaagaatgggaattgggttggttttctcttttctccacttggcaactgcagctattgtggagaatacaaggcgaaggagagcaatcagggagggacatattgatgacacaaatgcagtgttgaatatgtctgcaatgtggcttgttcctcaactttgcttgtcaggcatggctgaagcattcaatgctataggccaaaatgagttttattacactgagtttccaagaactatgtcaagtattgctgcttgcctttttggacttggaatggctgcaggaaatgtgttatctagtttgatattcagcatcgtggaaaatgttacttcaaggggaggaaagcaaggatgggttttagataatattaacaagggtagttatgacaggtactactgtgttcttgcttcactggctgctgttaatatactgtattatctagtgtgcagttgggcttatgtacccacagttgatcaactatccaatgtttctgacgaaaataattcaaatgagaaagtattaattcaattgggcaatatgagccaggtagatcttagtgaaggatttgggtcaaatgagaaaagagttaactagatttgac

SEQ ID NO: 10559 - DNA, 1821 bp, Glycine max
atggagaaggaagtggagttttgttcaagtgaattggaaatggcttctcaacacattccacaaccacaaaggaaaaagggtggtattgttaccatgcctttcatcatagcaaatgaagcacttgcaagcgtggcgaaaatcggtcttctgccgaacatgatattgtatttgatggggagttacaagtttcatttagccaaagcaactcaggtgcttctcttatcctctgcaacaagcaatctcacaccactcataggtgctttcattgctgattcttgcctcggtcgattcctctctgttgggtttggttcctccatctctttcctgggaatggcactcttgtgcctaacagccatcatcccacaggctcggcctcctccttgcaaccctgcaactgaaagatgtaaaccagcaacagctgggcaaatgacaatgttaatctcttcctttgctctcatgtccattggaaatggtggcctttcatgctccatcgcatttggcgcagaccaggtgaataaaaaagataacccaaacaaccagagggcattggaaacatttttcagctggtattatgcttctacagctttttctgttataattgccctcacagtcatagtatatatacaagatcattttggatggaaagtgggttttggagttccagcagcacttatgttcatgtccactttcttcttctttcttgcttctccactttatgtaaagaataaagtacaaggcagcttaatcactggcttagcacaagtaattgtcgtggcctataagaaccggaagcttcctttaccacctaggaactcagctgcaatgtaccatcgtaggaaggactctgatcttgttgttcctactgataaactaaggtttctgaataaagcttgcatcactaaagatccagaaaaagatatagcctctgatggatcagcttcaaatccgtggagtctctgcacaatagatcgagtggaagagctaaaagctattattaaagttattccactgtggtctacggggatcatggtgtcagttaacattggaggctcgtttggattactgcaagctaaatccctcaacagacatatcacttcacactttgaaatcccagcgggttcttttgccgtagtcattgtgtttataatatttatatgggtggctctttatgatcgtgtcattattcctatagcatcaaagctcagaggcaaaccagttaggatcagtgccaagagaagaatgggaattgggttggttttctcttttctccacttggcaactgcagctattgtggagaatgaaaggcgaaggagagcaatcagggagggacatattaatgacacacatgcagtgttgaatatgtctgcaatgtggcttgttcctcaactttgcttgtcaggcatggctgaagcattcaatgctataggccaaaatgagttttattacactgagtttccaagaactatgtcaagtattgccgcttgcctttttggacttggaatggctgcaggaaatgtgttatctagtttaatattcagcattgtggaaaatgctacttcaagaggaggaaacgagggatgggttttagataatattaacaagggtcgttatgacaggtactactgggttcttgcttcactgagtgctgttaatatactgtattatctagtatgcagttgggcttatggacccacggttgatcaactattcaaggtgtctgacgaaaatagttcaaatgagaaagaattcactcaattgggcaatatgggccaggttgatgttagtgaaggaattggctcaaatgagaaaagagttaactag

SEQ ID NO: 10560 - DNA, 2187 bp, Glycine max
atggagaaggaactagaactttcttcagctcaatccagaatggattcccagcgcatttcccaaccccaaaggtgtggtaagggtggcctcgttaccatgcctttcatcatagcaaatgaagcacttgcgagggtggcaacgttggggcttctgcccaatatgatattgtatttgatgggaaactacaatcttcatttaggcaaagctaccaagatactcctcttatcagttgcaaccaccaatttcatgcctcttcccggagccttcattgctgattcttatctgggtcgcttcctcgctgttggtttaggttccttcatcacttttctgggaatgacactgttgtggctaacagccatgatcccacaggctcggcctcctccttgcaattctgaaactgaaagatgtgaatcagcaacacctggacaaatggcaatgttaatctcttcccttgctctcatgtccattggaaatggtggcctttcatgttccctagcctttggtgctgaccaggtgaatagaaaagataaccccaataaccaaagggccttggagatgttcttcagctggtactatgcttcgtcagcgatatcagtcataattgccttcactggaattgtatatatccaagatcatcttgggtggaaattgggttttggagttccagcagcacttatgttcttgtccacttttttcttctttttggcttctccactttatgtaaagaataaaacacacaacaacttgctcactggctttgcatgtgtgattgttgtagcctataagaacaggaaacttcgattaccacataagatctcagatggaatgtatcatcgtaacaaggactctgatctagttgttccatctgataaactaaggtttctgaataaagcttgcttcattaaagactcagaaaaagatatagcctctgatgggtcagcctacaatcggtggagtctctgcacagttgatcaagtagaagaactaaaagctattattaaagttattcccctgtggtctacagggatcatgatgtatcttaacattggaggctcgtttggattgctgcaagctaaatcccttaaccgacatatcactccaaatttcgaagttccagctgggtctatgagtgtaatcatgatatttacaatatttatttggatagctctttatgatcgtgtcattattcctcttgcatcaaagcttagaggcaaaccggttaggatcagtgccaagagaagaatgggacttgggttgcttttctcttttctccacttggtaactgcagcaattgttgagactacaaggcgaaggagagcaattagtgagggacatattaacgacacacatgcagtgttgaatatgtctgcaatgtggctctttcctcaactttgcttgggtggcatagctgaagcattcaatgcaataggccaaaatgagttctattacaccgagtttcctaagactatgtcgagcattgcttcttccctttttggactaggaatggctgtgggatacgtgttatcttcattggtattcagtattgtggaaaaggttacttcaagagggggaaaagatggatgggtttcagataacattaacaagggtcgatttgacaagtactactggcttcttgccacaatgagtgctgttaatgtactgtattatctagtatgcagttgggcttatggacctacttctgatcaagaatcaaaggtaactgaagaaaatggttccaatgaggaagaattgccattaattcaatccaggactaagggtcagtttgataaggtatctcaggttagtgaagaaattttaagaacttcacataaatagtaactgattgaaattagttttagtgttttcaataaataaataagaatgttagtgttttcaatttacaaaaacaaacaaaatattcttatttgggagcctcgcccttcattcctttgtgggtcatccatacaacaatctttttggtgatagctgaaattgaccaatcattggttgaactctgttctactttattattaggcaactgaaaccggttgttgatattgtacgaggcaatatttcatatggtttgacaagattcttcaaatcatactacataaggattgcaaagcacctatctttcccatgcgtgttcagttgctagttactgagttatttcattttgctgtattc

SEQ ID NO: 10561 - DNA, 2342 bp, Glycine max
gaagagtgatgggacacagacacggtgcattccagatatgcatggagtctctctctctgtatgaacacgcaaaagaccattgattgtccgagagaacgcaagcactgacatcagtactccatatatttgctactctgcatgaacataacattcatacttaagttttgctggttgtgtgtgtgttttttgttcttggtcgagccttgtactgattaacgagaatggacaaggaagtggagcttggttcccttgaaggtgaaatggccacccagcacatttcacaaccacagaagcgcaagggtggtcttgttaccatgcctttcatcattgcaaatgaggcacttgcgagggtggcaagtttgggccttttgcccaacatgatactgtatttgatggggacctacaggcttcaccttgcccaagcaacccagatacttctctggtcccatgctaccagcaatttcacacctgtggtgggtgctttcattgctgattcttatctgggtcgattcctcgctgttgggttgggttcggccatcacttttctgggaatgacactgctgtggttaacagctatgatcccacaggcacggcctcccacttgcagtagcaataaagctggaggctgtaaatcggcaacaggagggcaaatggcaatcttaatctctgcccttgctctcatgtctgttggaaatggtggtctttcatgctccttagcatttggtgcagaccaggtgaacagaaaagataaccccaacaacagaagggtcttggaaatattcttcagctggtattatgcttctgctgctatttctgtcataattgctctcacaggaatagtttatatccaagatcatcttggatggaaagtgggttatggagttccagcagcactcatgcttttatctactgtctccttcctccttgcctctccactttatgtaaagaataaagtagaatccagcttgttcacaggatttgtacaagtgattgttgttgcctacaagaacagaaaacttccattaccaccaaacaactcccctgaacattaccatcataagaaggagtcagaccttgtcgttccaaccgataaactaagtttcctgaatagagcctgtgttatcaaagatcgggaacaagaaatagcctcggatggttcagcatcaaatccatggaaactctgcacagtagatcaagtagaggaactaaaagccattattaaagtgattcccttgtggtctacagggatcatgatgtcagttaacattggaggctcatttggattgctgcaagctaagtccctggacagacacatcacctcacacttccaagtgccacctggctcttttagtgtagtcatggtacttacaatatttttatggatagctctctatgaccgagccattcttcctttagcatcaaagataagaggcaaaccggttaggatcagtgcaaagagaagaatgggacttggcttgtttttctcttttatccacttggtaacttcggctattgtcgaatccgtaaggcgaaggagagcaatcaaggagggatatcttaacaatgccaatggtgtgttgcatatgtctgcaatgtggcttttcccacaactttgcttgggtggaatagctgaagcattcaatgcaataggccaaaatgagttctattacacagagtttcctaggaccatgtccagtgttgctgcttccctttctggactgggaatggctgcaggaaacttggtgtctagttttgtcttcagcgttgtacaaaatgctacttcaagaggggggaaagaaggttgggttttggataacattaacaagggtcgttatgacaagtactactgggttatttctggactcagtgctcttaatatagtgtattatctaatatgcagttgggcttatggacctaccgttgagcaagtacaagtacgtaagttaggtgaagaaaatggctcaagggaattagaaccttcaactgaatttaggaatgggagtcaggttgacaaagaattccagattagtaaagaaaatggctcaaaggaggaagaagagttaactaggtgatatgttgaattgctcctctaggcatattgttgatcgggcaaatacacttaatgcccagtgattcactctcaaataatatcttttttttctctccatgttttgaccagtagtcgcatttataataaggctatagatgaatatacacacatatattatgtataatcggttagtgtatgaagatgcgaataatactataaaatgctgtagaccataaatttttctggaacccttttggttctgttgagaaaaaaaaaattatttaagtcttaa

SEQ ID NO: 10562 - DNA, 2034 bp, Glycine max
gagacaacacttgataatctgaagcctttatgatgggagcatagaagagagggtttgttggccattgatgactattgagttgagggtctgatagaaggaggtggcaagctgtggcgagtagatggagatgtgtgtcatttgtactaagtctttgttgttgcattaggaaaagggttgaagaaggaaactccaacagtagctgatcaatggagatggaagtagaactttcttcagctcaacccaaaatgggttctcagcttatttcccaaccccaaaggtgtggtaagggtggcctcgttaccatgccttttatcatagcgaatgaagcacttgcgagggtggcaactttggggcttctacccaatatgatattgtatttgatgggaaactacaatcttcatttaggcaaagctaccaagatactcctcttatcagttgccaccaccaatttcatgcctcttcccggtgccttcatttctgattcttatctgggtcgctttctcgctgttggtttaggttccttcattactttcctgggaatggcactgttgtggctaacagccatgatcccacaggcacggcctccggcttgcaattctcaaagtgaaagatgtgaatcagcaacacctgggcaaatggcaatgttaatctcttcccttgctctcatgtccattggaaatggtggcctttcatgttccctggcctttggtgctgaccaggtgaatagaaaaggtaaccccaataatcaaagggccttggagatgttcttcagctggtactatgcttcgtcagcgatatcagtcataattgccttcactggaattgtatatatccaagatcatcttggatggaaattgggttttggagttccagcagcacttatgttcttgtccacttttttcttctttttggcttctccactttatgtaaagaataaaacacacagcaacttgctcactggctttgcacgtgtgattgttgtagcctataagaacaggaaacttcgattaccacataagatctcagatggaatgtatcatcgtaacaaggactctgatctagttgttccatctgataaactaaggtttctgaataaagcttgcttcattaaagactcagaaaaagatataacctctgatgggtcagcttcaaatccgtggagtctctgtacagttgatcaagtagaagaactaaaagctattattaaagttattcccatgtggtctacggggatcttgatgtatcttaacattggaggctcttttggattgctgcaagctaaatcccttaaccgacatatcactccaaatttcgaagttccagctggttctatgagcgtaatcatgatatttacaatatttatttggatagctctttatgatcgtctcattattcctctagcatcgaagatcagaggcaaaccagttaggatcagtgccaagagaagaatgggacttgggttgcttttctcttttctgcacttggtaactgctgcaatggttgagactataaggcgaaggagagcaattagtgagggacatgttaacgacacacatgcagtgttgaatatgtctgcaatgtggctcttccctcaactttgcttgggtggcatagctgaagcattcaatgcaataggccaaaatgagttctattacaccgagtttcctaagactatgtcgagcattgcttcttccctttttggactaggaatggctgtaggatacgtgttatcttctttggtattcagtgttgtggaaaaggttacttcaagagggggaaaagatggatgggtttcagataacattaacaagggtcgtttcgacaagtactactggcttcttgccacactcagtgctgttaatgtactgtattatctagtatgcagttggatttatggaccaactgctgatcaagaatcaaaggtaactgaagaaaatggttccaatgaggaagaattgccattaatttaatccaggactgagggtcagtttgataatgtatctcaggttagtgaggaaattttaagaacttcat

SEQ ID NO: 10563 - DNA, 1821 bp, Glycine max; identical to SEQ ID NO: 10559

SEQ ID NO: 10564 - DNA, 1924 bp, Glycine max; identical to SEQ ID NO: 10558

SEQ ID NO: 10565 - DNA, 2213 bp, Medicago truncatula
atggacaaggaacttcaactttgttctgttgacgatgatgaaatggtttctcaacaacctcaaagacgcaagggtggtcttatcaccatgcctttcatcattgctaatgaggcacttgcaaggatggcaagtttgggactattgcccaatatgatattgtatttcatgggaagttacaggcttcatcttgccaaagctactcagattcttctcttatcctctgcagctagcaatttcacacctgtggttggtgcttttattgcagattcttatctcggtcggttcctcggtgttggattaggttcatttgtcagcttcctgggaatgggaatgttgtggttaacagccatgatcccagcggcacggccgcctccgtgcaacaatccaacaaaaggctgtaaatcagcaacaacaggtcaaatggcaatgttactctccgcctttggtctcatgtcaataggaaatggtggtctttcatgttccatagcatttggtgcagaccaagtgaatagaaaagataatcccaataatcatagggttttggaaatattcttcagttggtattatgctttcacaactatttctatcatactagctctcactgtaattgtatatatccaagagcatcttggttggaaaattggttttggtgttccagcagcactcatgcttttatctactatctgtttctttcttgcttctcctctttatgtcaagatcacaaaaagaaccagcttgattactggttttgcacaagtcactactgctgcttataagaacagaaaacttcaattaccacctaagaactcacctcaattttaccatcacaaaaaggactcagatcttgatcttgttattccaactgataaactaaggtttctgaacaaagcttgtgttattaaggatcatgaaaaagatatagcctcagatggttcagcaataaatccttggagactctgcacagtagatcaagtagaagaactaaaagcccttgttagagttattccattatggtctacagggatcatgatgtctcttaacattggtggatcatttggattgctgcaagctaaatccttagacagacatatcacctcaaactttgaagtaccagcaggatcttttagtgttatcatggtaggttcaatatttatatggatagtactctacgaccgtgttcttattcctctagcatcaaagctaagagggaaaccagttaggatcagtccaaagataagaatgggaattgggttgtttttaaattttctccacttggtaactgcagctgcttttgagagtataaggagaaaaaaagcaattcaggcaggatttttgaatgatactcatggcgtgttgaaaatgtctgcattgtggcttgcacctcaactttgtttgggtggtataagcgaagcattcaatgctattggccaaaatgaattctattacaaagagtttccgaggactatgtctagtatttctgcttccctttgtggattgggaatggctgcaggaaacttggtatcttcttttgtattcaacactatagaaaacgttacttcgagaggaggaaaagaagggtggatttctgataatattaacaagggtcgttacgacaagtactatatggttatagctggagttagtgctcttaatttgctgtattttttagtttgcagttgggcttatggacctacagttgatcaagtatctaaggtgagcgacgaaaatgattccaaggagaaagattcaactgaattcaagaaggtgaatccactatttgatgaaactagttcaaatgggaaagagttaacagaaatcaagaatggtggtcaggctgagaaagtattcaagattagtgaagaaaatggatcaaaggaggaagagttaaccaaggattaatgaggttaattcagatagagatgttgaagtggcaaaaatgtatggttagtatatatgttgaactctagtcagcttgttagattatagagcaaaagtcctgaataggaaatgatcatgattcacactcaaattggatagtcatatattcctttatcctgtttgttttgataagtattagtcacagatatgggtaggcaatatatatttaaaatttgcttatgtataccctttttgatagagaaatattatttaaacaaccaaaacttgccaacttatttgacaatcgaatgaaaatgcatcatttacaattctaa

SEQ ID NO: 10566 - DNA, 2187 bp, Glycine max; identical to SEQ ID NO: 10560

SEQ ID NO: 10567 - DNA, 2288 bp, Medicago truncatula
atggacaaggaacttcaactttgttctgttgatgctgctgatgaagaagaaatggtttctcagcaaaaaccacaaagaagcaagggtggtcttgtcaccatgccttttatcattgggaatgaagcacttgctaagatggcaagtgtgggactattacccaacatgatattgtatttgatgggatcatacagacttcaccttggcatatctactcagatacttcttttatcctctgcagctagcaatttcacacctgtgattggtgcttttattgcagattcttatcttggtcgcttcttaggtgtcggaataggttcttctatcagtttcctgggaatgtcactgttgtggttaacagccatgatcccggcggcacggccttctgcttgcaaccatccatctgaaggttgtgaatcagcaacaccaggtcaattggcaatgttattctctgccttaattctgatagcaattggaaatggtggtattacatgttctttagcatttggtgcagaccaagttaatagaaaagataatcccaataactatagggttttggaaatattcttcagttggtattatgctttcataactatagctgtcataatagctctcaccggaatagtatatatccaagatcatcttggttggagaattggttttggtgttccagcagcactcatgcttatatccactgtcttgttctttcttgcttctccactttatgtgaaaattacacaaagaaccagcttgctcactggttttgcacaagtatctgttgctgcctataaaaacagaaaactttcattgccacctaaaacatctcctgaattttaccatcacaagaaagactcagaccttgttattccaactgataaactaaggtttctaaataaagcttgtgttattaaggatcatgaacaagatatagcctcagatggttcagcgataaatcgttggagtctatgcacagtagatcaagttgaagaactaaaagccattattaaagttattccattgtggtcaacagcgatcacaatgtctattaacattggaggctcatttggattgctgcaagctaaatccttagacagacatatcatttcaagttcaaactttgaagtaccagcaggatctttttctgttatcttgatagttgcaatattaatatggataattatctatgatcgtgttcttattcctttagcatcaaagataagagggaagcccgtaattatcagcccaaagaaaagaatgggaattgggttgttttttaattttcttcacttgataactgcagcaatttttgagactgtaaggagaaaggaagcaatcaaagaaggatatttgaatgatactcatggagtgttgaaaatgtctgcaatgtggcttgcacctcaactttgtttggctggtatagcagaaatgttcaatgttattggccagaatgagttttattacaaagagtttccaaagagtatgtctagtgttgctgcttccctttctggattggcaatgggtgtaggaaacttggtatcctctttagtattgagcattatagaaagcactactccaagtggaggaaatgaagggtgggtttctgataatattaacaaaggtcatttcgacaagtattattgggttatagttggaattaatgctctaaatctattgtattacttagtatgcagttgggcttatggacctacagttgatgaagtatccaatgtgagtaaagaaaatggttccaaagtggaagaatcaactgaattcaagcatatgaatccacactttgatgacaaggttagtggtgaaactagttcaaaggagaaagagttaactgaattcaagaatggggcccaggttgagaaagtattcaagaatagtgaacaaagggacttgaaggaggaagatttgtgatagaaggcttatatttcgtccaattcatttggagaaatgttataaacgctttttttaacactcctaacacctcatcttttatttgatgaaattcacgtgggactcatcattgtatgagggattcatttttaaagcgtgggatcaacatgtgtttcacccaataataaaatggtgttagagagtgttagaagaatgtgtccataacacttctcattcatgaattattatttttttttaggaattttagttagcatattttttatttttattttggtatattggtattttcttatggaccttattatgacacatggatgtgagcatttatttagagtagtaagtaatgtcaataaatttgatttgatatcttt

SEQ ID NO: 10568 - DNA, 1004 bp, Zea mays
gaaatccgcagattcccgtcgctacttcggccacatggctgcagcggcggcgtggaccggcgccgcatcccccaactcgctgctgctctcgcgctcgcctccccacgccgccgtgctcgcgccttcgccggggagctccatgcggaggcggctcctgctcggcgtcggcaccccggccgtggcggcgctggcggccgcggcgccgccagcggtgctgcaggacggggcggtcactgtgctcatcaccgccggcgcctactctcttgtgcgcgtcttcgacgagctcaccgagcggcggctcatcgaaaagagcttgagcaggaaggttgtgcacgtgctatccggcgtcctgttcatgtcatcttggcccctgttcagggaattgctgagaggtccactctattatgtcctggtgctgctgttcagcgttttagtcttctggcgtgagtcccccatcgggatcgtctccttgtcgatgatgagcggtggcgatggttttgctgacattgttgggaggaggtatggctcagcgaagctgccattcaatcggaagaagagctgggccgggagcatctcgatgttcatttctggtttcctgctgtccgcgatgatgatgctctacttctcaagcctgggttacattgatgttatctgggaagaggcacttggtaagctggcgcttgttgcactagcagcgacagtagtggagtgcgttcctgtgaccgaagttgtagatgacaacatatctgttcctttggccaccatgctggtagcttttctcttgtttagctccaaccgcacaatagttaattaaaatactactagtgcattatttaagacatgtgatgagttcttcagtgatgagttgtgcttacttttgcttcctatgtgatctctagtacttgatggcgacggcctaacatctcccagtttttggtgtctccttgccttggctgttttggtggaaaagtattgctagcttgtctaaaaaaaaaaaaaaaaaa

SEQ ID NO: 10569 - DNA, 1198 bp, Zea mays
gaagcagtcgtacttgtacactccttgtctccttcgctttggcacactggacacgtccaccacgtgaacacgtcaacagaagtgacccatcaaggggcccacaggtccacgagcccgagtgacgactgacgacagatcgcttgtgcgtcgctaacccgccgctagtcggctagtgggtgggaaatccgcagattcccgtcgctacttcggccacatggctgcagcggcggcgtggaccggcgccgcatcccccaactcgctgctgctctcgcgctcgcctccccacgccgccgcgctcgcgccttcgccgggaagctccatgcggaggcggctcctcctcggcgtcggcaccccggccgtggcggcgctggcggccgcggcgccgccagcggtgctgcaggacggagcggtcactgtgctcatcaccgccggcgcctactctcttgtgcgcgtcttcgacgagctcaccgagcggcggctcatcgaaaagagcttgagcaggaaggttgtgcacgtgctatccggcgtcctgttcatgtcatcttggcccctgttcagcaattcgacagaagcacggtatttcgccgcggttgtcccgttcctgaactccatgaggcttctgatatatggactccgtctctacactgatgaagctctggtaaaatcagtgacacgtgaaggaaaaccagaggaattgctgagaggtccactctattatgtcctggtgctgctgttcagcgttttagtcttctggcgtgagtcccccatcgggatcgtctccttgtcgatgatgagcggtggcgatggttttgctgacattgttgggaggaggtatggctcagcgaagctgccattcaatcggaagaagagctgggccgggagcatctcgatgttcatttctggtttcctgctgtccgcgatgatgatgctctacttctcaagcctgggttacattgatgttatctgggaagaggcacttggtaagctggcgcttgttgcactagcagcgacagtagtggagtgcgttcctgtgactgaagttgtagatgacaacatatctgttcctttggccaccatgctggtagcttttctcttgtttagctccaaccgcacaatagttaattaaaatactactagtgcattatttaagacatgtgatgagttcttcagtgatgagttgtgcttacttttgcttcct

SEQ ID NO: 10570 - DNA, 1120 bp, Phaseolus vulgaris
gttcctgtttcagcgtgttgtggcaagggggtagtagtgtatccttgttatcctatggcgaaggacgttgaggttacagagcgtggctccttctctgggaaggactaccatgaccctcctcctgcacccctcattgatactgaggagctaacaaagtggtccttctacagggctctcattgctgagttcattgccactttgcttttcctctacattactgtgctcacagtgatagggtacaagcaccagagtgacctcaaggaccatggtgatgcctgtggtggggttggcattcttggcattgcatgggcctttggtggcatgatcttcatccttgtatactggactgctgggatatcagggggtcacattaacccagcagtaacatttgggctgtttttggctcgcaaggtgtctttgatccgtgctatcatgtacatggtggctcagtgcttgggggctatctgtggagttggcctggtcaaggccttccaaaagtcttactacaacaggtatggtggtggggctaattccttggctgatgggtacagcacaggtactggattgggtgccgagatcattggcacctttgttttggtatacactgtcttctctgccactgatcccaagaggaatgccagagattcccatgtgccggttttggctccacttcccattggatttgctgtgttcatggttcacttggccaccatcccagtcactggcacaggcatcaaccctgctaggagtcttggagctgctgttatctacaacaaagataagccctgggatgaccattggatcttttgggtaggaccatttattggggcagccattgcagctttctaccaccagttcatcttgagagcaggggcagttaaggcccttggatcattcaggagtaacccccatgtttgagttgtctttctcttcatgatggctcttttggaaagaagataattggagagatggagttgatattgcaagtttaataatgggaaatgcttttggtgtttgcaacgtttctctcaattatgtcttcaagattgtggataagtgtagattaaagtctctttcatgacagggggagccttttgctaaaaaaaaaaaaaaaaaaaaa

SEQ ID NO: 10571 - DNA, 1413 bp, Glycine max
ctcttccacacacacttgcccatcatcaaagttttttcctttctctgctctttgccttctctgacacatttggtgccttgtagagcgtgttttggcaggaaggtggtatggcgaaggacgttgaggttgctgagcgtggctccttctctgggaaggactaccaggaccctccaccagcaccactcattgatgctgaggagctcacaaagtggtccttttacagggctctcattgctgaattcattgccactttgctcttcctctacattactgtgctcacagtcatagggtacaatcaccagactgacctcaaggaaaatggtgaaatctgtggtggggttggcattcttggcattgcatgggcctttggtggcatgatcttcatccttgtctactgcactgctgggatttcagggggtcacattaacccagcggtgacatttgggctgtttttggctcgcaaggtgtctttgatccgagccatcatgtacatggtggctcagtgcttaggtgctatctgtggagttggtttggttaaggctttccaaaagtcttacttcaacaagtatggtggtggggctaattccctcgctgctgggtacagcacaggtactggattgggtgctgagattattggaacctttgttttggtctacactgtcttctctgccactgaccccaagaggaatgccagagattcccatgtgccggttttggctccacttcccattggatttgctgtgttcatggttcacttggccaccatcccagtcactggtactggtatcaaccctgctaggagtcttggagctgctgttatctacaaccaagataagccatgggatgaccattggatcttttgggtaggaccatttattggggcagccattgcagccttctaccatcagttcatcttaagagcaggtgcagctaaggctcttggatcattcaggagtaacccccataattgagttgtctttctcttccttatgatggctctagtggaaagaagataattggagagatgggggttgatatggcaagtttaataataattgggaatgcttttggcttgtgttttgcaacgtttctttgaccctctcgattatgtcttcaagattgtggataagtgtagattaaagtctctttcatgacagggggagccttttgcactttcctctgtggtgttcttccctttagtgtgtcatttttttcttttaagttattctcttcagctgtcatctctgtactcaaaatatatttatggaaaatgttaaattttaattttaattacattcctgctttttactacattatcatcagccctgacacactaacaaagaaactaacgttgtaagtcaagaaacaaaatgaagaaaaattacaaaaagaaagaaagagattaatgcaatc

SEQ ID NO: 10572 - DNA, 1274 bp, Glycine max
gcccatcatcaaagtttcttcctttctctgctctttgtcttctctgacacatttggggccttgttgagtgtgtttttgcaagagggtatggcgaaggacgttgaggttgctgagcgtggctccttctctgggaaggactaccaggaccctccaccagcaccactcattgatgctgaggagctcacaaagtggtccttttacagggctcttattgctgagttcattgccactttgctcttcctctacattactgtgctcacagttatagggtacaagcaccagacggatcatgctgatgcgtgtggtggggttggcattcttggcattgcatgggcctttggtggcatgatcttcatccttgtctactgcactgctgggatttcaggaggtcacattaacccagcagtgacatttgggctgtttttggctcgcaaggtgtctttgatccgagccatcatgtacatggtggctcagtgcttgggtgctatctgtggagttggtttagttaaggctttccaaaagtcttacttcaacaagtatggtggtggggctaattccctcgctgatgggtacagcacaggtactggattgggtgctgagatcattggcacctttgttttggtgtacactgtcttctctgccactgaccctaagaggaatgctagagattcccatgttccggttttggctccacttcccattggatttgctgtgttcatggttcacttggccaccatcccagtcactggcactggtatcaaccctgctaggagtcttggagctgctgttatctacaaccaagataagccatgggatgaccattggatcttttgggtaggaccatttattggagcagccattgcagccttctaccaccaattcatcttgagagcaggtgcagccaaggcccttggatcattcaggagtaacccccataattgagatgtctttctcttcatgatgatggctctagtggaaagaagataattggagagatggaggttgatatggcaagtttaataatgggaaatgcttttggctttgtatttgcaacgtttctttgaccctctcgattatgtcttcaagattgtggataagtgtagattaaagtctctttcatgacagggggagccttttgcactttcctctgtggtgttcttccctttagtgtgtcatttttcttttttaagttattctcttctgtcatctctgtactcaaacaaatcatgggaaatattttaaattttaattttacattcctgcttttttactac

SEQ ID NO: 10573 - DNA, 1302 bp, Glycine max
ttttttttttttttttttttttagtaaaaaagcaggaatgtaaaattaaaatttaaaatatttcccatgatttgtttgagtacagagatgacagaagaaaataacttaaaaaagaaaaatgacacactaaagggaagaacaccacagaggaaagtgcaaaaggctccccctgtcatgaaagaaactttaatctacacttatccacaatcttgaaaacatagtcgagagggtcaaaaaaacgttgcaaatacaaagccaaaagcatttcccattattaaacttgccatatcaacctccatctctccaattatcttctttccactagagccatcatcatgaagagaaagacatctcaattatgggggttactcctgaatgatccaagggccttggctgcacctgctctcaagatgaactggtggtagaaggctgcaatggctgccccaataaatggtcctacccaaaagatccaatggtcatcccatggcttatcttggttgtagataacagcagctccaagactcctagcagggttgataccagtgccagtgactgggatggtggccaagtgaaccatgaacacagcaaatccaatgggaagtggagccaaaaccggaacatgggaatctctagcattcctcttagggtcagtggcagagaagacagtgtacaccaaaacaaaggtgccaatgatctcagcacccaatccagtacctgtgctgtacccatcagcgagggaattagccccaccaccatacttgttgaagtaagacttttggaaagccttaactaaaccaactccacagatagcactcaagcactgagccaccatgtacatgatggctcggatcaaagacaccttgcgagccaaaaacagcccaaatgtcactgctgggttaatgtgacctcctgaaatcccagcagtgcagtagacaaggatgaagatcatgccaccaaaggcccatgcaatgccaagaatgccaaccccaccacacgcatcagcatgatccgtctggtgcttgtaccctataactgtgagcacagtaatgtagaggaagagcaaagtggcaatgaactcagcaataagagccctgtaaaaggaccactttgtgagctcctcagcatcaatgagtggtgctggtggagggtcctggtagtccttcccagagaaggagccacgctcagcaacctcaacgtccttcgccataccctctcgcaaaaacacactcaacaaggccccaaatgtgtcagagaagacaaagagcagagaaaggaagaaactttgatgatgggcaagtgtcc

SEQ ID NO: 10574 - DNA, 1201 bp, Samanea saman
caaagtctctacctttcctcgtgatcctttctggggtttgatcttttccagctttaatggctaaggacgttgaggttgcagagcgtgggtcttactccgccaaggactaccatgacccacctccggcaccgctcattgacgcggaggagctcggcaagtggtccttttacagggctttgattgctgagttcattgccaccttgcttttcctttacattaccgtcctcactgtcatcggctacaagagccagtccgataccaaagccggcggcgatgtctgtggcggcgtcggcatcctcggcattgcctgggccttcggtggcatgatcttcattcttgtttactgcaccgcgggaatctcaggaggtcacattaacccagcagtgacatttgggctgttcttggctcgcaaggtgtcactgatcagagccatcttgtacatggtggctcagtgcttgggtgctatatgtggagttgggttagtgaaggccttccaaaaggcttactactccaggtacggtggtggtgctaacactctgagcgacggctacagcaccggcaccggcttaggcgctgagatcatcggaacctttgttttggtttacactgtgttctccgccactgatcccaagaggagcgctagagactcccatgtgcctgttttggctccacttcccattggatttgctgtgttcatggttcacttggccaccatcccagtcaccggcaccggcatcaacccggccaggagtctcggagctgctgttatcttcaaccaacagaaagcctgggatgaccattggatcttctgggtgggaccattcattggggcagccatagcagcattctaccaccagttcatcttaagggcaggtgcagctaaggcacttggatcattcaggagcaacccttctgtttaaaatcttcttgttaattaatgttttaatgggttcaaatggagcaagatgcttcaaagagatagagtctgtgatcatgtgacagagagggagccttttgtaataccctgttgtctttttgagcactttccttttgaatcttcttcttcagtgtgcctttcctttttcctcttttttttttagcctttttctttttcagtcattctctggtcttctctgtactcaacatatgattaatggggraaaaaaataaaaatattttaattaaaaaaaaaaaaaaaaaa

SEQ ID NO: 10575 - DNA, 1251 bp, Medicago truncatula
cataataaatatgagtacaaaggatcacagaagagaataacttaaaaaagaaaagatgacacactaaagagaatacagaggaaagtgtaaaaaggctccccctgtaacgaaagagactttaatttacacttatccacaatcttgaagacacaattgaagaggtgttgcaaatacaaaacaaatatcatcaattaatccatctcttcaattatcttctttttccattaaaaccatgatgaagaggaagaacagtgcacttaaacagtagggttactcctgaatgatccaagagctttaacagcacctgctcttaagatgaattgatggtagaaggctgcaatggctgccccaatgaatggtccaacccaaaagaaccaatggtcatcccagggcttatctttgttgtagataacagcagaaccaagacttctagcaggattgatgccagtgccagtgactgggatggttgccaaatgaaccatgaatacagcaaagccaatgggaagtggtgccaaaaccggcacatgtgaatctctagcacttctcttaggatcagtggcagagaaagcggtgtaaaccaaaacaaaggtaccaacaatctcagcacctaatccaacaccagtactgtaaccatcatggagaaaattagcaccaccaccatatctatcaaagtaagcactttgaaaagccttaaccaacccaactccagcaatagctcctaaacactgagccaccatgtacataattgctctgattaaagacaccttacgagccaaaaatagcccaaatgtcactgctgggttaatgtgaccacctgaaattccagcaatgcagtaaacaaggacaaagatcatgccaccaaaagcccaagcaataccaagaattccaacaccaccacaagcatcaccaccagctttaacatcagtttgaatactgtaaccaatcacagtcaaaacagtaacgtaaaggaaaagtaaagttgcaatgaactcagcaataagagccctataaaaggaccattttgtgagttcttcagcatcaatgagtggtgctggtggagggtcatggtagtctttgttagagaaagagccacgttcagcaacttcaacatcctttgccatttggattacccttatgaaacaacacactcaaacaagaatggaagttgttagagaagacaaagaacggagaaaggaagagactttgatgatagagaagtgtcccccatcgtctcactggccgacttgaccc

SEQ ID NO: 10576 - DNA, 1433 bp, Glycine max
ggtggtggtgtagtaaaagtgaggtcaaggtcggtgaaatagagactcaaaaccaaatagtttattgctattattatttggccttgttttttcagtgtcaaattgcattattgaaataatcaaatgcactaaccacactccatcacccccatatataccccttctcctctcatactaattaacacactcatccaaacaaccttctttctttttctgtgagcctttctttcaggttcttaacttgatcagtgtgcagtgtccaaatcataagggtagttgcaaattgcaatggctaagcatgatgttgagggtggttccttctctgcaaaggactaccatgatcctcctccagcaccgttgattgatgctgaggaactcacacagtggtccttctacagggctttgattgctgagttcattgccacaatgctcttcctttacatcacagtgctcactgtgattggttacaagagccagagtgatgtaaaggctgggggtgatgtgtgtggtggagttggcattcttggcattgcttgggcctttggtggcatgatcttcattctggtgtactgcactgctggaatctcagggggtcacataaacccagcagtgacatttgggctcttcttggctcgcaaggtgtctttgattagagcaataatgtacatggtggctcagtgcttgggagccatatgtggagttgggttggttaaggccttccaaaaggcttactacaacaggtatggtggtggggccaatgagctcagtgaagggtacagcacgggtgttggattgggtgctgagatcattggaacctttgttttggtttacactgtgttctctgcaactgatcccaagaggaatgctagagattctcatgtgccggttttggctccacttccaattggctttgctgtgttcatggttcacttggcaaccatcccagtaacaggcactggcattaaccctgctaggagtctaggagctgctgtcatgtacaaccaacagaaggcctgggatgaccattggatcttttgggttggaccatttattggagcagccattgcagccttctaccaccaattcatcttgagagcaggtgctgctaaggctcttggatcattcaggagcaaccccgctatttgagtcaatttaatttcttcttcatgatgagttcaaaatgaagaggaaattataagaataataaaaatattgtcaataatggcaattgcttgtgcttttattgcaaccttttctttgatcctattatgtagattaaaggttcttttcaagacaagagccattggtaaataccctttagtattttcaagcactttcctttctttcagtgtgtgatattttcttttaggtaatttaatctcttgtactcaacgtggaaaaaaatatatataaatccatgcttttacttaaaa

SEQ ID NO: 10577 - DNA, 1051 bp, Pyrus communis
ctctctcttttcccaaagcccaagactctgtttttctctgtctctccggactgtgtgaagcttaagctttattaatggccaaggacatggaagttgcagagaggggctccttctcagccaaggactaccacgacccaccgcctgcaccgctcatcgacgcggccgagctcaccaaatggtcgttttacagagctctcatagctgagttcgtagccactcttctcttcctctacgtcactgtgctcacagtgattggctacaagagccagaccgacccagctgtcaatgctgacgcttgcggtggggttgggattctgggaattgcttgggcctttggaggcatgatctttgtgcttgtttactgcactgctgggatttcagggggtcacattaacccggcggtgacatttgggctgttcctggcgcggaaggtgtcgctggtgagagctgtgctgtacatggtggctcagtcgttgggagccatagccggtgttgcgctggtgaaggctttccagaagagctactacatcaagtacggcggcggagccaactcacttagcgatggatacagcaccggagttggattggctgctgagattattggcacctttgtgctggtttacaccgtcttctctgccactgaccccaagaggagtgctagagactcccatgttccggttttggctccactgccaattgggtttgctgtgttcattgtccacttggccaccatcccaatcactggcactggcatcaaccccgctagaagtcttggagctgctgttatctacaacaaagacaaggcttgggatgaccaatggattttctgggtaggacccttcattggagcagcaattgcagccttctaccaccaatttatcttgagagcaggagctgtcaaggcccttggatcattcaggagcaacccccatgtttaaatttgaatattttcagataatatgaagggatttggaggaacaataagttaattattaaggggggaagtagtatttatattaaattgtggcttaaaaaaaaaaaaaaaaaaaaa

SEQ ID NO: 10578 - DNA, 1098 bp, Glycine max
ggaacacactcatcaaaaaacccttctttctttcaggttcattacttgatcagtgtcaaaagggtagttgcaaattgcaatggctaagcatgatgttgagggtggttccttctcggcaaaggactaccatgatcctcctccagcacctttgattgatgctgaggaactcacacagtggtccctctacagggctttgattgctgaattcattgccacattacttttcctttacatcacagtgctcactgtgattggttacaagagccagagtgatgtcaaggccgggggtgatgtgtgtggtggagttggcattcttggcattgcttgggcctttggtggcatgatcttcatccttgtttactgcactgctggaatctccgggggtcacataaacccagcagtgacatttgggctcttcttggctcgcaaggtatctttgattagagccataatgtacatggtggctcaatgcttgggagccatatgtggagttgggttggttaaggcattccaaaaggcatactacaacaggtatggtggtggagccaatgaactcagtgaagggtacagcacaggtgttggattgggtgctgagattattggaaccttcgttttggtctacactgtcttctctgcaactgaccccaagaggaatgctagagattctcatgtgccggttttggcaccacttccaattggctttgctgtgttcatggttcacttggcaaccatcccagtaacaggcactggcattaaccctgctaggagcctaggagctgctgtcgtgtacaaccaacagaaggcctgggatgaccattggatcttttgggttggaccatttattggagcagccattgcagccttctaccaccaatttatcttgagagcaggtgctgctaaggctcttggatcattcaggagcaaccccactatttgagtcaatttcctcttcataatcatgggtttcaaaaaggagataattggaagcaaaatgacttgatattgtaagaataataatgttattaataatggcaattgcttgtgcttttattgcaagcttttctttataaaaaaaagaaaaaaaaaaaaaaaaaaaaa

SEQ ID NO: 10579 - DNA, 1218 bp, Mimosa pudica
tctctccacattattcactctcaaaccctcaaactttccctctctctctatctttcttttgtggggtgtgacttttgttagagtgttcttcaatggcaaaagatgtggaagttgcagagcgaggatcatattcagcgaaggactaccatgacccaccacctgcaccactgattgacgcagaagagctgggaaagtggtccttctacagggctttgattgctgagttcattgccactttgcttttcctttacattactgttctcactgtcattggctacaagagtcagactgataccactgttgctactggtgatgtctgtggtggtgttggtattcttggcattgcttgggcctttggtggcatgatcttcatccttgtttactgcactgccggaatctctggaggacacatcaacccagcagtgacatttgggctatttttggcacgcaaggtgtcactgatcagagccatattgtacatagtggctcaatgcttgggtgctatctgtggagttggattagtgaaagccttccaaaaggcttactacaccaaatatggtggtggtgctaatactcttggtgatggctacagtgttggcactggtttaggtgctgagattattggaacctttgttttggtttacactgtcttctctgccactgatcccaagaggaacgctagagattcccatgtgcctgtcttggctccacttcccattggatttgctgtgttcatggttcacttggccaccatcccagtcaccggtaccggcattaacccggccaggagtttcggagctgctgtgatcttcaaccaacagaaagcctgggataaacattggatcttctgggtgggaccattcattggtgcagccatagcagcattctaccaccagttcatcttaagggcaggagcagccaaggcacttggatcattcaggagcaacccctctgtttaaatctctcttgtgataattaattattaatattaattaatctttaaacaatggattcaaatgggaacaaagatgctacaaagagatgagtctaatgttcatgtgacagagggagccttttgtaataccctcttgtctttttgagcactttccttttgaatcttcttcttcagtgtgcccttttctttttcttttttattttcagtcattccccggtcttgtctgtactcaacaatatgatttatgggaggaaaataaaaaa

SEQ ID NO: 10580 - DNA, 2553 bp, Glycine max
atgaaggccgtgcccctaccctatcaggaatttagagggaacggggtgctagattttgcttctggtgctgctgctgctgtttcagattcgttgttacttccacagcaagagcaatttctgcaaaggtggaacccccaaagggaaaacttttgctatgtgggcattgagccctcttctggtttggaccgcaaaaggaaaacaagcagccctcccacatcctcctctacactatcttcctcacgcgccagcagcggctccacggatagcacgacaggcacggccacggcgaccgcggctgagaaggagaacaacccacctcaagcagggttagaggttggacaggcaagatgtgggctgggaatggaggattgggagagtgtgttgtctgagtcaccaggtcaagatcattccattttgaagttgattatgggggacattgaggacccatctgtgggtttgaccaagcttttgcagggtggaagtggctctcaggatgttgaattcaatggggttggagtgggttttggtttggtggatcagagttctgtgcttttccctattcctagtgtgaactttgtgagcagcagcagcagcattgacccttctggtactgggaattgttctgatttccctttcaattctcaaactaatgttagccccaatgttcctagggttggttctggtgtgaatccaaacactactgggttccctgcttcagctagcaatctctcaccagtttcactccctcagggtgtgtttctgcctcaacaacaacaacagcatcatccaccaatagagcctctggatgagaagctacaagttctcaatcctcagttcattttgaaccaaaatcaatctcagtttatgccaaacgcgggtttggttttgcctttgacatatggccaactgcaagaaaatcatcaacttctccctcagcctccggcaaaacgcctgaattgtggcccaaattatcaggttccaaagacaccctttttggactctggccaagagctgttacttcggaggcagcaacagcagctccaactgcttcctcaccatcttctgcagaggccatccatggtggtggcaccaaagcaaaaaatggtgaactccggtggccaagacttggcgacccaccagcttcaacaggctataactgaacagcttttcaaagctgcagagctgatcgatgcaggtaatctggaactcgcgcacgggatattggcgcggctcaatcaccaactttctcccattgggaagccttttcagagggctgctttttatttcaaagaggccttgcaattacttctccattcaaatgccaacaacagttctttcaccttttcacccaccggccttctgctcaagattggtgcttacaaatcattctcagaaatctcaccagttctgcagttcgctaattttacttgtaaccaagcactgcttgaagctgtgaaagggtttgatcgcattcacataatagattttgatattgggcttggtggacagtggtcttctttcatgcaagagttagcactcaggaatggcggtgcacctgaactcaagatcactgcatttgtgtcaccctcccaccatgatgaaattgagctcagtttcactcaggagagcttgaagcaatatgctggggagttacgcatgccctttgagctggagattctgagccttgagtctttaaattctgcttcctggccccagccacttcgtgactgcaaagctgtagtggttaacatgcctattggctctttctcaaattacccatcatatctacctttggtccttcgttttgtgaagcagctcatgccaaaaattgtggttacattggatagaagttgtgatcgaactgatgcaccatttcctcagcatctgatttttgcacttcagtcttattcagggctgcttgagtcacttgatgcggttaatgttcacccagatgtccttcagatgattgagaagtattatcttcagccatcaatggagaagcttgttttgggtcgacatggtttgcaggaaagagcacttccttggaagaaccttctcttgtcatctgggttttcaccattgacatttagtaactttacagaatcccaggctgagtgtttggtgcagaggactcctagcaaggggttccatgttgagaagaggcagtcttcccttgttctttgctggcaaaggaaggatctcatctcagtttcaacttggagatgctaagcagagccattctgcacctttgaacgaccaattaattctatattcgaaggtgctacataacttaccgcttctattgatctttcttgcttgaatttgccttggctatggttctatgctaattgtctgtttttaggatttattattttcagttaaggaagtgaacatattaattagcaatggcaatttatgagccctgatatgaagtgtattattataaacatgagcattctatttatgcattttgtcctgttttaattgcctaaatttatgggcttttcttgtatgttttacaagaaagtaacactaattaccctgtaaagttga

SEQ ID NO: 10581 - DNA, 2800 bp, Glycine max
agcagaaaacacaaggaggacaaggctactccacagacaagagaaagaaagaaaaccccatttaaagttatttctttttgtactgtgcacatcacaagaagaacaaagatgggtttttgaaccatcacataaaagaaaaagagagagaaacaaaaaagaaatagggatattggagaaaaacaagaggaagctgtgcgagtgaaagaagatggaggagaatgaatgaggtgaggtgtgtttgttattcttcttgttgttgttttgttgttgctgaaatgggtttgttgaacacaagtgcatgtatttgactactagtgcgttaaagctcagatctttgtcttttgttctcccacctggtattttgaggttatcaatttgtgcactgagtccttccttaaccgaaacccattttgttggtttttttgggggttgttgagtttgtcttgtaccaacttgtcggggttgatttaaatgaaggccgtgcccctaccctttcaggaatttagagggaacggggttttagattttgcttctgttgctgctgtttcagattcgttgttactcccgcagcaagagcagtttctgcaaaggtggaacccccaaagggaaaacttttgctatgtgggcattgagcccgccgtttctggtttggacctcaaaaggaaaacaagcagccctcccacatcctcctctacactgtcttcctcacgcgccagcagcggcggctgcggaggctggggctccgcggatagcaccaccggtgcggccacggccacggtggccgagaaggagaacaacccacctcaaggagggttagaggttgttggacaggcaagatgtggactgggaatggaggattgggagagtgtgttgtctgagtcaccaggtgaagatcattccattctcaagttgattatgggggacattgaggacccatctgtgggtttgaccaagcttttgcagggtggaagtgcctctcaggatgttgaattgaatgggcttggagtgggttttggtttggtgaatcaaagttctgtgcttgaccccattcctagtgtcaactttgtgagcagcagcattgacccttctggtcctgggaattgtgctgatttccctttcaattcccacagtaatgttagccctaatgttcccagtgttggttctggtctgaatccaaaccctacaggattccctacttcagctagcaatctctcacaagtttcactccctcagggtgtgtttcagccacagcaacaacagcatcaaccaatagaacctctggatgagaagctacaggttctcaatccccagttcattttgtaccaaaatcagtctcagtttatgccaaacccgggtttagttttgcctttgacatatgcccagctgcaagaacatcatcagcttctccctcagcctccggcgaaacgcctgaattgtggcccaaaggctataactgaacagcttttcaaagctgcagagctgatcgatgccggtaatctggaactcgcgcatgggatattggcgcggctcaatcaccaactttctcccattgggaagccttttcagagggctgctttttatttcaaagaggccttgcaattacttctccatccaaatgccaacaacagttctttcaccttctcacccactggccttttgctcaagattggtgcttacaagtcattctcagaaatctcaccagttctgcagttcgccaatttcacttgtaaccaagcactgcttgaagctgtggaagggtttgatcgcattcacataatagattttgatattgggcttggtggacagtggtcttctttcatgcaagagttagcactcaggaatggcagtgcacctgaactcaagatcactgcatttgtgtcaccctcccaccatgatgaaattgagctcagtttctctcaggagagtttgaagcaatatgctggggagttacacatgtcctttgagcttgagattctgagccttgaatctttaaattctgcttcctggccccagccacttcgtgactgtgaagctgtagtggttaacatgcctattggctctttctcaaattacccatcatatctacctttggtccttcgctttgtgaagcagctcatgccaaaaattgtggttacattggatagaagttgtgatcgaactgatgcaccatttcctcagcatctgatttttgcacttcagtcttattcagggctgcttgagtcacttgatgcggttaatgttcacccagatgtccttcagatgattgagaagtattatcttcagccatcaatggagaagcttgtcttgggtcgacatggtttgcaggaaagagcacttccttggaaaaaccttctcttgtcatctgggttttcaccattgacctttagtaactttacagaatcccaggcagagtgtttggtgcagaggactcctagtaaggggttccatgttgagaagaggcagtcttcccttgttctttgctggcaaaggaaggatctcatctcagtttcaacttggagatgctaagcagagccattttgcacctttgaactaccaatttaattttaaattctaaagtgctacataacttacagcttctattgatctttcttgcttgaatttgccttgtctatggttctatgctaattgtctgtttttaggatttattattttcagttaaggaagggaagtgaacatattaattagcaactgaatgacgatttatgagcgtgatatgcagtgtattattataaataggggcattctatatatgcattttgtcctgttttaattgcctaaa

SEQ ID NO: 10582 - DNA, 2520 bp, Medicago truncatula
atggcctgcaaggatggtaataagcacttaatggataatggaaagtatgtacgttatacacctgagcaggttgaagctcttgaaaggctttatcatgaatgtcctaaaccaagttcaattcgaagacaacaacttattagagaatgtcctattctttctaatattgaaccaagacaaatcaaagtttggtttcagaatagaaggtgtagagagaagcagagaaaagagtctttcaggttgcaaggtgtgaataggaagttgacagccatgaataagctgctgatggaggaaaatgataggttgcagaagcaggtgtctcacctggtgtatgagaatggctattttcgtcaaaacacccaaaatgcaaccaaagacacgagttgtgattcagtggtgactagtggtcagcacaatatgactagtcaacatcccccaagggatgcaagtcctgcagggcttttgtccattgcagaagaaactttagcagaatttctttcaaaggctactggaaccgctgttgagtgggtccaaatgcctggaatgaagcctggtccggattccattggaatcgtcgctatttctcatggttgcactggtgtcgcagcaagagcttgtggtctagtgggactagaacccactagggttgcggaaatcctaaaagatcgtcctttgtggtttcgtgattgccgagctgttgatattgtcaatgtgctgcccactgctaacggtggaactattgagctgctttatatgcagctttatgcaccaaccacattggcacctgctcgtgatttctggttgttacgctacacttctgttgtagaagatggcagcctagtgatctgtgagaggtctcttaaaaatactcaaaatggtccaagcatgcctcctgtgccgcattttgttagagcagacatgctgcctagtgggtacctgataagaccttgtgaaggaggtggttccatcatccacattgttgatcatatggacttggagccatggagcgttccagaagtactgcgtccactatatgaatcaccaatggtgctggctcagaagactactatggcggctttacgtcatctaaggcagatttcgcatgaagtttctcagcccaatgtcactgggtggggaagacgaccagcagctctgcgggcacttagccagagattgagccggggtttcaatgaggcactcaatggatttactgatgaagggtggacaatgatgggcaatgacggtgttgatgatgtcactattctagtaaattcatcacctgacaagttaatgggtctgaatctttcctttggcaatggatttccttctgtcagtaatgctgtgttatgtgccaaggcatcaatgctattacagaatgtgcctccagccattctcctaaggttcctgcgtgaacatagatcagaatgggcggaccataatatggatgcttacacagctgctgccattaaagttggcccttgcagcttaacaggatctcgcgtaggaaattacgggggtcaagtgattctcccgctagcacacactattgagcatgaggagtttttggaagttattaagttggacggagttgcccattctcctgaagaaatgatggccagagaattgtttctgttgcaactctgcagtggaatggatgagaatgctattggcacctgtgcagaacttatatttgctccaattgatgcttcatttgctgatgatgccccacttctaccctctgggtttcgtatcatccctcttgaatctggaaaagaatcgtccagtcctaatcgcactcttgatcttgcatctgcccttgacattggccctactggaaaccgagcatcaagtgataatgctggaaattctggctgtgtgagatctgtgatgacaatagcatttgaatttgcatatgaaagtcatatgcaagagaatgtagcatgcatggcacgccaatatgttcgcagtattatatcatcagtccaaagggtagcgttagcactttctccttctaatctgagttcacatgctgggctgaggtcaccgctaggtacccctgaagcacaaacccttgctcattggatctgcaacagttatagatgctacttaggcgtggagctacttaaatctaatactgaaggaaaagaatctgtactcaagtccttgtggcaccactctgatgctgtattatgctgcactctaaaggcaatgccagtgttcactttctcaaaccaggcagggcttgacatgctggagactacgcttgttgcattacaagatataagtctggagaaaatatttgatgataatggtcgaaaaactctcttttcggagttcccccagattattcaacagggttttgcatgtctgcaaggtggtatttgtctctcaagcatgggacgacctgtctcatacgagagagctgttgcttggaaggtgctgaatgatgaacagaatgctcattgtatttgctttatgtttgtgaactggtcttttgtttgacattatgttcggagttatagg

SEQ ID NO: 10583 - DNA, 2718 bp, Glycine max
atgtcctgcaaggatggtagcagaaacggaatcggaatggataacgggaagtatgtccgttacacgcctgagcaggttgaagccctagaaaggctctatcacgattgccccaaacctagttccattcgccgccagcagctcattcgcgagtgccctattctctccaacattgagcccaaacaaatcaaggtttggttccagaacagaagatgtagagagaagcagaggaaggagtcgtcgcggctgcaagctgtaaataggaagttgactgccatgaacaagttgctcatggaggagaatgataggttgcagaagcaggtctctcaactcgtctatgaaaatggctattttcgtcaacacacccagattacaacgcaggcaaccaaagacacaaactgtgaatcagttgtgacgagtggtcagcacaatttgacaactcaacatcccccacgggatgcaagtcctgcagggcttttgtccattgcagaagagactttagcagaatttctttctaaggctactgggactgctgttgagtgggtccaaatgcctggaatgaagcctggtccggattccattggaatcgttgctatttctcatggttgcactggtgtggcagctagagcctgtggtctagtgggactagaacccactagggttgcagaaatcctcaaagatcggcctttgtggtttcgtgattgccgagctgttgatgttctcaatgttctgcccacagcaaatggtggaaccattgagctgctttatatgcagctatatgcaccaaccacattggctcctgctcgtgacttctggttgttgcgctacacttctgttttagaagatggaagcctagtgatctgtgagaggtctcttaaaaatactcaaaatggtccaagcatgcctcctgtgcagcattttgttagggcagagatgctgcctagtgggtacctgatcagaccttgtgaaggaggtggttccatcatccacattgttgatcatatggatttagagccatggagtgtgccagaagtgctacgcccactgtacgaatcatcaacagtactggctcagaagacaactatggcagccctacgtcatctaaggcagatttcacatgaagtttctcagtccaatgtcactgggtggggtagacgaccagcggcactacgagctcttagccaaagattgagccggggtttcaatgaggcactcaatggatttaccgatgagggatggacaacaattagcaatgatggtgtagatgatgttactattctagtgaattcatcccctgacaagttaatgggtctgaatctttcctttgccaatggatttccgtctgtcagtaatgcagtgctatgtgccaaagcatccatgctattacagaatgtgccccctgccattctcctaagattcctgcgggagcatagatcagaatgggcagacaacaatatggatgcttacacagctgctgctattaaagttggcccttgcagcctatcaggatcctgtgttggaaactttggcggtcaagttatactccccctagcacacacaattgagcatgaggagtttttggaagtcattaaattggaaggaatagctcattctcctgaagacacaataatgcccagagaaatgtttcttttgcaactctgcagtggaatggatgagaatgctgttggcacctgtgctgaacttatatctgctccaattgatgcttcgtttgctgatgatgccccccttctaccttctggatttcgcatcattcctcttgaatctggaaaggaagcttccagccccaatcgtacacttgaccttgcatcttcccttgacgttggtcccagtggaaaccgagcttcaaatggatctgctggaaattccagctgtatgagatctgtgatgacaatagcatttgaatttgcatttgaaagccatatgcaagagcatgtaacatctatggcacgccaatatgttcggagcattatatcatcagtccaaagggtagcattagcactttctccttctcatttgagttcacatgcagggcttaggtcaccattgggtactcctgaagcacaaacccttgctcattggatctgcaacagttataggtgctacttgggtgtggagctacttaaatctaataacgaggggaatgaatctttgctcaagtccttgtggcatcactctgatgcaatattgtgctgcactctaaaggcattgccagtgttcactttctcgaaccaggccgggcttgacatgctagagaccaccctagttgcattacaagatataactttagagaaaatatttgatgatcatggacgaaaaattctcttttcagagtttccacagattatacaacagggttttgcatgtcttcaaggtggtatttgtctttcaagcatggggcgacctgtctcgtacgaaagagttgttgcttggaaggtgctgaatgaagaagagaatgctcattgtatttgctttatgtttgtgaactggtcttttgtttgacatcttgttctgagtacacttgggcttattgtatcttagtgtaagataaggatttactccaagacactcgtgctttgttggttgatgttttactgtatttgcactaaatacttggattgcacattaaatgactatttatttcttagtctatgtaacttgtttccttattcaacatccagctaatatttatgcattattaag

SEQ ID NO: 10584 - DNA, 3046 bp, Glycine max
aaagaaaaagaaaaagaaagagaagtaacagtggcggatttgggtacagagtgaggaagcagtgagcaaaagaaaagctgaaaacagcgcaccagttctgagctgagctagctagggtttcctctctccctcgtcttctcactttcacacatccatccatgtcttgaaacgatgcttcgcagatcaagcatagtcgattccaattcgcgcaagctcatggacggagatcgctgatacggcgaaccagatcgttgcacgagattcgtcacgtgacactcgatcttagttaggactagtgctagaaagcagaagctacttggttcttttgaaggtttgatttggatgtggaaataatgtcctgcaaggatggtagcagaaacggaatcggaatggataacgggaagtatgtccgttacacgcctgagcaggttgaagccctagaaaggctctatcacgattgccccaaacctagttccattcgccgccagcagctcattcgcgagtgccccattctctccaacatcgaacccaagcaaatcaaggtttggttccagaacagaagatgtagagagaagcagagaaaggagtcgtcgcggctgcaagctgtcaataggaagctgactgctatgaacaagctgctgatggaagagaatgataggttgcagaagcaggtgtctcaactcgtctatgaaaatggctattttcgtcaacacacccagattactacgcaggcaaccaaagacacaaactgtgaatcagttgtgacgagtggtcagcagcacaatttgataactcaacatcccccacgggatgcaagtcctgcagggcttttgtccattgcagaagagactttagcagaatttctttctaaggctactgggactgctgttgagtgggtccaaatgcctggaatgaagcctggtccggattccattggaatcgttgctatttctcatggttgcactggtgtggcagctagagcctgtggtctagtgggactagaacccactagggttgcagaaatcctcaaagatcagcctttgtggtttcgcgattgccgagctgttgatgttctcaatgtgctgcccacagcaaatggtggaaccattgagctgctttatatgcagctatatgcaccaaccacattggctcctgctcgagacttctggttgttgcgctacacttctgttttagaagatggaagcctagtgatctgcgagaggtctcttaaaaatactcaaaatggtccaagcatgcctcccgtgcagcattttgttagagctgagatgctgcctagtgggtacctgatcagaccttgtgaaggaggtggttcgatcatccacattgttgatcatatggatttagagccatggagtgtgccagaggtgctacgtccactgtacgaatcatcaacagtactggctcagaagacaactatggcggccctacgtcatctaaggcagatttcacatgaagtttctcagtccaacgtcactgggtggggtagacgaccggcagcactacgagctcttagccaaagattgagcaggggttttaatgaggcactcaatgggtttactgatgagggatggacaacaattggcaatgatggtgtagatgatgttactattctagtgaattcatcccctgacaagttaatgggtctgaatctttcctttgccaatggatttccgtctgttagtaatgcagtgctatgtgccaaagcatcgatgctattacagaatgtgccccctgccattctcctaaggttcctgagggagcatagatcagaatgggcagacaacaatatggatgcttacacagctgctgctattaaagtcggcccttgcagcctatcaggatctcgtgttggaaactatggaggtcaagttatactccccctagcacacacaattgagcatgaggagtttttggaagtcattaaattggaaggaatagctcattctcctgaagacacaataatgcctagagaaatgtttcttttgcaactctgcagtggaatggatgagaatgctgttggcacctgtgctgaacttatatctgctccaattgatgcttcctttgctgatgatgcccccctcctaccttctggatttcgcatcattcctcttgaatctggaaaggaagcttccagccccaatcgcacacttgaccttgcatctgcccttgacgttggtcccagtggaaaccgagcttcaaatggatgtgctaattccagctgtatgagatctgtgatgacaatagcatttgaatttgcatttgaaagccatatgcaagagcatgtagcatctatggcacgccaatatgttcggagcattatatcatcagtccaaagggtagcattagcactttctccttctcatttgagttcacatgcagggcttaggtcaccattgggtactcctgaagcgcaaacccttgctcattggatctgcaacagttataggtgctacttgggtgtggagctacttaaatctaacaacgaggggaatgaatctttgctcaagtccttgtggcatcactcagatgcaatattgtgctgcactctaaaggcattgccagtgttcactttctcgaaccaggctgggcttgacatgcttgagaccaccctagttgcattacaagatataactttagagaaaatatttgatgatcatggacgaaaaattctcttttcagagtttccacagattatccaacagggttttgcatgtcttcaaggtggcatttgtctttcaagcatggggcgacctgtctcatatgaaagagttgttgcttggaaggtgctgaatgaagaagagaatgctcattgtatttgctttatgtttgtgaactggtcttttgtttgacatcttgttctgagtacacttgggcttattgtatccaagtgttagataaagttttactctaagactcttgtgtgctttgttggttggtgttttactgtatttgcactaaatacttggattgcactttaaatgactatttgtgttattattagcttatgtaacttgtttccttattc

SEQ ID NO: 10585 - DNA, 2727 bp, Glycine max
gttgcacagattcctccatcctagtttagtgctagaaagagtaaagtatgtcctgcaaggatggtagcagaaacggaatcggaatggataacgggaagtatgtccgttacacgcctgagcaggttgaagccctagaaaggctctatcacgattgccccaaacctagttccattcgccgccagcagctcattcgcgagtgccccattctctccaacatcgaacccaagcaaatcaaggtttggttccagaacagaagatgtagagagaagcagagaaaggagtcgtcgcggctccaagctgtcaataggaagctgactgctatgaacaagctgctgatggaagagaatgataggttgcagaagcaggtgtctcaactcgtctatgaaaatggctattttcgtcaacacaccacccaaaatactaagcagcagccaaccaaagacacaagctgtgaatcagctgtgacgagtggtcagcagcacaatttgacaactcaacatcccccacgggatgcaagtcctgcagggcttttgtccattgcagaagagactttagcagaatttctttctaaggctactggaactgctgttgagtgggtccaaatgcctggaatgaagcctggtccggattccattggaatcgttgctatttctcacagttgcactggagtagcagcaagagcttgtggtttagtgggactagaacccactagggttgcagaaatcctcaaagatcggcctttgtggtttcaggattgccgagctgttgatgttctcaatgtgctgcccacagcaaatggtggaaccattgagctgctttatatgcagctatatgcaccaaccacattggctcctgctcgagacttctggttgttgcgctacacttctgttttagaagatggcagcttagtgatctgtgagaggtcacttaaaaatactcaaaatggtccaagcatgcctcctgtgcagcattttgttagagcagagatgctgcctagtgggtacctgatcagaccatgtgaaggaggcggttccatcatccacattgttgatcatatgaatttagagccatggagtgtgccagaagtgctacgtccactgtacgagtcatcaacggtactggctcagaagacatctatcgtggccctacgccatctaaggcagatttcacatgaagtttctcagtccaacgtcactgggtggggtaggagaccagcagcactacgagctcttagccaaagattgagccggggtttcaatgaggcactcaatgggtttactgatgagggatggacaacgattggcaatgatggtgtagatgatgttactattctagtgaactcatcccctgacaagttaatgggtctgaatctttcctttgccaatggatttccgtctgtcagtaatgcagtgctatgtgccaaagcatcgatgctattacagaatgtgccccctgccattctccttaggtttctgcgggagcatagatcagaatgggcagacaataatatggatgcttacacagctgctgctattaaagttggcccttgcagcttatcaggatctcgtgttggaaactatggaggtcaagttatactcccccttgcacacacaattgaacatgaggagtttttggaggtcattaaattggaaggaattgctcattctcctgaagacacaataatgcccagagaaatgtttcttttgcaactttgcagtggaatggatgagaatgctgttggcacctgtgctgaacttatatctgctccaattgatgcttcctttgctgatgatgccccccttttaccttctggatttcgcatcattcctcttgaatctggaaaggaagcttccagccccaatcgcacccttgaccttgcatctgctctagacattggttccagtggaaaccgagcttcaaatgaatgtgctggaaattccagctatatgagatctgtgatgacaatagcttttgaatttgcatttgaaagccatatgcaagagcatgtagcatctatggcacgtcaatatgttcggagcattatatcatcggtccaaagggtagcattagcactttctccttctcatttgagttcacatgcagggcttaggtcaccattgggtactcctgaagcgcaaacccttgctcattggatttgcaacagttataggtgctacttgggtgtggagctacttaaatctaataatgaggggaatgaatctttgctcaagtccttgtggcatcactcagatgcaatattgtgctgcactctaaaggcattgccagtgttcactttctcgaaccaggctgggcttgacatgctggagaccacccttgttgcattacaagatacacctttagagaaaatatttgatgatcatggacgaaaaatacttttttcagagtttccccagattattcaacagggttttgtatgtcttcaaggtggtatttgtctttcaagcatggggcgacctgtctcgtacgaaagagttgttgcttggaaggtgctgaatgaagaagagaatgctcattgtatgtgctttatgtttatgaactggtcttttgtttgacattttgttctgagtacagtagtgcttattgtaatctaaagtgttagataaagatttactcgacacttgagctttgttggttggacttcactgtatttgcgctaaatacttggattgcacattttatgactatttatgtgttattagcttagta

SEQ ID NO: 10586 - DNA, 2856 bp, Malus x domestica
gttggtttatctctatcctcgaaaagtttatttatttctaagtatttagtcatcgagttctgcaagttagcacatttggttgagacccagttgccgttttggtgctctgagggtttgggaattggtttggatttctgggtttggtgtaattttctgtggtttggaagtggtttctgagctgagaatttggaaatggctatgtcctgcaaggatggtaataagcatgcattggataatggcaagtatgtgaggtacacacctgagcaggttgaagccctcgagaggctttatcatgattgccccaaacccagttcgattcgccgccaacagcttattcgggagtgcccgattctctccaacatcgaaccgaaacagattaaggtctggttccagaacagaagatgtagagagaagcagaggaaagaggcttcacgcctccaagctgtcaacaggaagctcagtgctatgaataagctactaatggaggaaaatgataggttgcagaagcaggtgtctcacttggtgtatgaaaatggttacttccgtcagcatacccaggggacaacgcttgcaaccaaagacacgagttgtgaatcagtggtgacgagtggccaacaccatttgacacctcagcatccgccaagggatgcaagtcctgcaggacttttgtccattgcagaagaaactttagcagagtttctttcaaaggcaactggaactgctgttgagtgggtccaaatgcctggaatgaagcctggtccggattccattggaatcgttgctatttctcatggttgcactggagtggcagcacgagcctgcggcctggtgggtctagagcctaccagggttgcggagatcctcaaagatctgccgtcgtggttgcgtgattgccgcgctgtagatgttttaaatgtattgcctacagctaacggtggaaccattgagctgctctacatgcagctatatgcgccgacaactttggcgcctgcttgcgatttctggctactgcgctatacgtctgttttagaggatggcagccttgtggtatgtgcgagatctctgaaaaacactcagaatggtccaaccatgcctccagtgcagcactttgtcagagcagaaatgctgcctagtggataccttatacgaccctgtgaagggggtggctcgattatacatatcgttgatcatatggatttagagccttgtagcgtgcctgaagtcctgcgcccattgtatgaatcatctgctgttcttgctcaaaagatgacaatggcggctttacgtcagctgagacagatagcgcatgaggtttctcaatctaatgtcacaggttggggaagacgacctgcagctttacgagcattaagccagaggcttagcaggggttttaatgatgcacttaatggatttaccgatgagggttggtccatgatgggaaatgatggcatggatgatgttactatcctcataaactcgtctcctgacaagctgatgggcttaaacctgtcctttggtaatggattcccagctgtcagtaattctgtcttatgtgctaaagcatccatgctgttacagaatgtgccccctgctatccttcttcggttcctgcgcgagcacagatcagaatgggcagacaacaatattgatgcttactcagctgcagctgttaaagtcggtccttgtagcttagctgggtctcgagttggtagttttggaggtcaagttatactccctctggctcacactcttgagcatgaagagttcttggaagtcattaaattggaaggcgttggccattctcctgaagatgcaatgatgccaagagaaatgtttctcttgcaactatgcagtggaatggacgagaatgctgtgggttcctgtgctgaactcatttttgctccaattgatgcttcttttgctgatgatgcaccccttctaccttctgggtttcgcatcattcctcttgattatgggaaggaagcttccagtccaaatcgcaccttggaccttgcatctgctcttgaaattgggccaactggaaataaaggatctagtgaatattctgcaagtgctggttgtgtgagatctgtcatgactatagcatttgaatttgcttgtgagacccacatgcaagagcatgtagcatccatggcccgacaatatgttcgcagcattatatcttcagttcagagggtggcattagctctctctccttcaaatttgagttcacaggctggtcttcggtcaccacttggtactcctgaagcgcaaacacttgctcgttggatctgcaacagttacaggtgctatctgggtgtggagctgctcaaatcgggcaatgaaggaagtgaatccatcctcaaatctttgtggcatcactccgatgcaattatgtgctgctctctgaaggcattgccagttttcacctttgcaaaccaggcagggcttgacatgctggagaccaccttggttgcgctgcaagacataactttggagaagatatttgatgaccatggacgaaagactctgtgctcggaattcccccaaataatgcaacagggtttcacttgtcttcaaggtggcatctgtctttcgagcatggggcgaccagtgtcatatgagagagcagtggcgtggaaggtgttgaacgaagaggagacggctcactgcatgtgtttcttgtttgtaaactggtctttcgtctgatatcaggaccaggtcactaagactagaagatataatgtaataggcttgaaaagaggaagactttgaacctttcatgtttaaaccatctcctgtccttttggtgtgattaaaaatgttgtatggatgttaagacttaaaaaaaaaaaa

SEQ ID NO: 10587 - DNA, 3108 bp, Medicago truncatula
cataaaaaaaaacttcatgtttcataaacatgaagatcgtttaaacggtgtcgtttcagttcatgctctgttttaagaaaatcaaaacccaaggaaccagatcgttgttatcacgatgaagtttttcacaaagctctgatctcgaagatttcaacgtgttttcttgtgttcttcactgtctcttctttaggaaacacgtttatttccgtgcttaaacttctttttttacttccaatgaattttttcatcttaaaaaagcacttataattggaatctggatagatagaacaagaaagttctgtggttggtgaaagtgattttgaaaaaagctattatgtcttgtaaagatggtaaaggtgttatggataatggaaaatacgttcgttatacacctgaacaagttgaagctcttgagaggctttatcatgattgtcctaagccaagcagtattcgtcgtcaacagcttattcgagagtgtcctattctctctcatattgaacctaaacagatcaaagtttggttccaaaatagaagatgtagggagaagcagagaaaagaggcttcaaggttgcaagctgtgaataggaagttgagtgctatgaataagctgctgatggaagagaatgataggttgcagaaacaagtatctcatttggtgtatgaaaatggctactttcgccaacatactcaaaatactaatctggcaaccaaagatacaagctgtgattcggcggtgactagtggtcaacgcagtttgacagcccagcatccgccaagggatgcaagtcctgcagggcttttgtccattgcagaggaaactttagcagagtttctttcaaaggctactggaactgctgttgagtgggtccaaatgcctggaatgaagcctggtccggaatctattggaatcattgcgatttctcatggttgccatggtgtggcggcaagagcatgtggcctagtggggctagaacctacaagggttgcagaaatcctcaaagatcggccctcgtggtatcgtgattgccgagctgtggatattctgaacgtgcttcccacagccaatggtggaaccatagagctgctttacatgcagctatatgcgccaactacattggctcctgctcgagacttatggttgttgcgctacacatctgttttagaagatggaagcctagtgatatgtgagaggtctcttaaaaacacacaaaatggtccaagcatgcctcctgtgcagcattttgtcagagctgagatgctgcccagtgggtacctgataaggccttgtgaaggaggtggttccatcatccacattgttgatcatatggatttggagccatggagtgttcccgaggtactgcgtccactctatgaatcatcaacaatgctggctcagaagacaacaatggtggccctacgtcacctaaggcagatttcacatgaagtttctcagtctaacgtcactggatggggtagacgaccagcagcacttcgagcacttggccaaagactgagccggggtttcaatgaggcactcaatgggtttactgatgagggatggtcaatgattggcaatgatggtgttgacgatgttactattctagtgaattcatcccctgacaaattaatgggtctgaatctttcatttgccaatggatttccatctgtcagtaatgcagtcttatgtgctaaagcttcaatgctgttacaaaatgtgcctccggccattctactaaggtttttacgggagcatagatcggagtgggcagacaacaacatggatgcttactcagctgctgccatcaaagctggtccttgtagtttctcaggatctcgggttggaaattatgggggccaagtaattcttcctctagcccacactattgagcacgaggagtttctggaagtcattaaattggaaggaattgcccattctcccgaagacgcgataatgcctagagaagtgtttcttttgcaactctgcagtggaatggatgagaatgctgttggtacctgtgctgaacttatatttgctccaattgatgcatcctttgctgatgatgccccccttctgccttctggatttcgtataattcctcttgattctggaaaggaagtggccaacaacccaaatcgcacccttgacctgacatctgcccttgatattggtcccgctggaaacaaagcttctaatgattattctggaaattctggctgtatgagatcagtgatgacaatagcatttgaatttgcttttgaaagtcatatgcaagaccatgtagcatctatggcacggcagtatgttcgcagcattatatcgtctgtccaaagggtagcattggcactttcaccttctaatttgaattcacaaggtgggctcaggacaccactgggtactcctgaagctcaaacacttgctcgttggatcagcaacagttataggtgcttcttgggtgctgagctacttaaatctaataatgaggggagcgaatcattactcaagtccttgtggcatcacactgatgcaatactctgctgcactctaaaggcattgcccgtgttcacttttgccaaccaggcagggcttgacatgctggagactaccttagttgctctgcaggatatagcattggagaaaatatttgatgaccatggccgaaagattctgtgctcggaatttcctctaattatacaacagggttttgcatgccttcaaggtggtctttgtctctcaagcatggggagacctatttcatatgaaagagtagtggcttggaaggtgctgaatgaagaagagaatgctcattgtatttgctttatgtttgtgaactggtcttttgtttgacattgtttttagacaataggactccaagtggtgttaaagaggaagcactcttattaagacatgttcttttgcttgctattttgctatattcgctgcaaaaacttggattgcatgtaaaaactacttatatattagcctatgttacatttcccttataattttgtgccgtgcttttatgatactatgcactttgtaatgtgggaagaaatctagacacttctagatacttgtaaagaaagaaatggacagaaaacgttagaatt

SEQ ID NO: 10588 - DNA, 2828 bp, Vitis vinifera
atggcaatgtcctgcaaggatggtaaaggcataatggataatggcaagtatgtgaggtatacacctgagcaggttgaagccctggagaggctctatcatgagtgcccgaaacccagttctattcggcgccaacagctgattcgggaatgtccgattctgtccaatattgagcccaagcaaatcaaagtttggttccagaacagaagatgccgagagaagcagaggaaagaggcgtctcgcctccaagctgtgaataggaagctgaccgccatgaacaagcttttgatggaggagaatgataggttgcagaagcaggtgtctcaactggtgtatgagaatggctacttccgccaacatacccagaacacaacgcttgccacaaaagacacaagttgtgagtcggtggtgacgagcggtcaacaccacttgacccctcagcatccgcccagggatgctagtcctgcagggcttttgtccattgcagaagagactttaacagagtttctttcaaaggccactggaactgctgtagagtgggtccaaatgcctggaatgaagcctggtccggattccattggaatcgttgctatttctcatggttgcactggagtggcagcacgagcctgcggcctggtgggtctagagcctacaagggttgcagagatcctcaaggatcggccatcctggtttcgcgattgccgagctgtggatgtgctgaatgtgttgcccactgcaaatggtggaactattgagctgctttacatgcagctctatgcgcctactacgttggcgcctgctcgtgacttctggttgttacgttatacttctgttatggaggatggaagtcttgtggtctgtgaaagatcacttaaaaatactcagaatggtccaagcatgccaccagtgcagcattttgtgagagcagaaatgctgccaagtggctacttgataagaccttgtgaagggggtggttcaatcatacatattgttgatcatatggatttagagccatggagtgtgcctgaagtgttgcgtcctctgtatgaatcatcaacagtgcttgctcaaaaaacaacaatggcggctttgcgccagctgagacaaatagctcaggaggtttctcagtctaatgtcactggttggggtagacgacctgcagcactgcgagcgcttagccagaggctgagcagaggttttaatgaggctctcaatgggtttactgatgaagggtggtcaatgatgggaaatgatggcattgatgacgttaccatccttgtgaactcatctcctgagaaactaacaggcttaaatctttcctttgctaatggatttcctgcagtcagcaatgctgtgttatgcgctaaagcatcaatgcttttgcagaatgtgcctccagcaatacttcttaggtttctgcgggagcacagatcagaatgggcagacaacaatattgatgcttactcagctgcagctgtaaaagttggtccctgtagtttgccagggtctcgagttggaagttttgggagccaagtcatacttccactggctcacactattgagcatgaagagttcttggaggtcattaagctggaaggtgtcggccattgtcctgaagatgcaatgatgcctagagacatgtttctcttgcaactatgcagtggaatggatgagaatgctgttggcacctgtgctgaactcatatttgctcccattgacgcttcttttgctgatgatgcacctcttttgccttctggttttcgcatcatccctcttgattctgggaaggaagcctccagtccaaatcgcaccctagaccttgcatctgctcttgagattgggccagctgggaatagatcatcaaatgattattctgttaatggtggcaatactagatctgttatgacaattgcatttgaatttgcatttgaaagccacctacaagaaaatgtagcatccatggctcggcagtatgtccgcagcattatatcatctgttcagagggtggcattagctctctctccttcgcatttaagttcccatgctggtcttcgaccaccactgggcactcctgaagcgcacacacttgctcgttggatcagtcacagctataggtgctacctgggtgtggagctactcaaatccagtggtgaagggagtgagaccatcctaaaaacactgtggcatctctcagatgctatcatgtgctgctctctgaaggcattacctgtattcaccttcgcaaaccaggctggtcttgatatgcttgagacaaccttggttgccctgcaagacattactttggagaagatattcgatgatcatggacgcaagactctctgctcagagttccctcagataatgcaacagggttttgcttgccttcaaggtggtatctgtttgtcaagcatgggccgtcctgtctcatatgaaagagctgtggcatggaaggtgctgaatgaggaagagaacgcccattgtgtctgttttatgtttatgaactggtcttttgtctgaccttctgaccagaactaaaagtacagtgtatgaagagtactagaacactcttaagaccattattctcgtcttttcttttttcttttttgttccttgtttgtctttttgttgtggaaaccctggagtactgattaggaccaatgttcccatgtttttaggcctgctgttgagatatttaccctgaaactaccttgtgttccattttgggtaatttcatgatctcttcagttcctgaatagaagaattatctctgatgtaattatttgttaaaatggaggaaatgcttgaaaccaggaactgattcaatgctaaaa

SEQ ID NO: 10589 - DNA, 2963 bp, Glycine max
gatttgcgttgtaaaagaacaattcatttttgacttaattaatcctaataataataataatttgacacatccatggtccatccatgccatatcgttcttccatcatggttggcagatcggtgaagcggcggagcaaatggttgcagagattccatacatgactcgatcttagtttagttaggagcagtggtggaaagcctaatagatcaagtatgtcctgcaaggatggtagcagaaacggaatcggaatcggaatggataacgggaagtacgtgcgttacacgcctgagcaggttgaagccctagagaggctctatcacgattgccccaaacctagttccattcgccgcctgcaactcattcgcgagtgccccactctctcccacattgatcccaagcaaatcaaggtttggttccagaacagaagatgtagagagaagcagaggaaggagtcgtcgcggctgcaagctgtaaataggaagttgactgccatgaacaagctgctcatggaggagattgataggttgcagaagcaggtctctcaactcgtctatgaaaatggctattttcgtcaacataccacccaaaatactaagcagcaggcaatcaaagacacaagctgtgaatcagctgtgaggagtggtcagcagcacaatttgataactcaacatcccccacgggatgcaagtcctgcagggcttttgtccattgcagaagagactttagaagaatttctttctaaggctactgggactgctgttgagtgggtccaaatgcctggaatgaagcctggtccggattccattggaatcgttgctatttctcatggttgcaatggtgtggcagcaagagcttgtggtctagtgggactagaacccactagggttgcagaaatcctcaaagatcggcctttgtggtttcgcgattgccgagctgttgatgttctcaatgtgctgcccacagcaaatggtggaaccattgagctgctttatatgcagctatatgcaccaaccacattggctcccgctcgagacttctggttgttgcgctacacttctgttttagaagatagcagcttagtgatctgtgagaggtcacttaaaaatactcaaaatggtccaagcatgcctcctgtgcagcattttgttagagcagagatgctgcctagtgggtacctgatcagaccttgtgaaggaggcggttccatcatccacattgttgatcatatgaatttagagccatggagtgtgccagaagtgctacgtccactgtacgagtcatctaaagtactgtctcagaagacaactatggcggccctacgtcatttaaggcagatttcacatgaagtttctccgtccaacgtcagtgggtggggtagaagaccatcagcactacgagctcttagccaaagattgagccggggtttcaatgaggcactcaatgggtttactgatgagggatggacaacaattggcaatgatggtgtagatgatgttactattctcgtgaattcatcccctgacaagttaatgggtctgaatctttcctttgccaatggatttccgtctgtcagtaatgcagtgctatgtgccaaagcatcgatgctattacagaatgtgcaccctgccattctccttaggttcctgcgggagcatagatcagaatgggcagacaacaatatggatgcttacacagctgctgctattaaagttggcccttgcagcttttcaggatctcgtgttggaaactatggaggtcaagttatactccccctagcacacacaattgagcatgaagagtttttggaagtcattaaattggaaggagttgctcattctcctgatgacacaataatgcccagagaaatgtttcttttgcaactttgcagtggaatggatgagaatgctgttggcacctgtgctgaacttatatctgctccaattgatgcttcctttgctgatgatgccccccttttaccttctggatttcgcatcattcctcttgaatctggaaaggaagcttccagccccaatcgcacccttgaccttgcatcttcccttgacgttggtcccagtggaaaccgagcttcagatgaatgtgctggaaattccagctatatgagatctgtgatgacaatagcatttgaatttgcatttgaaagccatatgcaagagcatgtagcagctatggcacgtcaatatgttcggagcattatatcatcggttcaaagggtaggattagcactttctccttctcatttgagttcacatgcagggcttaggtcaccattgggtactcctgaagcacaaacccttgctcattggatctgcaacagttataggtgctacttgggtgtggagctacttaaatctaataacgaggggaatgaatctttgctcaagtccttgtggcatcactcagatgcaatattatgctgcactctaaaggcattgccagtgtttactttctcgaaccaggctgggcttgacatgctggagaccaccctagttgcattacaagatatacctttggagaaaatatttgatgatcatgaacgaaaaattctcttttcagagtttccccagattattcaacagggttttgcatgtcttcagggtggtatttgtctttcaagcatggggcggcctgtctcatacgaaagagtcgttgcttggaaggtgctgaatgaagaagagaatgctcattgtatttgctttatgtttatgaactggtcttttgtttgacattttgttctaagtacagtagtgcttattgtaatctaaagtgttagataaagatttactcaagacacttgagctttgttggttggtattttactgtatttgcactaaatacttggattgcacattttatgactattttatgtgttattagcttatgtaacttgtttccttattcaacctccagctaatatttaatgcaatctttagaagtgttgcacc

SEQ ID NO: 10590 - DNA, 2868 bp, Vitis vinifera
tttaggacttctctgcccttcctgggcctctctgttttcatctttatccgtggtttttttgggtgttttccttggtggtatggcgctttctatgcacaaagagtctaagcagcagatggattccagcaagtatgtaaggtatacgcccgagcaggttgaagctttagagagggtgtatagtgaatgcccaaagccaagctccatgagaaggcagcagctcataagagagtgtcccatactctctaatatcgagcccaaacagatcaaagtctggtttcaaaatcgcaggtgccgtgaaaagcaaaggaaggaagcttctcgtctccagactgtgaatcggaagttgactgcaatgaacaagctgttgatggaagagaatgaccggttacagaagcaggtctcgcagttggtttatgaaaatggatacatgagacagcagctgcagagtgcatctacagcgaccacagacactagctgcgagtctgtggtcatgagcggtcagcaccaacaacagcaaaacccaacacctcagcatcctcaaagggatgcaagcaacccagctggtctactcgcaatagctgaggagaccctggcagagttcctgtccaaggctactggaactgctgtcgactgggtccagatgattgggatgaagcctggtccggattctattggaatcgttgctgtttcccgcaactgtagtggggtagcagcacgagcctgtggcctcgtgagtctagaacccacgaaggttgcggaaatcctcaaagatcgtccatcttggtttcgtgactgccgatgcctcgatgtattgagtgtaatccctacaggaaatggggggacaatagaactcatatacatgcagacatatgctcctacaacattggcatcagcacgtgatttttggacattgagatatactacaagcttggaagatggcagtctagtgatttgtgagaggtcattgacatcttctactggtggccctactggaccccctgcatcaagttatataagagcggaaatgcttcctagtggctatctaatccgaccttgtgagggtggtggctccattattcacattgttgatcatgttgatttggatgcatggagtgttcctgaagttcttaggccgctatatgaatcatctaaaattctcgctcagaaaacgactgttgctgcattacggcacatacgacaaattgcacaagaaaccagtggagaaattcagtatggtgggggccgccaacctgctgttttaaggacgtttagccagagattgtgcagggggttcaatgatgctgttaatgggtttgcggatgatggttggtcgctcatgggtagtgatggggtggaggacgtaaccattgtgattaactcatctccaagcaaattcctcgggccccagtataactcaacaatgtttccaacttttggaggtggcgtgctgtgtgccaaagcatcaatgctgctacagaatgttccccctgctttacttgttcgattcctgagagaacaccgttctgagtgggctgactatggtgttgatgcttattctgctgcatgtcttaaagctagtccttatgaagttccctgtgcaagacctggaggcttccccagtagccaggtcattttacctctcgcccatacagtggagcatgaggaggtgacaacgcagttcttggaggtggttcgtctagaaggacatgcattctcgcctgaggatgtggctttgacacgggacatgtacttactacagctatgcagtggggttgatgagaatgcagctggtgcctgtgctcagctggtttttgcacctattgatgaatcatttgctgatgatgctcctttgctgccatctggcttccgcgtcataccattggatcctaaaacggatggacctgctgctactaggacattggatttggcctctacacttgaagtgggagctggtggggcacgcccagccaatgagtctgatttgaacaattataacctcagatctgttctgactattgcattccaatttacttttgagaaccatgttcgagacaatgtggctgctatggctcgccaatatgtacgtagtgttatggcctctgttcagagggttgccatggctattgccccttcccggctcagctcccatatgggcctaaaaccacttcctggttctcctgaggctcttactttggcacggtggatttgtcgtagctacaggattcacactgggggagagctccttcgggttgactcccaaggtggtgatgctgtcttgaagttactttggaaccattctgatgcaatcatgtgctgctccctgaaaacaaatgcatctccagttttcacatttgctaaccaggctgggcttgatatgcttgaaaccactctggtggcccttcaagatataatgctagacaagattcttgatgaagctgggaggaagattctctgctctgagttctctaagatcatgcaacagggctttgcgtatctgccagcagggatatgcacatccagcatgggcaggcctgtgtcttatgagcaggccattgcatggaaagtcctgaacgatgaggactccaatcactgcctggctttcatgtttataaactggtcctttgtgtgatgcacataggctttgctatatcttaagttatatagtatgtggctttagaaaaaagttggtacaatattacattatgacatgaatgaagtatatcaggatctcataaacactctatctatatatgtattgcttatgtttgcttaatggtgctttctgctgtccacctcttggtaccatttgtttgttttgttgggttcctattcggcataggacgtcagtaaatttcttagtaacattca

SEQ ID NO: 10591 - DNA, 2700 bp, Glycine max
atggcactttctatgcacaaggactcagccaacaaccagatggactcgagcaagtatgtgaggtacacaccagagcaggttgaggctttggagagggtatatgctgaatgccctaagccgagttccttaagaagacaacaactcatcagagagtgccccatcctctccaacattgaaccgaaacagatcaaagtttggtttcagaacagaaggtgtcgtgagaagcagaggaaggaagcttctcggctgcagacagtgaacagaaagctgactgcaatgaacaagcttttaatggaggaaaatgaccgtttgcagaagcaggtttctcatctggtttatgagaatggttacatgaagcaacagatacacactgcttctgcaggtactaccacagacaatagctgtgagtctgtggttatgagtggtcaaaaccaacagcaaaacccaacacctcagcatcccaatagggatgctaacaacccagctggtcttctcgccatagctgaggagaccctggcagagttcctttccaaggctactggaactgctgtcgactgggtccagatgattgggatgaagcctggtccggattctattggaatcgttgctgtttcccgcaactgtagtggcgtggcagcacgagcctgcggccttgtgagcctagagcccactaaggttgctgagatactaaaagatcgacagtcgtggtatcgtgactgtcgatgcgtggatgtgttaagtatagtccccactgggaatgggggcaccatcgagctcctgtacatgcagacatatgcgcccacaactttggctgcagcacgggacttctggacactaagatacacgacaagtttggaagatggaagtcttgtgatatgtgagagatcattgacatcctcaactggtggccccacagggcctccttctacaacctttgtacgagctgaaatgcttcccagtggttttctagttagaccttgtgagggtggtggatccattattcacattgttgatcatattgatttagatgtctggagtgtacctgaagtactgaggcccttgtatgaatcatcaaaattcttggctcagaaattgacaattgctgccttgcaacatataagacaaatagcacaagaatctagtggagaaattcagtacagtgggggacgccagcctgctgtattgagaacatttagccagagactttgcaggggctttaatgatgctgtgaatggatttgttgatgatggctggtcactgatgggtactgatggggtggaagatgtgacaatagccataaactcatctccaaacaaattcttgggctccaattacaatgcatcaatgttcccagcatttggaggtggcgttttgtgtgctaaggcatcaatgctcttgcagaatgttccccctgctttgcttgttcgatttttgagggagcatcgatcagagtgggctgattatggagttgatgcatactctgctgcatgccttaaagctagtccctatgcagttccttgtgcaagacctggtggcttccccagcacccaggtcattttaccccttgctcatactattgagcacgaggagttcctggaggtagttcgaatagagggtcatgcattttctcccgaggatgttgcgttggcacgtgatatgtatctattgcagctgtgcagtggagttgatgaaaatgcaattggggcatgtgctcaacttgtgtttgcacctattgatgagtcctttgctgatgatgctctgttgcttccatctggttttcgtgtcattccgttggatcctaaatcagatggtccagctgcaactaggacattagatttggcatcaacaatggaagtaggttctggtaatgctcgtccagctggggaagctgacttgaacggctacaaccttaggtcggtccttactattgctttccaatttacctttgagaaccatacacgggacaatgtggctgctatggctcgccagtatgtgcgtagtgttgtgggatcagttcagagggttgccatggctattgctccctccaggttcaatacccagctggggccaaagtcactttctggatcacccgaggcccttaccttagcgcgatggatctgtagaagctacagggttcacactggcacagagctttttaaagctgagtccacagctggtgatgcaatccttaagcaactttggcaccatcccgatgcaatcatatgctgttctgtgaaaacaaatgcatctccagtgttcaccttttcgaaccaggctggtttagacatgcttgaaactactcttgtttcccttcaagatataatgcttgataaagttcttgatgaatctggcaggaagattctctgctccgagttctccaagataatgcaacagggttttgcatctctccctgcaggaatatgtgtatctagtatgaatcggccagtgtcctatgagcaggttgttgcatggaaagtcctcaatgatgatgattctaatcactgcctagccttcatgttcatcaattggtcttttgtatgatggatgaaccatatctagagactactacttattttatctactaatcagatgatactatcacagacagatgtactgatgtcagcttttctttatgccctatgtatgaagtatgctaatgttacttattcgctatatatataaaatatctagttaatttgg

SEQ ID NO: 10592 - DNA, 2709 bp, Glycine max
atggcactttctatgcacaaggactcagccaacaaccagatggattcaagcaagtatgtgaggtacacaccagagcaggttgaggctttggagagggtctatgctgaatgccctaagccaagttccttgaggaggcagcaactcatcagagagtgccccatactttccaacattgaacccaaacagatcaaagtttggttccagaatagaaggtgtcgtgagaagcagaggaaggaagcttctcgcttgcagacagtgaacagaaagctgactgcaatgaacaagctgttaatggaggagaatgaccgtttgcagaagcaggtttctcatctggtgtatgagaatggttacatgaagcaacagatacacactgcttctgctggtactaccacagacaatagctgtgagtctgtggtaatgagtggtcaaaaccaacagcaaaacccaacacctcagcatcccaaccgggatgctaacaacccagctggtcttctcgccatagctgaggagaccctggcagagttcctttccaaggctactggaactgctgtcgactgggtccagatgattgggatgaagcctggtccggattccattggaatcgtagctgtttcccgcaactgtagtggcgtggcagcacgagcctgcggccttgtgagcctggagcccactaaggttgctgaaattctcaaagatcgacagtcgtggtatcgtgactgtcgatgcgtggatgtgttgagtatagtccccactggaaatgggggcaccatagagctcatgtacatgcagacatatgcgcccacaactttggcagcagcacgggacttttggacactgagatacacgacaagtttggaagatggaagtcttgtgatatgtgagagatccttgacatcctcaactggtggcccagcagggcctccttctactacttttgtaagagctgaaatgcttcccagtggttttctaattagaccatgtgagggtggtggatccattattcatattgttgatcatattgatttagatgtctggagtgtacctgaagtactgaggccgctgtatgaatcatcaaaaatcttggctcagaagttgacaattgctgccttgcaacatataagacagatagcactagaatcaagtggagaaattcagtatggtggtggacgccagcctgctgttttaagaacatttagccagagactttgcaggggctttaatgatgctgtgaatgggtttgttgatgatggctggtcactgatgggtactgatggagtggaagatgtgactatagccataaactcatctccaaacaaatttttgggctccaattacaacgcatcaatgtttccagcatttggaggtggggtcttgtgtgccaaggcatcaatgctcctgcagaatgttcctcctgctttgcttgttcggtttttgagggagcatcgatcagagtgggctgattatggagttgatgcatactctgccgcatgccttaaagctagtccctatgcagttccttgtgcaagacctggaggcttccccagcacccaggtcattttaccccttgctcatactattgagcacgaggagttcctggaggtagttcgaatagagggtcatgcattttctcctgaggacgtagcgatggcacgcgatatgtatctattgcagctgtgcagtggagttgatgaaagtgcagttggggcatgtgctcaacttgtgtttgcacctattgatgagtcatttgctgatgatgctctgttactgccatctggttttcgtgtcattccgttggatcctaaatcagatggtccagctccaactaggacattagatttggcatcaacgatggaagtaggttctggtaatgcccgtccagctggggaagcagacttgaatgggtacaaccttaggtcggtcctcactattgctttccaatttacctttgagaaccatacacgggacaatgtggctgctatggctcgccagtatgtgcgtagtgttgtgggatcagttcagagggttgccatggcaattgctccctccaggctcaatacccagttggctccaaagtctcttcctggttcgcctgaggcccttaccttagcccggtggatctttagaagctataggatgcacactggtacggagctttttaaagctgagtccacagctggtgatgcaatcttgaagcaactttggcaccatcccgatgcaatcatgtgctgttctgtgaaaacaaatgcatctccagtgtttacctttgcgaaccaagctgggttagacatgcttgaaactactcttgtcgcccttcaagatataatgcttgataaagttcttgatgaatctagcaggaagattctttgctgtgagttctccaagataatgcaacagggttttgcatatctcccagcaggaatatgtgcatcaagtatgaatcggccagtatcttatgagcaggctgttgcatggaaagtcctcaatgatgatgattctaatcactgcctagcattcatgttcatgaattggtcttttgtataatggatgaaccatctagaaactacttattttatctgctactaatttatattcagtacttaattatcagataatactatcacagacaaatgtactaatgtcagcttttctttatgccctatgtatggagttacttattcgctattatataaaatatctagttaatttggt

SEQ ID NO: 10593 - DNA, 3066 bp, Nicotiana sylvestris
gtgtttttctttttctcttgtcctgtgtgtagacacagtactttaatttctctctctctctctctctctctctctctctctctctctctctataaacattggtgtgttaagataaagacctctcttcactggggtcttcagttatttcttgtcaaaacaaatctcaagaataagagcaagagttggagatagggagagtgaaaaaagagtagtgttgatgagtgaaagaggaggctctcttagaggagagagagcctgcctgttcatgcaagaacaaagacatctcagtttgtgttgttgttgaaagagaaagaaagcagtgatttttttgtttgttttgttttcatatagtgaatggcgttgtgtttgaataacaagaatcagataatggataacagcaagtatgtgaggtacacaccagaacaagtggaagctttggagagagtgtatgcagaatgtccaaagcctacttctttgaggaggcaacagctcattagggagtgtcccattctctctaatattgaacctaaacagatcaaagtctggtttcagaaccgaagatgccgtgaaaaacagaggaaggaagcatctcgtctcacgactgttaacaggaagctgagtgctatgaacaagctgttgatggaagaaaatgaccggttgcagaagcaagtctcacagcttgtgtatgagaatggctacatgaaacaacaaatcaatactgttagcagcacgaccacagatacaagctgtgaatctgtggtcgtgaatggtcagcagcaaagaaaaaacccaacacctcagcatccagaaagggatgcgaataacccagctggtcttcttgcaatagctgaggagaccctggcagagttccttggaaaggctactggaactgctgtcgactgggtgcagatgattgggatgaagcctggtccggattctattggtattgttgctgtttcccgcaactgcagtggggtagcagcacgtgcctgcggccttgtgagtttagagcccacgaaggttgctgagattctcaaagatcgtccttcttggtatcgcgactgccgttgccttaatatactgagtgtaatccctacaggcaatggagggacgatagagcttatttacttgcagacttatgctccaactacattggcatccgctcgtgacttttggacattgagatacactacaagtttggaggatggcagtcttgtgatatgtgaacgatctctgacgacagctactggtggcccaacagggcctcctgccacaagttttgtcagggctgaaatgctaccaagtggctacctcattcggccttgtgagggtgggggctcaatgattcacattgttgatcatattgatctagatgcttggagtgtccctgaagttctgaggccactttatgagtcctccaagatccttgcacagaagacgactgtggctgccctgcgacacatacgacaaattgcacaagaaaccagtggggaaatccaatacactgggggtcgccaacctgctgttttgagggcactaagtcaaagattatgcaggggatttaatgatgctgttaatggatttgttgacgacggttggactgttatggatagtgatggtgtagaggacgtaaccgttgctataaactcatcttcgaccaaatttcttggttcacagtacaacactttgtcaatactccctacctttggaggagtcctgtgtgccagggcatcaatgcttcttcagaatgttccccctgctttgcttgttcgtttccttagggagcatcgttctgagtgggcagattatggggttgatgcatattctgctgcatctcttaaagccagtccatatgctgtaccttgcgccagaccgggtggcttcccaagtagccaggtcattttacccctagctcagactgtggagcatgaagagtttcttgaagtagtacgactagagggtcctgctttctcccctgaggacattgctttatcacgggatatgtacttgttacagttatgcagtggagttgatgagaatgcttcaggtgcctgtgctcagcttgtttttgcacctattgatgagtcttttggtgatgatgctccattgcttccatctggtttccgtgtcattccgctggagcctaaatcagatggccctgcagcaactcggactttggacttagcttcaactcttgaagctggaactggtgggacacgtccagctggtgaaattgaagcaagcaattacaatcatcgttctgtcttgacaatcgcattccagtttacttttgagagtcactaccgggataatgtagctgctatggctcgccaatatgtgcgaagtatagtaggctcagttcagagagttgcaatggccatagcaccctctcgactgagctctcagttgacgcctaaacccttccctggttcacctgaggctgtcactttggcaaggtggatttcccggagttatagagtgcacacaggaggggacctgcttcaggttgattctcaagatggtgatgctgttctgaaacaactgtggcaccatagtgatgcaataatgtgttgctctgtcaaaatgaatgcatctgcagtttttacatttgcaaaccaggcaggtcttgacatgcttgaaaccaccttgttagctcttcaggatataatgcttgataagattctagatgaagctggtcgtaaggtcctcctatcagagttctccaagatcatgcagcaggggtttgcctatctaccagcaggaatatgtgtatctagcatggggaggccagtgtcatatgagcaagctgtagcatggaaggttctcaatgatgaagattccaaccactgcctagctttcatgttcataaactggtcttttgtttaagttaaaacagataatctatgcaagacttttggtattagctatcaaccttctaagttaatgtcggtactcacaatgttttaaattaagcttgtatgactatgttgacaaggatgtgtggatggatcctaactctatatcatatttattacaatatgacatgttattcctgttaaaaaaaaa

SEQ ID NO: 10594 - DNA, 2769 bp, Glycine max
atggcactttgtatgcagagagattcagcatcaaacaagcaacagctcatggattgtggcaagtatgtgaggtacacacctgaacaggtggaggctttggagagggtttatattgaatgtccaaagcctagttcttccagaaggcaacaaatcattagggagtgtccactccttgctaacattgaaacaaagcagatcaaagtgtggttccagaatcgcagatgtcgtgaaaagcagcggaaggaagcctctcgtctgcagacagtgaatagaaagctgtctgcaatgaacaagttgttgatggaagagaacgaccgactgcagaagcaggtctcacagttggtttatgataatggattcatgaaacaacaaatacatactgcatctgctactactactactgacaatagctgtgaatctgtggtagtgagtggtcaacgccaacatcaaaaccccaaaattcagcatccccagtgggatgccaacaacccagctggtcttcttgcaattgctcaggagaccctggcggcgttcctttcaaaagctactggaactgctgtcaactgggtccaaatgattgggatgaagcctggtccggattctattggaatcgttgctgtttcccgcaactgtagtggtgtagcggcaagagcctgtggccttgtgagccttgagcccacaaaggttgctgagattctcaaagatcgtccatcatggtatcgtgactgtcgatgcctcaatgtactgagtgtaatccccacagggaatgggggcacgatagagctcatgtacatgcagacatatgcaccaacaacattggcagctgcaagagacttctggactctgagatacactactagtttggaagatggaagtcttgtgatttgtgaaaggtccttgacttcttcaactggtggccccacagggcctgctgcttcaaacttcgtgagagctgaaatgcttcctagtggctatctaattagatcctgtgagggtggtggatctattgttcacattgttgatcatgttgatttagatgtttggagtgttcctgaagtacttagacccctctatgaatcaccaaaattcttggctcagaaattgactactgctgccttgcgaaatgtaagacaaattgcacaagaatcaagtggagaagttcagtatggtgggggtcgtcagcctgctgtcttgaggacatttagtcaaaggctttgcaaagggttcaatgatgctgtcaacgggtttgtggatgatggttggtcattgatgggtaatgatggggttgaagatgtgaccataggcataaactcatctcccaacaagtttttcagttcccattacaatacatcaatgcttcccgcatttggaggtggggtcttgtgtgcgaaagcatcaatgctgctacagaatgttcctcctgctttgcttgttcgttttctgagggagcatcgttcagagtgggctaattatggggttgatgcatactcttctgcatgtctcaaagctagtccttatgcagttccttgtgcaagacctagtggtttcccgagcagccatgtcattataccacttgctcatactattgagcatgaggagttcttggaggtagttcgtattgagggtaatgcatttccccctgatgatgtagctttggcatgtgatatgtatttaatgcagctgtgcagtggaattgatgaaaatgcaatcggagcatgtgcacagcttgtgtttgcacctatcgatgaatcatttgcagatgatgctctcttactgccttctggtttccgcatcataccattggatcctaaaacagatggtccggcttcaactaggacattggacttagcgtcaacactggaaactggatctggtaatgctcgctcagctggtgaaagtgacctgaataactacaaccttaggtcggtcctcacaattgcattccaatttacctttgagaaccatttgcgggacaatgtggctgttatggctcgccagtatgtgcgtaatgttgtgcgatctgttcagagggttgctatggcaattgctccctctaggatcagtacacagttggggccaaagtcacttcctggtccaccagaggcccttaccttagcaagatggatctgcaaaagctacagtctccacacctgcacagagctttttagcgttgagtccacatctggtgatgcaatcttgaagcaactttggcaccatccagatgcaatattgtgctgttctgtaaaaacaaatgcatctccagtgttcacctttgcaaaccaagctggacttgacatgcttgaaaccactcttgttgctcttcaagacataatgctggataaagttcttgatgaagctggcaggaagtttctctgcattgagttctccaagataatgcaacagggatttgcatatctgccagcaggaatatgtgtatcaagtatgaatcgaccagtgtcttatgagcaggccattgcttggaaagttctcgatgatgatgattccaaccactgccttgcctttgtgttcatgaactggtcttttgtctgatggggggagccatcatttagatacttattatatctattaatttatgtttggagtattttacaaagaaattgtcacaccaacaacgaatgttaactaatgtctggattttatgaacacgcatggttgtgtgccattagattagcattgctttatgcttttactaagtatgtacctttcttcgtatataaactccttgttgaattatagactgctttttcc

SEQ ID NO: 10595 - DNA, 3227 bp, Glycine max
tttttgataaaaaaaagaaattgttgcttttcattttggcatcacagagtatcagagagaaagagagagagagcggttttgcagaaaaaatccaagtaaatttaaggagccaccactgttccaatcagcccctttcattttgcagtgcccgtttattttttcgtgtttgcattcaccgttccacagaaggaaaaaagagtgctttgttccatctctttctgtggtgtgtctcaagataaaaagctcactcactcacagcagcaacaacccttttaccttaactcttgaaactttgttcagagtttggattttgagagagcatgatctgatgaaggagtgtggaggctctcttgggggagagggcaaggaagaagaggactacacaaaacaagtgttgtctttttgaaccccaaaaaaaacgtttttttttgttttgttgttatggcactttgtatgcagagtcagcagagagattcagcatcaaacaagctgctcatggattgtggcaagtatgtgaggtacacacctgaacaggtggaggctttggagagggtgtatgttgaatgtccaaagcctagttcttccagaaggcaacaaatcattagggagtgtccactccttgctaacattgaaacaaagcagatcaaagtgtggttccagaatcgcagatgtcgtgaaaagcagcggaaggaagcctctcgtctgcagacagtgaatagaaagctgtcttcaatgaacaagttgttaatggaagagaacgaccgactgcagaagcaggtctcacagttggtttatgataatggattcatgaaacaacaaatacatactgcatctgctactactactactactactgacaatagctgtgagtctgtggtagtgagtggtcaacaccaaccgcaaaaccccaaaactcagcatccccagtgggatgccaacaacccagctggtcttcttgctattgctcaggagaccctagtggagttcctttccaaagctactggaactgctgtcaactgggtccagatgattgggatgaagcctggtccggattctattggaattgttgctgtttcccgcaactgtagtggcgtagcggcaagagcctgtggccttgtgagcctagagcccacaaaggttgccgagattctcaaagatcgtccatcatggtatcgtgactgtcgatgcctcaatgtattgagtgtagtctccgcagggaatgggggcacaatagagcttatgtacatgcagacatatgcaccaacaacattggcagctgcaagagacttctggactctgagatactctactagtttggaagatggaagtcttgtgatttgtgagaggtccttgacttcttcaactggtggccccacagggccagctgcttcaaacttcatacgagctgaaatgcttcccagtggctatctaattagatcctgtgagggtggtggatctatcattcacattgttgatcatgttgatttagatgtttggagtgttcctgaagtacttagacccctctatgaatcaccaaaattcttggctcagaaattgactactgctgcattgcgacatgcaagacaaattgcacaggaatcaagtggagatgttcattatggtgggggtcgtcaacctgctgtcttgaggacatttagtcaaaggctttgcaaagggttcaatgatgctgtcaacgggtttgtggatgatggttggtcactgatgggtaatgatggggtggaagatgtgaccatagccataaactcgtctcccaacaagtttttcggttcccattacaatacatcaatgcttccagcatttggaggtggggtcatgtgtgccaaggcatcaatgctgctacagaatgttcctcctgctttgcttgttcgttttctgagggagcatcgttcagagtgggctaattatgaagttgatgcatactcttctgcatgtctcaaagctagtccttatgcagttccttgtgcaagacctagtggtttcccaagcagccatgtcattataccacttgctcatactattgagcatgaggagttcttggaggtagttcgtattgagggtaatgcatttccccctgatgatgtagcttgggcatgtgatatgtatctaatgcagctgtgcagtggaattgatgaaaatgcaattggagcgtgtgcacagcttgtgtttgcacctattgatgaatcatttgcagatgatgctctcttactgccttctggtttccgtatcataccattggatcctaaaacagatggtttggcttcaactaggacattggacttagcatcaacactggaaacaggatctggtaatgcccgctcagctggtgaaagtgactcgaataactacaaccttaggtcggtcctcacaattgcattccaatttacctttgagaaccatttgcgggacaatgtggctgttatggctcgccagtatgtgcgtaatgttgtgcgatctgttcagagggttgccatggcaattgctccctctaggctcagtacacagttggggccaaagtcatttcctggtccaccagaggctcttaccttagcaagatggatctgcagaagctacaggctccacacctgcacagagcttttcagcgttgagtccacatctggtgatgcaatcttgaaacaactttggcaccatccagatgcaatattgtgctgttctgtaaaaacagatgcatctccggtgttcacctttgcaaaccaagctggacttgacatgcttgaaaccactcttgttgctcttcaagacataatgctggataaagttcttgatgaagctggcaggaaggttctctgcattgagttctccaagataatgcaacagggatttgcatatctgccagcaggaatatgtgtatcaagtatgaatcgaccagtgtcttatgagcaggccattgcatggaaagttctcgatgatgatgattccaatcactgccttgccttcgtattcatgaactggtcttttgtctgatgggggaaccatcatttagatactttattatatctattaatttatattttgagtactttactaagatattgtcacaccaacaacgaatgtaactaatgactggatttcatgaactcatggttgtgtgtgccattagattagctttgctttatgcttttaccaaggatgtacctttcttactatataaactccttgttgaagtatagcctacttattcctaaaaa

SEQ ID NO: 10596 - DNA, 2663 bp, Malus x domestica
atcaaagtctggttccagaaccgcagatgccgagagaagcagcggaaggaatcttctcgactccagacagtgaacagaaagctgactgcgatgaacaagctgttaatggaagaaaatgaccgcttacagaagcaagtttctcatttggtttatgagaatggatttatgaagcagcaactgcataccgcatcaggaacgaccacagacaatagctgcgagtctgtggtcatgagtggtcagcaccaacaacagcaaaacccaactccccagcacccccaaagggatgctaacaacccagctggtcttcttgcaatagcagaagagaccttggcagagttcctttctaaggctactggaactgctgtcgactgggtccagatgattgggatgaagcctggtccggattctattggcatcgttgctgtctcccgcaactgcagtggagtagcagcacgagcttgcggtcttgtgagcctagagcccacaaaggtcgccgaaatactcaaagatcgtaaatcttggtttcgcgattgccgatgccttgaggtattaagtctaatccctgcggggaatggtggaacaattgagctcgtatacatgcagacttatgcacccacaacattggctgcggcacgtgacttttggacactaagatatactacaagtttggaagacggcagtcttgtggtatgcgagaggtcattgacttcctctactggtggcccacctgggccaacatctgcaagttttgtcagagctgaaatgcttcctagtggttatcttatccgaccttgtgagggtggaggttccattatcaacattgtggatcatgttgatttagacgcttggagcgttcctgaagttctcaggtcactttatgaatcctccaaaatccttgctcagaagacgaccatttctgccctgcgacacataagacagatagctcaagagtctagtggagaaattcagcatggtggaggtcgccaacctgctgttctgaggacattttgtcagaggctgtgtagtgggtttaacgatgctgttaatgggtttgcggatgacggttggacacttatgggtagtgatggtgtggaagatgttaccattgctattaactcatctccgaaagtgcttggttcccagtataacacttcaattttcccaccttttggaggaggggtgctgtgtgccaaggcatcaatgctgctgcagagtgttccccctgctttgcttgttcgtttcctgagggagcaccgggctgagtgggctgactatggggttgatgcatactctgctgcatgtcttaaagctagtccatatgcagttcctcttgcaagaggtggtggctttccgagcacccagaatattttaccgcttgcacaaactgtggagcatgaggagtttttagaggtagttcggctagagggtcctgctttctctcctgaagatgttgctttgacacgggatatgtacttattacagttgtgcagtggagttgatgagaatgcagttggtgcctgcgctcagcttgtctttgcacctattgatgaatcatttgctgatgatgctcctctgttgccctccggttttcatgtcatacctttggatcccaaggcagatggacctactgcaactcgcactttagatttggcctctacgcttgaagtaggaaccagtggtgctcgtgccattaatgacgctgatgggaatagttacaaccgtaggtcagtgctaaccatagccttccaatttacctttgagaaccacttgcgagacaatgtggctgcaatggctcgccagtatgtgcgtagtgttgtaagctctgttcagagggtagctatggctattgccccatccccgctcagctcccaaataggaccaaaaccccttcctggatgtcccgaggctcatactttggcacgatggattttcagaagcttcaggattcacactgggggagagctctttcgagtcgatatctcatctagtgatgctattttgaagcaactttggcgccattcggatgccatcatgtgctgctctgttaaaacaaatacgtcgccagtgttcacctttgcaaaccaggctggccttgacatgctcgaaaccactcttgttgccctccaagacatcatgctcgacaagattctagacgaagctggacgaaaatttctctgctcggagttctccaaaatcatgcaacagggctttgcatatctgccagccggaatatgtgcctccagcatggggagaccggtgtcttacgagcaagctgttgcatggaaagttgttaacgacgacgattccaatcactgccttgcattgatgttcatgaactggtcctttatgtgattgtgatggatgatagatctcacaaacacttttaagtttcgattaagttatgtagttcctttttatatgagtactcttagaacttttgaagtcaaagtagtcaatagcaggatatttcatggagacttttcagagtgtttatattttggatcaatggatatgactatgcagtctgctttaacatatcacgatgatttgtgaatgctgaactctctcccaaaagcatgcgaccctttgtatttaggtttcacgcggtgtcagaaccgttctattccgtcaataatactcgggagtttctcaaaaaaaaaaaa

SEQ ID NO: 10597 - DNA, 692 bp, Antirrhinum majus
  misc_feature (351)..(351): n is a, c, g, or t
acggcggtggattgggtgcagatgattgggatgaagcctggtccggattctattggcattgttgctatttcccgcaactgtagcgggatagcggcaagagcctgcggcctcgtgagtcttgaacccacgaaggttgctgaaattctcaaagatcgactttcttggtatcgcgactgccgttgccttgatattgcgagtgccatccccacggggaacggaggcaccatagagctcatgtatatgcagacttacgcaccaacaacactggcgtctgctcgtgatttttggacgatgagatacactacaagtttggaagacggaagtcttgtgatatgtgagaggtcattgacntcttccactggtggtccagctggaccacttgctacttgctttgtgagagctgaaatgcttcctagtggttttctgatacgtccttgtgatggcggtggctccatcatccatattgttgatcacctcgacttggatgcttggagtgttcctgaagttctaaggccactttatgaatcttccaaaatcctcgcacagaagatcaccgtggctgccttgcgtcatatcagacaaattgctcaagaaagcaatggagagattcagtgtagcggtggtcgccaacctgctgtccttagaacattaagtcagagattgtgcaggggcttcaatgatgccctcaacgg

SEQ ID NO: 10598 - DNA, 2694 bp, Vitis vinifera
atggcgatggcgattgcgcagcagcatagggagagtagtagcagtggtagcatcaacaagcatcttgactccggaaaatatgtgcggtacaccgcagagcaggtcgaggctctggaacgagtctacttagagtgtccaaagcccagttctcttcggcggcagcagctgatccgggagtgtcctattctctctaatattgagcccaagcaaatcaaagtctggtttcagaatcgcagatgtcgagagaagcagagaaaagaggcttctcgactccagaccgtgaacaggaaattgacggccatgaacaagctgttgatggaggagaatgatcggctgcagaaacaagtgtcgcagctggtatgcgagaatgggtatatgcgacaacagcttcaaactgcatcagctgcaactactgatgctagctgtgaatctgtggttaccactcctcagcattctctgagagatgctaataaccctgctggactcctctccattgcagaggagactttggcagagttcctctcaaaggctacaggaactgctgtcgattgggtccagatgcctgggatgaagcctggtccggattcggttgggatctttgccatttcacatagttgcagtggagtggcagctcgagcatgcggtcttgtaagtttagaaccctcaaagattgcagagatcctcaaagatcgtccatcttggttccgggactgtcggagccttgaagttttcaccatgtttccagctggaaatggaggaactgttgaactcttatacacacagatatatgccccaactacgctggctcctgcacgggatttctggactctaagatacaccaccagtttggacaatggcagtctcgtggtctgtgagagatcactgtctggttctggagctggtccaaacaccgctgctgctgctcagtttgtgagagctgaaatgcttcctagtggctatcttattcgtccatgtgagggtggaggatcgatcatccatattgttgaccacctgaatcttgaggcatggagtgtgccagaggtgctgcgaccactttatgaatcttcaagagttgtagctcagaaaatgactattgcagcattgcgctacatccggcaaatagctcaggagacaagtggtgaggtggtatatggtttgggcaggcagccagctgttctgcgaacttttagccaaagattgagcagaggcttcaatgatgctatcaacggatttaatgatgacggctggtcattgatgagttgtgatggtgctgaagatgtaataattgcagttaactcaaccaaaaatttgaacaccacttctaatcctgctaattccctttccttgcctgggggggttctctgtgctaaagcatccatgctgctccaaaatgttcctccggcagttctggttcgcttcctgagggagcaccggtcagagtgggctgattttagtgttgatgcctattctgctgcatcattgaaagctagcccatactcttatccagggatgaggcccacgaggtttactgggagccaaattattatgccacttggtcacacaattgaacatgaagagttgcttgaagtaattcgacttgaaggccattctcttgctcatgaagatgcttttatgtcgagggacattcatctcctgcagatatgtagtggagttgacgagaatgcagtgggagcttgttctgaacttgtttttgctccaattgatgaaatgtttccagatgatgctccactgttaccctctggttttcggatcatcccactggattcaaaatcaggtgatacacaggagacattgactactcatcggaccttggatctgacatccagtcttgaagtgggcccagcaacaaatcaggctgcaggggattcatcatcatgctataacacacgatcagtcttgactattgccttccagtttccatttgagagcaatctacaggataatgttgcaacaatggctcgtcagtatgttcggagcgtgatttcctctgtgcagagggttgccatggccatatctccttcaggattgggcccagctgtgggaccaaagctgtcagcagggtctccagaagctcttacattagcccactggatctgccagagctatagttaccatgttggggcggagttgctgagatctgattctgtgggtggcgattcggtgttaaaaaatttgtggcatcaccaggatgctattttgtgctgctcattaaagtcattgccagttttgatctttgcaaaccaggcaggacttgacatgctggagacaactttagtagctctacaagacatctcattggataagatatttgatgagtctggacgcaagggattgtgtgcagatttcgccaagataatgcaacagggttttgcttacttgccggctggaatctgcatgtcaacaatggggcgccatgtttcatatgaacaggccatcgcatggaaagtccttgctgcggaagagaacactgtccattgccttgctttctctttcatcaactggtcttttgtgtgatcattatttattcaccaagcccctttcctgagtggaacttggaaacaaaaaggaaaagaagtgcagaagaaaaagttttgtaatatgtaaacaccagtcccacgtttgcttcatattaatttaatttaattttattgaatgcacccaaaaatttcttta

SEQ ID NO: 10599 - DNA, 3035 bp, Glycine max
gtgttacctttgttgagagtgagtgagtgaaagcatggctatggttgtggctcaacacagagaaagtagcagcagtggaagcattgacaagcacttagattctggtaagtatgtgaggtatactgctgagcaagttgaggctcttgaaagggtctatgccgagtgccctaagcctagttctctgcggaggcaacaattgatcagagagtgccccattctctccaacatcgagcctaagcaaatcaaggtttggttccagaaccgtaggtgtagggagaagcaaagaaaagaggcatctaggcttcagaccgtgaaccgcaaactcactgcaatgaacaagttgttgatggaggagaatgatcggttgcagaagcaggtgtcacagcttgtttgtgagaatggttttatgaggcagcaattgcatactccatcggcaacaactactgatgctagttgtgattcggtggttaccactcctcagcataccctgagagatgctagtaaccctgctggactcctatcaattgcagaggaaactttgacagagttcctttcaaaggctacaggaactgctgtagattgggtccagatgcctgggatgaagcctggtccggattcggttgggatctttgccatttcacaaagttgcagtggagtggcagctcgagcctgtggtcttgttagtttagaacctacaaagattgcagagatccttaaagatcgtccatcttggttccgtgactgtcggagcctagaagtttttactatgtttcctgctggaaatggaggaaccattgaacttgtttacacacagacatatgctccaacaacactggctcctgctcgggatttctggactctgagatataccacaagtttggaaaatggcagtcttgtggtttgtgagaggtccctgtctggttctggaactggccctaatccagctgctgctgctcagtttgtaagggctgaaacactccctagtggctacttgatccgaccatgtgaaggtggagggtcaatcattcacatagtagaccacctaaatctcgaggcatggagtgtgccagaagtgttgcggccactttatgaatcatccaaggtggttgctcagaaaatgacaattgcagcgcttcgctatatcaggcaaatagctcaggaaacaagtggtgaggttgtttatggattgggtaggcagcctgctgttctgcggactttcagccagagattgagcagaggcttcaatgacgctgtaaatggattcaatgatgatgggtggactgtattgaactgtgatggtgctgaggatgtaattattgctgttaattcaaccaagaatttgagtggcacttctaacccagcaagttcccttacattccttggaggaattctctgtgcaaaagcttctatgttgcttcaaaatgtccctcctgcagttttggttcgttttctgagggagcaccgctcagagtgggctgatttcaatgttgatgcttattctgctgcatcactgaaagctggcacctatgcctatccagggatgaggcctacaagattcactggcagtcaaataattatgcctcttggtcatacaattgaacatgaagagatgcttgaagttattaggttggaaggtcactctcttgctcaagaagacgcttttgtttctagggacattcatctcttacagatatgtagtgggattgatgagaatgctgtgggggcttgttcagagctcgtatttgctccaattgatgaaatgttccctgatgatgctccattggttccttctggtttccgcattatcccattagattcaaaaccaggtgacaaaaaggatgctgttgctacaaatcggaccctggatttgacatctggttttgaagttggtcctgcaacaactgctggtgcagatgcatcatcaagtcaaaacactcgatcggtgttgactattgccttccagttcccttttgacagcagtctgcaagacaacgtcgcggtcatggcacgccaatatgtccgcagtgtgatttcctccgtgcagagggttgccatggctatatctccatctggtataaacccatcaattggagctaaactttctcctggttctccagaggctgttacactagctcactggatctgccaaagttatagttactatttagggtccgacttactgagatcagattctcttgttggtgacatgatgctgaaacaactgtggcatcaccaggatgccattctatgctgttcactgaagtcattgccagtgttcatatttgcaaatcaagctggccttgacatgttggaaacaaccctagttgccttacaagatatcacattggataaaatatttgatgaggctggacgcaaggcattgtgtacagactttgccaagttaatggagcagggttttgcttatctgccagctggaatctgcatgtcgacgatggggcgccatgtgtcatatgaccaagccattgcatggaaagttcttactggggaagacaacactgttcactgcttggctttctctttcataaattggtcatttgtatgaaaaatccaattcgtgtgccctgctttttcccacttgaacataaaaatgaaagggttaaaagggagacaagacaagtttggggggaaaaagaagtcgtaaatttttgtataacacatcaggatcaggtttgcatttaattcgatttaatttatttcttatttagtgcagagaccaaattgaattaatcttgtaaattatttagtgctagagtgaagttgagacttttgaatgacacatgttgagtactttgtttttgtctctagtatctttcactcgagttgagctcatacacagaagaacttgtgtgatgacaaagcgcgtgtaatgtttcttacacaatcacagttctgacttgtgtgtccaatgtagtactttgtttttgtatgtagtatgatcatatctttcaactcgagttaaatattagcacagtacatttgtatctgatgtacaacctaagtatattttaaattgc

SEQ ID NO: 10600 - DNA, 3797 bp, Glycine max
actttattcccttcttcaactccaacatgtttatgcttcttagggtttctttttctttaccctcttaaaactttaacccccccccttctctattccttccttctatctcaagcccatcccctcattctctttctctttcttttcaaacccacacctctcctctcttctacataaacaccaataaaaccccgcaatttgagctcaacacacgacaacaactacaagtggggttccttaaaaattcaatctttcggtttcgacttcttgcaagtgaaaaaaaaaaaaaggcagtgagtgggttgtggttcggtttggttttatcttagctggttcttttacgagcgtttctgtttaacatttttggagccattcgctgcaattcttttctcaatgaaagagagtttctttctttctctctctctccccttttattttttattctctgagctggttccacggtagagaagaagaagaagaagaaacaaccaataacggtggttgcactaaaatacacactcttactctttctctctccctttaacgttaccccagttaagttttcttatgtaaaggcacacccttcactagtaccaacaccaacaacaaccttgtcttttttcattttctccttctcgtgttacctttgttgagagtgagtgagtgaaagcatggctatggctgtggctcaacacagagaaagtagcagcagtggaagcattgacaaacacttagattctggcaagtatgtgaggtacactgccgagcaagttgaggctcttgaaagggtctatgctgagtgccctaagcctagttctctgagaaggcaacaattgatcagagagtgccccattctctccaacatcgagcctaagcaaatcaaggtttggttccagaaccgcaggtgtagggagaagcagagaaaagaggcatctaggcttcagactgtgaaccgcaaactcactgcaatgaacaagttgttgatggaggagaatgatcggttgcagaagcaggtgtcacagcttgtgtgtgagaatgggtttatgaggcagcaattgcatactccatcagcagcaactactgatgctagttgtgattcggtggttaccactcctcagcataccatgagagatgctaataaccctgctggactcctatcaattgcagaggaaactttgacagagttcctttcaaaggctacaggaactgctgtagattgggtccagatgcctgggatgaagcctggtccggattcggttgggatctttgccatttcacaaagttgcagtggagtggcagctcgagcctgtggtcttgttagtttagaacctacgaagattgcagagatccttaaagatcgtccatcttggttccgtgactgtcggagcctagaagtttttactatgtttcctgctggaaatggaggaaccattgaacttgtttacacgcagacatatgctccaacaacactggctcctgcccgggatttctggacgctgagatataccaccagcttggaaaatggtagtcttgtggtttgtgagaggtccctgtctggttctggaacaggccctaatccagctgctgctgctcagtttgtaagagctgaaacacttcctagtggctacttaatccgaccatgtgagggtggagggtcaatcattcacatagtggaccacctaaatctggaggcatggagtgtgccagaagtgttgcggccactttatgaatcatccaaggtggttgctcagaaaatgacaattgcagcgcttcgctatatcaggcaaatagctcaggaaacaagtggtgaggtggtttacggattgggtaggcagcctgctgttctgcggactttcagccagagattgagcagaggcttcaatgacgctgtaaatggattcaatgatgatgggtggactgtattgaactgtgatggtgccgaggatgtatttattgcagttaattcaaccaagaatttgagtggcacttctaacccagcaagttcccttacattccttggaggaattctctgtgcaaaagcttctatgttgcttcaaaatgtccctcctgcagttttggttcgttttctgagggagcaccgctcagagtgggctgatttcagtgttgatgcttattctgctgcatcactgaaagccggcacctatgcctatccagggatgaggcctacaagatttactggcagtcaaataattatgcctcttggtcatacaattgaacatgaagagatgctggaagttattaggctggaaggtcactctcttgctcaagaagatgcttttgtttctagggacattcatctcttacagatatgtagtgggattgatgagaatgctgtgggggcttgttctgagcttgtatttgctccaattgatgaaatgttccccgatgatgctccattgattccttctggtttccgcattatcccattagattcaaaaccaggtgacaaaaaggaagttgctacaaatcggaccctggatttgacatctggttttgaagtgggtcctgcaacaactgctggcacagatgcatcatccagtcaaaacactcgatcagtgttgactattgccttccagttccctttcgacagcagtctgcaagacaatgtcgcagtcatggcacgtcagtatgtccgcagtgtgatttcttccgtgcagagggttgccatggctatatcaccatctggtataagcccatctgttggagctaaactttctcctggttctccagaggctgttacactagctcactggatctgccaaagttatagttactatatagggtctgacttactgagatccgattctcttgtgggtgacatgatgctgaaacaactgtggcatcatcaggatgcaattctatgctgttcactgaaggcaagcaagcttccattgccagtgttcatatttgcaaatcaagctggccttgacatgttggaaacaactctagtagctttacaagacatcacattggataaaatatttgatgaggctggacgcaaggcattgtgtacagactttgccaagttaatggagcagggatttgcttatctgccagctggaatctgcatgtcgacgatgggacgccatgtgtcatatgaccaagccatcgcatggaaagtgcttactggagaagacaacactgttcactgcctggctttctctttcataaattggtcatttgtatgaaaatccaattcgcgtgccctgctttttcccacttgaacataaaaatgaaagggttaaaagggagacagtcaaatttggagggaaaaagaagtcctaaatttttgtataacacatcaggatcaggtatgcatttaattcgatttaatttatttcttatttagtgcagaaaccaaattgaattaatcttgtaaattatttagtgctagagtgaagttcagacttgaatgacacatgttgagtactttgtttttgtctctactatctttccctcgaccttaagctcatacacagaagaacttgtgtgatgacaaagcgcgtttgtaatgtttattcttacacaatcacagttctgacttgtgtgtccaacgtagtactatatattcttactggagtactttgtctttcaactcgagttaagcattagggtacatttgtatctgaagtactatgcatttgtacaacctatctgtattttaagattgctaaagttataaactgaagtgttaaattaattacacatcactaacgatggtggtaacgtatgtgaaatagaaagagaataaatggaaaatagttacacagaccttttat

SEQ ID NO: 10601 - DNA, 2857 bp, Malus x domestica
ctttaagctccttctgaaatctaaagaaaaaccaaaaccaactagttgtctctagagctctctctcttcctcctttctctctcctcccacccttggttgtctatattagcttttgagcttttgttggtttttggggttcgggaaaatggccatggcggtggctcaccacagagagagcagcagtgggagcagtataaacaagcacctcgatgccggaaaatatgtacgttacacatccgagcaagttgaagctcttgagagagtctacgccgagtgcccgaagccgagctctctgcgcaggcaacagttgatccgggagtgctccattttatcaaacattgagcccagacagatcaaggtctggttccagaaccgcaggtgtagggagaagcagagaaaagagtcctcaagactgcagactgtaaacagaaaattatcggcaatgaacaaactgctgatggaggaaaatgatcgattgcagaaacaggtctctcagcttgtttgtgaaaatggttatatgcgccagcaattgcatagtgcatcagctgcaactactgatgcaagcggcgactctgtggtgacaactcctcagcattctctcagagatgctaataaccctgcaggactcctatccgtagcggaggagacattggcagagttcctatccaaggctaccggaactgctgtcgattgggtccagatgcctgggatgaagcctggtccggattcagttgggatatttgccatttcacaaagttgcagtggagtggcagcaagagcctgcggcctcgtaagtttagagcctacgaagattgcagagatccttaaagatcgtccatcttggttccgggactgtcggagccttgaagtttttacaatgtttcctgctggaaatggaggaactatagaacttatatatacacagacatatgctccaactacattggctcctgcaagggatttttggaccctaagatacactgcaactttagacaatggcagttttgtggtgtgtgaaagatctctttccggttctggcgctggcccaaatcctgcttctgcttcacagtttgttagaggcgcgatgcttcctagtggttatctgattcgaccatgtgagggtgggggatcaatcgttcatattgttgaccacctgaatcttgaggcatggagtgtgccagaggtgctgagaccgctttatgaatcgtctaaagtggtagcacagagaatgactattgctgcgttgcgctatatcagacaaatagccgaagagacaagcggtgaagtggtgtacagtttgggtaggcagccagctgttctgcgaacttttagccaaagattgatcagaggcttcaatgatgctgtcaatggattcaatgatgatggatggtcattggtcaactgtgatggtgatggtgctgacgatgttataattgcagtcaattcaactaagaatttaacttctacttcgaaccatgccaattcccttgcattacttggaggtgttctctgtgcaaaggcttccatgttactacaaaatgtgccccctgctgttcttgttcgtttcttgagggagcaccgttcagagtgggcagatttcaatgttgatgcctactccgccacatctatgaaagctggtgcatatgcttatcctgggatgaggccaacaaggtttaccgggggacaaattatcatgccacttggccacacaattgaacaagaagagttgcttgaagttgttcgacttgaaggccattctctaactcaagaggatgcttttgcatcgagggacattcatctcttgcagatatgtagtggagttgatgagaatgctgtcggagcctgctctgagcttgtttttgctccaattgatgagatgtttccagatgatgcgccattgcttccctctggtttccgtattatcccactggattcaaaaacaggtgattcaaaggatactttgaatacacatcgaacattagatttgacatccagtcttgaagtgggctcaacaacgagcaatgcagctggagagcttactacatttcacaatactcgatcagtattaacgatcgccttccagtttccatttgataatagtctacaagagaatgtcgcaaacatggcacggcagtatgttcgaagcgtaatttcatctgtgcagagagttgcgatggctatatctccatctggattgagtccgtccgtaggaccaaaactatctcccggctcccctgaagctcaaacactggctcactggatctgccagagttacagttatcatgttgggggtgaattactgagacctgattccttgggcggtgactcgttgttgaaacatttatggcatcaccaagatgccattttgtgttgttcattgaagtcaatgccggttttcatctttgcaaaccaggcaggacttgacatgctggagacaacattagttgcccttcaggacatctcattggacaagattttcgatgagtccggacgcaagacgttgtgtgcagactttgctaagctaatgaaccaggggtttgcatacttgccggctggcatctgcatgtcgacgatgggacgccacgtatcgtacgagcaagcgattgcatggaaagtagttgcagcagaagagaactctgtccattgtcttgccttctccttcgtaaactggtcttttgtgtgaacgttttaatttattccatccctctcacctttcttccgcttgaacatgcaaaagaagcttgagaaaaaagaaaagcagaaatgtgggaaaggaaaagaagttttgtaatatatttaccccggaggtttgcatcatattaatttaatttaattttttgctttgaaaaaaaaaaaa

SEQ ID NO: 10602 - DNA, 3794 bp, Glycine max
actttattcccttcttcaactccaacatgtttatgcttcttagggtttctttttctttaccctcttaaaactttaacccccccccttctctattccttccttctatctcaagcccatcccctcattctctttctctttcttttcaaacccacacctctcctctcttctacataaacaccaataaaaccccgcaatttgagctcaacacacgacaacaactacaagtggggttccttaaaaattcaatctttcggtttcgacttcttgcaagtgaaaaaaaaaaaaaggcagtgagtgggttgtggttcggtttggttttatcttagctggttcttttacgagcgtttctgtttaacatttttggagccattcgctgcaattcttttctcaatgaaagagagtttctttctttctctctctctccccttttattttttattctctgagctggttccacggtagagaagaagaagaagaagaaacaaccaataacggtggttgcactaaaatacacactcttactctttctctctccctttaacgttaccccagttaagttttcttatgtaaaggcacacccttcactagtaccaacaccaacaacaaccttgtcttttttcattttctccttctcgtgttacctttgttgagagtgagtgagtgaaagcatggctatggctgtggctcaacacagagaaagtagcagcagtggaagcattgacaaacacttagattctggcaagtatgtgaggtacactgccgagcaagttgaggctcttgaaagggtctatgctgagtgccctaagcctagttctctgagaaggcaacaattgatcagagagtgccccattctctccaacatcgagcctaagcaaatcaaggtttggttccagaaccgcaggtgtagggagaagcagagaaaagaggcatctaggcttcagactgtgaaccgcaaactcactgcaatgaacaagttgttgatggaggagaatgatcggttgcagaagcaggtgtcacagcttgtgtgtgagaatgggtttatgaggcagcaattgcatactccatcagcagcaactactgatgctagttgtgattcggtggttaccactcctcagcataccatgagagatgctaataaccctgctggactcctatcaattgcagaggaaactttgacagagttcctttcaaaggctacaggaactgctgtagattgggtccagatgcctgggatgaagcctggtccggattcggttgggatctttgccatttcacaaagttgcagtggagtggcagctcgagcctgtggtcttgttagtttagaacctacgaagattgcagagatccttaaagatcgtccatcttggttccgtgactgtcggagcctagaagtttttactatgtttcctgctggaaatggaggaaccattgaacttgtttacacgcagacatatgctccaacaacactggctcctgcccgggatttctggacgctgagatataccaccagcttggaaaatggtagtcttgtggtttgtgagaggtccctgtctggttctggaacaggccctaatccagctgctgctgctcagtttgtaagagctgaaacacttcctagtggctacttaatccgaccatgtgagggtggagggtcaatcattcacatagtggaccacctaaatctggaggcatggagtgtgccagaagtgttgcggccactttatgaatcatccaaggtggttgctcagaaaatgacaattgcagcgcttcgctatatcaggcaaatagctcaggaaacaagtggtgaggtggtttacggattgggtaggcagcctgctgttctgcggactttcagccagagattgagcagaggcttcaatgacgctgtaaatggattcaatgatgatgggtggactgtattgaactgtgatggtgccgaggatgtatttattgcagttaattcaaccaagaatttgagtggcacttctaacccagcaagttcccttacattccttggaggaattctctgtgcaaaagcttctatgttgcttcaaaatgtccctcctgcagttttggttcgttttctgagggagcaccgctcagagtgggctgatttcagtgttgatgcttattctgctgcatcactgaaagccggcacctatgcctatccagggatgaggcctacaagatttactggcagtcaaataattatgcctcttggtcatacaattgaacatgaagagatgctggaagttattaggctggaaggtcactctcttgctcaagaagatgcttttgtttctagggacattcatctcttacagatatgtagtgggattgatgagaatgctgtgggggcttgttctgagcttgtatttgctccaattgatgaaatgttccccgatgatgctccattgattccttctggtttccgcattatcccattagattcaaaaccagttaagttttgttcctctgtaaatcggaccctggatttgacatctggttttgaagtgggtcctgcaacaactgctggcacagatgcatcatccagtcaaaacactcgatcagtgttgactattgccttccagttccctttcgacagcagtctgcaagacaatgtcgcagtcatggcacgtcagtatgtccgcagtgtgatttcttccgtgcagagggttgccatggctatatcaccatctggtataagcccatctgttggagctaaactttctcctggttctccagaggctgttacactagctcactggatctgccaaagttatagttactatatagggtctgacttactgagatccgattctcttgtgggtgacatgatgctgaaacaactgtggcatcatcaggatgcaattctatgctgttcactgaaggcaagcaagcttccattgccagtgttcatatttgcaaatcaagctggccttgacatgttggaaacaactctagtagctttacaagacatcacattggataaaatatttgatgaggctggacgcaaggcattgtgtacagactttgccaagttaatggagcagggatttgcttatctgccagctggaatctgcatgtcgacgatgggacgccatgtgtcatatgaccaagccatcgcatggaaagtgcttactggagaagacaacactgttcactgcctggctttctctttcataaattggtcatttgtatgaaaatccaattcgcgtgccctgctttttcccacttgaacataaaaatgaaagggttaaaagggagacagtcaaatttggagggaaaaagaagtcctaaatttttgtataacacatcaggatcaggtatgcatttaattcgatttaatttatttcttatttagtgcagaaaccaaattgaattaatcttgtaaattatttagtgctagagtgaagttcagacttgaatgacacatgttgagtactttgtttttgtctctactatctttccctcgaccttaagctcatacacagaagaacttgtgtgatgacaaagcgcgtttgtaatgtttattcttacacaatcacagttctgacttgtgtgtccaacgtagtactatatattcttactggagtactttgtctttcaactcgagttaagcattagggtacatttgtatctgaagtactatgcatttgtacaacctatctgtattttaagattgctaaagttataaactgaagtgttaaattaattacacatcactaacgatggtggtaacgtatgtgaaatagaaagagaataaatggaaaatagttacacagaccttttat

SEQ ID NO: 10603 - DNA, 2568 bp, Populus trichocarpa
atggcgatggcggtggcccctcagcacagagagagcagtggtagtgggagcttaaacaagcacctcactgataatggaaagtatgttcggtacacatcagagcaagtggaggctcttgaaagagtttacgccgagtgccctaagccaagctctttgcgcaggcaacagttgatcagagagtgtcccattttggctaatattgagcccaagcagatcaaagtctggtttcaaaatcgcaggtgtcgagagaagcagagaaaagagtcctcaagactccaaactgtgaacaggaaattgactgcaatgaataagctgttgatggaagagaatgatcgcctgcaaaaacaggtgtcacagctggtgtgtgaaaatggtttcatgcagcaacaactacaaactgcacctgcagcagctgatgcgagctgtgactccgcggttaccactccacagcattcactcagagatgccaataaccctgctggactcctctcattggcagaggagaccttggcagagttcctttcaaaggctacaggaactgctgtcgattgggtccagatgcctgggatgaagcctggtccggattcggttgggatctttgccatttcacaaaggtgcagtggagtggcagctagagcctgcggtcttgtaagtttagaacctacaaagcttgcagagatccttaaagatcgtcaatcttggttccgggattgtcggaaccttgaagttttcactgtgtttcctgctggaaacggtggaacaattgaactattatacagtcagatatatgctccgacaactctagctcctgcgcgggatttctggactctgagatacactataaatttagagaatggcagtcttgtggtgtgtgagagatctctttctggttctggtgctggaccaaatgcagctgcagctgctcagtttgtgagggctgaaatgcttcctagtggttatttgataaggccatgtgaaggaggagggtcaattatccacatcgtggatcacctgaatcttcaggcatggagtgtgcctgaggtgctgcgaccactttatgaatcatcaaaagcagtggcacaaaaagtgacaatcacggctctgcgccatgtcaggcaaatagctcatgaaaccagtggtgaggtggtgtatggtttgggcaggcagccagctgtgctgagaacctttagccaaagattaagcagaggcttcaatgatgcaatcaatgggtttaatgatgatggttggtcactgatgaattctgatggagctgaggatgtaataattgctgttaacacaaccaagaacttgatcagtgctaataatcctgctcattcactttcattcttgggagggattctttgtgcaaaggcttccatgctactgcaaaatgtgcctccagctgtgctggtccgcttcctaagggagcatcgctctgagtgggctgatttcagtgttgatgcctattctgctgcatcgttgaaagctggttcatatgcatatccagggatgagatctatgaggtttactgggagccaaatcatcatgccattgggccacacaattgaacaagaagagttgcttgaagttattcgacttgaaggccattcttttgcacaagaagatgcttttgtttcacgggacatccatctcctacagatatgtagtggaattgatgagaatgctgttggagcctgttctgaactagtttttgctccaattgatgaaatgttcccggatgatgctccactgctaccctctggtttccgcgtcattccactggaatcaaaaacaaaggatgcgcaggaggcattgaccacaaatcgcactctggatctaacatcaagtcttgaagtgggcccggtaacaaaccatgcttcagtggatggttcatcatgtcatttgcgatcagtgttgactattgctttccagttcccgtttgagagcaatctacaggataatgttgccaccatggcccgtcagtatgtccgcagtgtgatttcatctgtccagagggttgccacggccatatctccatcaggattgaatccagctttgggaccaaagctatctgcaggctcccctgaagctctaacactggctcactggatctgccaaagttattggcaagtcctgcctcaagtttcatcatgttaccatttaggagcagaattactgagatctgattctgtgggtggagattctgtcctgaaacatctatggcatcatccggatgcaattttatgttgttcattggaggcactaccagtgttcatctttgctaaccaggcaggacttgacatgctggagacaactctagtggctctgcaagacatcacactggataagatatttgatgaatctggacgcaaggcattgtttacagacttcgcaaagttaatgcaacaggcaaacaatggatttgcatgcttgcctgctggaatctgcatgtcaacaatggggcgcaatgtatcatatgaacaagctgtttcatggaaagtgcttgctgctgaagagaacactgtccactgcattgctttctcttttgtaaactggtcttttttgtga

SEQ ID NO: 10604 - DNA, 3061 bp, Gossypium barbadense
ggcgtgcaaatgaaatataaaaattttcatttcatctctttccaattcctcactgtttcaagctcagacttattagatcactcgctgtctcacagctttttttttttcttctcttcatttatctatctctttgagaaaaaagtttatattttgcagaaagaacccttcactttgtattattgacaccctttttcttgttcttcatcatggttaagatttgtgttcctcttgacatttctttgtttagttctttcagaaaaccagcttttttctaatgctaatacttttgtggctctctcaaaaaagagagccaaattttgttattgtgtaataaagaaaaaaaaacccagttgagttgaccccctttttgttttggttttaaagattggatcttcgagagacatcaaaacacaaacagctgtttcaaagattgcttctttgagatggctatggcgatgacacatcatcacaacagggaaagcagcatagacaagcatttagatacaggcaagtatgttaggtacacagctgaacaagttgaagctttggaacgtgtttatgctgaatgtccaaaaccaagttctttgcgtaggcaacagttaataagggaatgtcctattctttctaacattgagcctaaacagttcaaagctttgttccaaaatcgcaggtgtagagagaaacaaaggaaagaagcttcaaggcttcaaacagtaaatagaaaattaacagcaatgaataagctgttaatggaagagaatgataggttgcaaaaacaggtttctcagttggtttgtgagaatgggtacatgagacagcaattgcatactgtaaatgcatcggcgactgatgcgagctgtgactctgcggtaaccactcctcagcattcactgagaaatgctaataaccctgctggactcctctctatcgcggaggagaccttggcagagttcctttctaaggctacgggaactgctgtcaattgggtccagatgcctgggatgaagcctggtccagattcagttgggatatttgccacttcccaaagttgtagtggaatggcagctcgagcttgtggtcttgtaagtttagaacctacaaagattgcagagattcttaaagatcgtccatcttggttccgggactgtcggaagcttgaagttttcaccatgtttccagctggcaatggtggtacgattgagcttgtatacacacagatgtttgctcctactacattggctcctgcaagggacttttggactctaaggtacactacaactttagagaacggcagtctcgtggtgtgtgagaggtctctttcgggttccggtgctggcccgagtgtggcttccgcagctcaatttgtgagagctgaagtgctccctagtggctatttgattaggccttgtgagggtggagggtcgattatccatattgttgaccacttgaatcttgaggcatggagtgtgccggaggtcttgcgccccctttatgaatcatccagagtaattgctcagaaaatgactattccggcgctgcgctatgttaggcagattgctcaagagacaagcggcgaggtggtttacagtttgggcaggcagcctgctgtgcttagaacatttagccaaagattaagcaggggcttcaatgaggcaataaatggattcaacgaagatggctggtcgataatgaattgtgatggtacagaggatgtgataattgctattaattccggcaagagcttgagcaacagttcgaatttgaccaccggtctttcattcctcgggggcgttctatgtgcaaaggcatccatgctgcttcaaaatgttcctcctgctgttcttgtccgattcttgagggaacatcgtttggaatgggctgatttcaatgtcgatgcttattcagctgcatcattgaaggccggaacatacacttatcctggaatgagacctacaagttttactgggagtcagatcatcatgccactcggccagacggtcgaacatgaagagctgctcgaagttataagactcgaaggccagtctcttacgcaagaagacgcgcttctatcaagggacattcatctattacagatatgtagtggaattgatgacaatgcggttggggcctgttcggagcttgtgtttgcaccaatagatgagatgtttccggatgatgctgccttactaccttcaggattccgcattatcccgttggagtcaaaaccagattcgttggctacaaatcggactttggatcttacttcgagtctcgaagtggggcctgcaacaagccaagctgccggagattctccgagtcagaatgcacgatcggtgttgacaattgccttccagtttcccttcgatacaaatcttcgggataatgttgcgaccatggcacgccagtatgtccgtagcgtcatttcttctgtccagaggrttgctatggccatatctccatgyggatcgagcccaactataggaccaaagccatctccaggttctcccgaagcgcttacgttggctcattggatctgccagagctacagtttccatttgggggaagagttgttgaaatccgaatcacttggtggcgactcagtattgaagaatctttggcaacatcaggatgcaatattgtgttgttcgttgaagtctgtaccggttttcatcttcgcaaatcaggccggtctagacatgcttgagacaactctagtggatctaccagacatcacactggacaaaatattcgatgagtcgggacggaaggcattgtgctctgatttcaccaagttgatgcagcagggattcactcacttgctggccggagtttgcatgtcgacaatgggccgccacgtctcgtatgaacaagctgttgcttggaaagtacttgcagctgatgcaaacactgtccactgcttggcattctcttttataaactggtcttttgtgtgaacaaaaaagaaaattataatttaaaatttccgaatatccagttttttttcctctctagccaaacatgaatgggtagtaaggcagcatcatcaatcactagtgaattc

SEQ ID NO: 10605 - DNA, 3108 bp, Medicago truncatula; identical to SEQ ID NO: 10587

SEQ ID NO: 10606 - DNA, 2879 bp, Vitis vinifera
atggcaatgtcctgcaaggatggtaaaggcataatggataatggcaagtatgtgaggtatacacctgagcaggttgaagccctggagaggctctatcatgagtgcccgaaacccagttctattcggcgccaacagctgattcgggaatgtccgattctgtccaatattgagcccaagcaaatcaaagtttggttccagaacagaagatgccgagagaagcagaggaaagaggcgtctcgcctccaagctgtgaataggaagctgaccgccatgaacaagcttttgatggaggagaatgataggttgcagaagcaggtgtctcaactggtgtatgagaatggctacttccgccaacatacccagaacacaacgcttgccacaaaagacacaagttgtgagtcggtggtgacgagcggtcaacaccacttgacccctcagcatccgcccagggatgctagtcctgcagggcttttgtccattgcagaagagactttaacagagtttctttcaaaggccactggaactgctgtagagtgggtccaaatgcctggaatgaagcctggtccggattccattggaatcgttgctatttctcatggttgcactggagtggcagcacgagcctgcggcctggtgggtctagagcctacaagggttgcagagatcctcaaggatcggccatcctggtttcgcgattgccgagctgtggatgtgctgaatgtgttgcccactgcaaatggtggaactattgagctgctttacatgcagctctatgcgcctactacgttggcgcctgctcgtgacttctggttgttacgttatacttctgttatggaggatggaagtcttgtggtctgtgaaagatcacttaaaaatactcagaatggtccaagcatgccaccagtgcagcattttgtgagagcagaaatgctgccaagtggctacttgataagaccttgtgaagggggtggttcaatcatacatattgttgatcatatggatttagagccatggagtgtgcctgaagtgttgcgtcctctgtatgaatcatcaacagtgcttgctcaaaaaacaacaatggcggctttgcgccagctgagacaaatagctcaggaggtttctcagtctaatgtcactggttggggtagacgacctgcagcactgcgagcgcttagccagaggctgagcagaggttttaatgaggctctcaatgggtttactgatgaagggtggtcaatgatgggaaatgatggcattgatgacgttaccatccttgtgaactcatctcctgagaaactaacaggcttaaatctttcctttgctaatggatttcctgcagtcagcaatgctgtgttatgcgctaaagcatcaatgcttttgcaggttagctttatatcttgttctgatgttctgttcactatttatcattttcagaatgtgcctccagcaatacttcttaggtttctgcgggagcacagatcagaatgggcagacaacaatattgatgcttactcagctgcagctgtaaaagttggtccctgtagtttgccagggtctcgagttggaagttttgggagccaagtcatacttccactggctcacactattgagcatgaagagttcttggaggtcattaagctggaaggtgtcggccattgtcctgaagatgcaatgatgcctagagacatgtttctcttgcaactatgcagtggaatggatgagaatgctgttggcacctgtgctgaactcatatttgctcccattgacgcttcttttgctgatgatgcacctcttttgccttctggttttcgcatcatccctcttgattctgggaaggaagcctccagtccaaatcgcaccctagaccttgcatctgctcttgagattgggccagctgggaatagatcatcaaatgattattctgttaatggtggcaatactagatctgttatgacaattgcatttgaatttgcatttgaaagccacctacaagaaaatgtagcatccatggctcggcagtatgtccgcagcattatatcatctgttcagagggtggcattagctctctctccttcgcatttaagttcccatgctggtcttcgaccaccactgggcactcctgaagcgcacacacttgctcgttggatcagtcacagctataggtgctacctgggtgtggagctactcaaatccagtggtgaagggagtgagaccatcctaaaaacactgtggcatctctcagatgctatcatgtgctgctctctgaaggcattacctgtattcaccttcgcaaaccaggctggtcttgatatgcttgagacaaccttggttgccctgcaagacattactttggagaagatattcgatgatcatggacgcaagactctctgctcagagttccctcagataatgcaacagggttttgcttgccttcaaggtggtatctgtttgtcaagcatgggccgtcctgtctcatatgaaagagctgtggcatggaaggtgctgaatgaggaagagaacgcccattgtgtctgttttatgtttatgaactggtcttttgtctgaccttctgaccagaactaaaagtacagtgtatgaagagtactagaacactcttaagaccattattctcgtcttttcttttttcttttttgttccttgtttgtctttttgttgtggaaaccctggagtactgattaggaccaatgttcccatgtttttaggcctgctgttgagatatttaccctgaaactaccttgtgttccattttgggtaatttcatgatctcttcagttcctgaatagaagaattatctctgatgtaattatttgttaaaatggaggaaatgcttgaaaccaggaactgattcaatgctaaaa

SEQ ID NO: 10607 - DNA, 2694 bp, Vitis vinifera; identical to SEQ ID NO: 10598

SEQ ID NO: 10608 - DNA, 2682 bp, Medicago truncatula
atggcagtgagttcagggtgcaaagatggtagcaagatagcaatggacaatggaaagtacgtaaggtacacaccagaacaagtggaagcacttgaaagactctaccatgaatgtccaaaaccaacttctcttcgaagacaacaactcattagagagtgtcctattctctctcatattgaacctaaacagatcaaagtttggttccagaacagaaggtgcagagagaagcagaggaaagaagctggaaggttacaagctgtgaacaggaagttaacagcaatgaacaaactgcttatggaggaaaatgatagattgcagaaacaagtgtcacaccttgtctatgagaacacgtttttccgccaacatacacaaaatacgacccttgccactacagacacgagttgtgagtcagtggtaacaagcggtcagcagcatccacaaccaagggatgcaagccctgctggacttttgtccattgcagaggagactttagcagagtttctatcaaaggctactggaaccgctgttgagtgggtccaaatgcccgggatgaagcctggtccggattccattggaatcgttgcaatttctcatggttcccctggagtggctgcacgtgcgtgcggcctcgtgggtcttgaacctgcaagggttgctgaaatcctcaaagataggctctcatggtatcgtgattgccgaactgtggatgttctaaatgttatgtccacaggaaatggaggaaccattgaattgctttacatgcagttgtatgcgccaacaactctggcaccaggtcgcgacttctggttgctgcgctacacatcacttttggaggatggcagtcttgttgtgtgtgaaagatcacttaacaacacacagaatggtcctagtatgcctccagtgccacattttgttagagctgaagtgttgccaagcggttatctgattagaccctgtgaaggagggggatccataattcatattgttgatcatatgcttttagagccttggagtgtgcctgaagttttgcgcccactttatgagtcgtccatgctgcttgctcagagaacaactatggcagctttacgtcatttaaggcagatttctcaagaagtttctcagccaagtgtgacaggatggggaaggcggcctgcagctctacgtgcgcttagtcaaagattgagcaagggattcaatgaagctgtcaacgggtttacagatgatggatggtctatgttagatagtgatggaattgatgatgtcacccttcttgtgaattcatcacctagcaagatgatgggactaaatcttggttataacaatggatttccatctgtcaccagttctgtgctatgtgccaaagcttccatgttgttacagaatgtccctccggctattcttcttagatttttgcgggaacacagatcagaatgggcagatacaagtattgatgcttattcagctgctgccattaaagctggtccgtgtagcttgccaggggccagaacaggagcttttggtggtcaggttattcttccactagctcacacaattgagcatgaagagttcatggaagttattaagcttgaaaacatgggctactatagagatgatatgacaatgcctggtgatattttcctcttacaactttgtagtggagtggatgagcatgcagttggcacaagtgcagagcttatttttgctccaattgatgcatctttctctgacgatgcacccattttgccttctggttttcgcatcatacctcttgaatctggcacagatgctgctagcccaaaccgtacactcgatcttgcttctgcactcgaggttggaaccacaggaaacaaagcaggtggtgacaattctggtcattcagggatcacaaaatctgtgatgacaatagcattccagtttgcatttgaagcccatcttcaagataatatcgcagctatggcacgacagtatgtgcgtagcattgttgcatctgttcagagagtttcattagcactctcaccatcgcgatttggttctcagaatgcttttcctttgccacctggaactcctgaggcacaaacgctcactcgatggatctgtaacagctacagattctatttaggcgcagaattactcaagtgtgaagggagcgaatcgatacttaaatccctttggcatcactcagacgcagttctgtgctgctctttaaaggcattacccgtttttacgtttgcaaatcaagctggacttgacatgcttgaaaccaccctggttgcacttcaagacatcaccctagaaaagatattcgatgacaacggaaagaaaaccctgtgctctgaatttccccagataatgcagcagggtttcatgtgtattcaaggcggtatttgtttatccagcatggggaggccaataacttatgagagagctgtagcatggaaagtattgaacgaagaagaatctgctcattgcatctgttttatgttcatcaattggtcttttgtctaatagattaaaaggtaggatgtaggaaaatagattgaaatgctaacctttaatctcatctatggtatttggataatcacttcactagaatgctctataactattttattgctatggctacctatggactcatttctttttagttgttgctatttatatatttttccctttatgcttttt

SEQ ID NO: 10609 - DNA, 3048 bp, Glycine max
acttctctttttctccctctctctctcccatatatgatccaatatattataatacaatagaaccaacaactgtgacagacaaactctgagtagtacctcttttattctcctcctcctccttctctttcattctcaaagcactcccatagtcttttctttcaccacccccttaatgaaacctcttggtttgtgtggttgaaataaacaaagataagtagtagtaataataataaatcgggttggacttggaagggatgatgacggtgagttcagcctgcaaagatgggagcaaggtggcactggacaacggcaagtacgttaggtacacacctgaacaggttgaagcactggaaagactctaccatgaatgtcccaaaccaagttccctccgccgccaacaactcatcagagagtgtcccatcctctccaacatcgaacccaaacagataaaggtttggttccaaaaccgaaggtgcagagagaagcagcggaaagaagcatcacggctgcaagctgtgaacaggaagctaacagcaatgaataaattactgatggaggaaaacgacagattgcagaagcaggtgtcacacctcgtctatgaaaacagctttttccgccaacagacacacaacaacgctacgcttgccacaacggacacaaacacaagctgtgagtcggtggtgacgagtggtcagcggaacttgacaccgcagcagcatccgccgagggatgctagccctgcaggacttttgtccatcgcagaggagactttagcagagtttctttcaaaggccactggaactgctgtcgagtgggtccaaatgcctgggatgaagcctggtccggattccattggaatcgttgctatttctcacggttgccctggagtggccgcacgtgcctgcggccttgttggtctagaacctgccagggttgccgaaatactcaaagataggctctcatggtttcgtgattgccgaactgtggatgttctaaatgtgatgtccactggaaatggtggaaccattgagctgctttacatgcagttgtatgcgccaacaactttggcacctggtcgtgacttctggttgctgcgctacacatcacttttagaggacggtagtcttgtggtctgtgaaagatcactaaataacactcagaatggtcctgctatgcccccagtgcagcattttgttagagcagacatgctggcaagcgggtatctgataaggccttgcgaaggagggggatcaattattcatattgttgatcatatggttctagagccatggagtgtacctgaggttttgcgcccactttatgagtcatcaatgctgcttgctcaaaggacaactatggcggccttacgtcatttgaggcagatttctcaagaggtttctcagccaagtgtaacaggatggggaagaaggcctgcagctctacgtgcgctgagccagagattgagcaagggctttaatgaagctgtcaatgggtttgcagatgatggctggtccatgttagagagtgatggcattgatgatgttacccttcttgtgaattcctcacctagcaagatgatgggagttaaccttggctataacaacaatggatttccttctgtaagcagttctttgctatgtgccaaagcatccatgttgctacagaatgtccctccagcaattcttcttagattcttgcgggagcaccgatcagaatgggcagatagcagtattgatgcttactcagctgctgccattaaagctggtccttgtagcttgccaggggcccgacccggaggttttgggggtcaggttattcttccactagcccacacaattgagcatgaagagttcatggaggttatcaagcttgaaaacatgggctattatagggacgacatgaatatacctggtgatgttttcctcttgcaactttgcagtggagtggatgagcatgcagttggcaccagcgcagaacttgtttttgctccaatcgatgcatctttctctgatgatgcgcccattttaccttctggttttcgcatcatacctcttgattctggcacagatgctgctagtccaaaccgtacacttgatctggcttctgcacttgaagttggaacaacagcaaacaaagcagctggtgacaactcaggtcattccgggagcacaaagtctgtgatgacaatagcattccagtttgcgtttgaagtccaccttcaggagaacatagcaaccatggccagacaatatgttcgtagtatcattgcatctgttcaaagggtttcattagcactttctccttcgcgctttggttctcacaatgctttccacttaccacctggcactcctgaggcacaaacacttgctcgatggatctgtaacagctaccggttctatcttggggtagaacttctaaaatgtgaaggcagtgaatccattctcaagtctctttggcatcactcagatgcagttttgtgctgctctttaaaggcattacccgttttcacgtttgcaaatcaagctggacttgacatgcttgagacaacattggttgcacttcaagacatcactctggaaaagatttttgatgacaatggaaagaaaactctgtgcaccgagttcccccagataatgcagcagggtttcatgtgtattcaaggtggtatctgtttatccagcatgggaaggccagtatcctatgagagagcagttgcatggaaagtgttaaacgaagaagaatctgctcattgcatctgttttatgttcatcaattggtcctttgtctgatagattaaacagtattaggatgtaggaaagaaaagtagaacagcacaagagtacctaactttggcgaatccctagaatgctttaaactctagtggggcatatgcgccaccaaaatctatctatagtcccatttgtttttttttttttttttcagttgttgtctctccttattttcttttatgcttctttaatattcgtgcatatcactttttttttaaataattatgttttttcatattctaatattaataattcacgt

SEQ ID NO: 10610 - DNA, 2810 bp, Glycine max
atgatggcggtgagttcagcctgcaaagatgggagcaaggtggcactggacaacggcaagtacgttaggtacacacctgaacaggtggaagcactggagaggctctaccatgaatgtccaaaaccaagttctcttcgccgtcaacaactcatcagagagtgtcccattctctccaacatcgaacccaaacagatcaaggtttggttccaaaaccgaaggtgcagagagaagcagcggaaagaagcgtcacggctgcaagctgtgaacaggaagctaacagcaatgaataaattactgatggaggaaaacgacagattgcagaagcaggtgtcacacctcgtctatgaaaacagctttttccgccaacagacacacaacaacaacgctacgcttgccacaacagacacaaacacaagctgtgagtcggtggtgacgagtggtcagcggaacttgacaccgcagcagcatccaccgagggatgctagccctgcaggacttttgtccattgcagaggagactttagcagagtttctttcaaaggccactggaactgctgtcgagtgggtccaaatgcctgggatgaagcctggtccggattccattggaatcgttgctatttctcacggttgccctggagtggctgcacgtgcttgcggccttgtgggtctagaacctaccagggttgccgaaatcctcaaagataggctctcatggtttcgtgattgccgaactgtggatgttctaaatgtgatgtccactggaaatggtggaactattgagctgctttacatgcagttgtatgcgccaacaactttggcacctggtcgtgacttctggttgctgcgttacacatcacttttggaggacggtagttttgtggtctgtgaaagatcacttaacaacactcagaatggtcctgctatgcccccagtgcagcattttgttagagcagacatgctgccaagcgggtatttgataagaccctgcgaaggagggggatccattattcatattgtcgatcatatggttctagagccctggagtgtacctgaagttttgcgcccactgtatgagtcatcaatgctgctagctcaaaggacaactatggcggccttacgtcatttgaggcaaatttctcaagaggtttctcagccaagtgtaactggatggggaagaaggcctgcagctttgcgtgcactgagtcagagattgagcaagggctttaatgaagcagtcaatgggtttgcagatgatggctggtccatgttagagagtgatggcattgatgatgtcacccttcttgtgaattcctcacctagcaagatgatgggagttagccttgtctataacaacaatggatttccttctgtgagcagttctgtgctatgtgccaaagcatccatgttgctgcagaatgtccctccagcaattcttcttagattcttgcgggagcaccgatcagaatgggcagacagcagtattgatgcttactcagctgctgccatcaaagctggtccctgtagcttgccaggggcccgatcaggaggttttggcggtcaggttattcttccactagctcacacaattgagcatgaagagttcatggaggttatcaagcttgaaaacatgggctactatagggacgacatgagtatacctggtgatgttttcctcttgcaactttgcagtggagtggatgagcatgcggttggcaccagtgcagaacttgtttttgctccaattgacgcatctttctctgatgatgcacccattttaccttctggttttcgcatcatacctctagattctggcacagatgctgctagtccaaaccgtacacttgatttggcttctgcacttgaggttggcacaacagcaaacaaagcagctagtgacaactcagctcattctgggagcacaaagtctgtgatgacaatagcattccagtttgcattcgaagttcaccttcaagagaacatagcaaccatggccaggcaatatgttcgtagcatcattgcatctgttcagagggtttcattagcactttctccttcgcgctttggttctcacaatgcttttcacttaccacctggcactcctgaggcacaaacacttgctcgatggatctgtaacagctatcggttctatcttggggtagaacttctaaaatgtgaaggcagtgagtccattctcaagtctctttggcatcactcggatgcagttttgtgctgctctttaaaggcattacccgttttcacgtttgcaaatcaagctggacttgacatgcttgagacaactttggttgcacttcaagacatcactctggaaaagatttttgatgacaatggaaagaaaactctgtgcactgagttcccccagataatgcagcagggtttcatgtgtattcaaggtggtatctgtttatccagcatgggaaggccagtgtcctatgagagagcagttgcatggaaagtgttaaacgaagaagaatccgcccattgcatctgttttatgttcatcaattggtcctttgtctaatatattaaacagtattaggatgtaggaaagaaaagtagagcacaagagtacctaactttggcgaatccctagaatgctttaaaactctagtgggcatatgcgccaccaagatctatctatggccccatttgttttatttttatcatcgctccttattttcttttatgcttctttaatattcgtgcatatcacttttttttagttatgttttttcatattctaatattaataattcatgtcatagccacaagagcatggcataactttggctg

SEQ ID NO: 10611 - DNA, 3060 bp, Malus x domestica
ggacagtcggtgagacagagttgaagtgttggaaagcgcccaaacaaaccagtaccgcaagaaaaatcagcagtaaacgagagagagagagagagagagagagagagagagagagagagaaatgatgtgaatacaaatacagttcctcttctgtctgaaattaagggggttttctcttcttaaaaaccttttcctttatcatttttctgctccatatatatttatacatacataacagtttgagtttgaaaaaccaaaagcaaaagaacacagccacttctcgacaactctgaccatgaatgaaacaacaaaatcacactaatagtctctctagcttccgggcatcaacaaaaccttcctagcaaatccaaaccttgaggaggccttgtcatgatggcggtgacgtcatcctgcaaagatggtgggatgaagatgcagatggacaatggcaagtacgtaaggtacacgccggagcaggtggaagctttggagcggttgtaccatgagtgcccgaagccgagctccatgcgccgccagcagctcatccgtgagtgccctatcctctccaacatcgagcctaagcagatcaaagtctggttccaaaaccgcagatgtagagagaagcagcggaaggaggcgtcgaggttgcagaccgtgaacagaaagctgacggcgatgaataagcttctgatggaggagaatgatcggttgcagaagcaggtgtctcagctggtctacgagaacagctacttccgccaacagacacaaaatgcgactttagccacgacagacacaagttgtgattcggtggtgacgagcggtcaacaccatttgactccgcagcagcatccaccaccaccgccaagggatgcgagccctgcaggacttctgtccattgcagaggaaactttagcagagtttttatcaaaggccactgggactgctgtggagtgggtccaattgcctgggatgaagcctggtccggattccattggaatcgttgcaatttctcacggttgcaccggtgtggcagcacgtgcatgcggccttgtaggtctagaccctacaagagtcgctgaaatcctcaaagatcggccttcgtggttccgaaactgccgatctgtggatgtgctgaacgtgttgtccactggcaatggtggaaccattgaactgctttacatgcagctctatgcacccacaactttggctccagctcgagatttctggttgcttcgctacacatcggtactagaagatggtagtctcgtggtctgtgaaagatcacttaacaacacacagaatggtcctagcatgccaccggtgcagaattttgtgagagcagaaatgctgccgagcgggtatctaattagaccttgtgaaggtggtggctcgatccttcacattgttgatcatatggatttggagccttggagtgtacccgaagtgttgcgcccgctttatgagtcatcaacacttcttgctcagaagacaactatggcggcattacgcaacctgaggcagatttctcaagaagtttctcagcctaattccgctggttggggaagaaggcctgcagctctccgtgctcttagtcagagattgagcaaaggtttcaatgaagcagttaacgggtttacagatgagggatggtctgttctagaaagtgatggtgttgatgatgttacccttcttgtgaactcgtctccgggcaagatgatgagtgcaaatctttataccaatggagttccatctatgagcactgcagtcttatgtgccaaagcatccatgttactccaaaatgtgcctccagccatacttcttagattcttgcgagaacaccgatcagagtgggctgacagaagcattgatgcttattcagctgctgctatcaaagctggtccctgcaacatgctagggcctcgagctggaagtttcggggatcaggttattcttcccctggctcacacaattgagcatgaagagttcatggaggtcattaagattgaaaacatgggccactatcgagaggatatgatgatgcctgcagctgacattttcctcttgcaactgtgcagcggagtggatgagaatgccgtcgggacctgcgctgaactagtatttgctcccattgatgcatcattttcggatgatgctccaattctaccttctggttttcgcatcatccctcttgattctcggatggatactccgagtccaaaccgtacgcttgatcttgcctcagctcttgaagttggacctgcaggaagcagagcatctggtgataatgctggccactctggcaatacaaagtctgtgatgacaatagcattccagtttgcatttgaaattcacctccaagaaaatatagccgccatggctcggcagtatgtgcgcagtatcatagcatcagtgcagagggtggcactggcactctccccgtctcattttggttcgcatgctggtttccggcctccacctggcacccctgaagcacaaacacttgctggttggatctgtcagagctataggtgctatctgggtggagaactactaaaaaccgaaggaagcgagtccattctcaaatccctttggcatcactcggatgcaatcttatgttgctccttgaaggcaatgccagtttttacattcgcaaaccaggcaggccttgacatgcttgagacgacgttagttgcacttcaagacataacactggagaagatttttgatgacaacggaaggaagaccctatgctccgagttcccgcagataatgcagcagggttttatgtgtcttcaaggaggaatatgcatgtcaagcatgggaaggccgatctcgtacgagagagcagtggcatggaaggtgttgaacgaagaagaaactgctcactgcatctgcttcatgttcatcaactggtcatttgtttaacactttggaggccacaagaacaacatcataggatatagaacttagaaattaaaacctcttctttgcaccaaaggcatattgggcccaaatttttttggttatcaatatcatctgctctttgctaaaaaaaaaaaa

SEQ ID NO: 10612 - DNA, 2978 bp, Malus x domestica
ccacttctcaacaactctaagcatgaatgaaacaacaaaaacacaataattgtctctccagcttccggccatcaacaaaaccttcctagcaaatccaaaacttgaggaggccttgtcatgatggctgtgacgtcttcctgcaaagatggtgggatgaagatgcagatggacaatggcaagtacgtaaggtacacgccggagcaagtggaagctttagagcggttgtaccatgagtgcccgaagccgagctccatgcgccgccagcagctcatccgcgagtgccctatcctctccaacatcgagccgaagcagatcaaagtttggttccaaaaccgcagatgcagagagaagcagcgcaaggaggcgtcgagattgcagacggtgaacagaaagctgacggcgatgaacaagcttctgatggaggagaatgatcggttgcagaagcaggtttctcagctggtctatgagaacacctatttccgccagcacacacaaaatgcaactctagcgacgacagacacgagttgtgagtcggtggtgacgagcggtcaacaccatttgactgcacagcagcatccaccaccaagggatgccagccctgcaggacttctgtccattgcacaggaaactttagcagagtttttatcaaaggccactgggactgctgtggagtgggtccaattgcctgggatgaagcctggtccggattccattggaatcgttgcaatttctcacggttgcactggtgtggcagcacgtgcatgcggccttgtaggtctagaccctacaagagtcgctgaaatcctcaaagatcggccttcgtggttccgaaattgccgatctgtggatgtggccaatgtaatgtccactggcaatggtggaaccattgaactgctttacatgcagctctatgcacccacgactttggcaccagctcgagacttctggttgcttcgctacacatcggttctagaagacggtagtcttgtggtctgtgaaagatcacttaacaacacacagaatggtcctagcatgccaccagtgcagaattttgtgagagcggaaatgctgccgagcgggtatctaattagaccttgtgaaggtggtggctcgatccttcacattgttgatcatatggatttagagccttggagtgtacctgaagtgttgcgcccgctttatgagtcatcaacaattcttgctcagaagacaactatggcagcattacgcaacctgaggcagatatctcaagaagtttctcagcctaattctgctggttggggaagaaggcctgcagctctccgtgctcttagtcagagattgagcaagggtttcaatgaagcagttaacgggtttacagatgagggatggtctgttctagaaagtgatggtgtcgatgatgttacccttcttgtgaactcgtctccgggcaagatgatgagtgcaaatctttataccgatggagttccatctatgagcactgcagtcttatgtgccaaagcatccatgttactccaaaatgtgcctccagccatccttctcagattcttgcgagaacaccgatcagagtgggctgacagaagcattgatgcttattcagctgctgctgttaaagctggtccctgcaacatgctagggcctcgagttggaagtttcggggataatgttattcttcccctggctcacacaattgagcacgaagagttcatggaggtcattaagattgagaacttgggccactatcgagaggatatgattatgcctgcagctgacattttcctcttgcaactgtgtagtggagtggatgagaatgccgtcgggacctgctctgaactagtatttgctcccatcgatgcatcattttcggatgatgctccaattctaccttctggtttccggatcatccctcttgattctcggatggatactcccagtccaaaccgtacacttgatctggcctcagctcttgaagttggacccgcaggaagcagagcatctggtgataatgctggccactctggcaatacaaagtccgtaatgacaatagcattccagtttgcatttgaaattcacctacaagaaaatgtagcctccatggctcggcagtatgtgcgcagtatcatagcatcagtgcagagggtggcactggcgctctccccttctcgttttggttctcatgctggtttccggcctccacctggcactccccaagcacaaacacttgctggttggatttgtcagagctataggtgctatctaggtggagaactactaaaaaccgaaggaagcgagtccattctcaaatccctttggcatcacccggatgcaatcttatgctgctctttgaaggcaatgccaatttttacattcggaaaccaggcaggcctggacatgcttgagacgacgttagttgcacttcaagacattacgctggaaaagattttcgatgacaatggaaggaagacactatgctccgagttcccgcagataatgcagcagggttttatgtgtcatcaaggaggaatatgcatgtcaagcatgggaaggccgatctcgtacgagagagcggtagcatggaaggtgctgaatgaagaagaaaccgctcactgcatctgcttcatgttcatcaactggtcatttgtttaaaactttggaggacacaagaacgacatcataggatttagaaattaagacaaaaaaagatagactacttagaaattaaagcttcttcttgttctttgtacttttctttatgctttatttatgaatcataatgctcctgccctttgttttctttttttctttccttctttgaaaaggttacatattagctttgtaatcttggagttgagatgagaactggactttgaatgttttttaggatctcactaggaagagaaactcacttacaacggacgggtgtatattatttttagcgtgggttttaactttaatcatttggttctaaaaaaaaaaaa

SEQ ID NO: 10613 - DNA, 2736 bp, Vitis vinifera
atggcggttagttcgagctgtaaggatgcgaaaatggcgttggacaatgggaagtatgttaggtacacgcccgagcaggtcgaagcgctcgagaggttgtatcacgactgcccgaaacccagctcgcttcgccgccagcagcttatcagggaatgcccaattctctccaacatcgagcccaagcagattaaagtttggtttcagaaccgaagatgcagagaaaagcagcggaaggaggcgtcacgcctccaagctgtgaataggaagctaacagccatgaataagctgttaatggaggagaatgataggttgcagaagcaggtgtcacagctggtgtatgagaacagttttttccgccaacaaactcagaatgcgacccttgccaccacagacaccagttgtgaatcggtggtgacaagtggtcaacaccatttgactcctcagcatccaccaagggatgccagtcctgcaggacttttgtctattgcagaggagactttaacagagtttctttcaaaggccactggaactgctgtggagtgggtccaaatgcctgggatgaagcctggtccggattccattggaatcgttgctatttctcatggttgcactggagtggcagcacgcgcatgcggccttgtcagtctagagccaacaagagtcgcagaaatcctcaaagattggccttcatggtatcgtgagtgccgcaatgtggatgttcttaatgtgttgtctactggaaatggtggaaccatagaactgctttacatgcagctctatgcgcctacaactttggcaccagctcgtgacttctggttgctccgttatacatctgttttggaggatgggagtcttgtggtctgtgaaaggtcacttaacaacactcagaatggcccaagtatgccaccggtgcagtattttgtgagagctgaaaagctaccaagtgggtatttgataagaccctgtgaagggggtggatcaatcattcatatagttgatcatatggatttagagccatggagtgtacctgaagtgttgcgccctctctatgagtcatcaacattgcttgctcagaagaccacaatggcggctttacgccaactgaggcagatatctcaagaggtttcccagccaacaaatactggttggggaagaaggcctgcagctctgcgtgcacttggccagaggctaaccaagggttttaatgaagctgttaatgggtttacggatgaaggatggtctatgatggaaagtgatggtattgatgatgttacccttcttgtgaactcctctcctgcgaaaatgatgggagtaaatctttcttatgccagtggatttccatctatgagcaatgcagtgctgtgtgccaaagcatctatgcttttacagaatgtgcctcctgcaatacttcttagattcttgagggaacaccgatcagaatgggcagacagcagtattgatgcttattctgcggctgctgttaaagctggcccctgtaccttaccagtgtctcgagctggaggttatgggggtcaggtcattctcccactggctcacactattgagcatgaagagttcatggaggtcattaaacttgaaaatgttgatcactatcgggaagacctgatgatgtctggagatgtcttcctcttgcaactttgtagtggagtggacgataatgctgtgggcacctgttctgaactcatctttgctccaattgatgcctctttctctgatgatgcacctcttcttccttctggttttcgaattattccccttgattctggggtggatggctctagtccaaatcgtaccctcgaccttgcttcttctcttgaagtcgggccagctggaaacaaggcatctagtgacaactctgggcacactgggagcgcaaaatctgtgatgacaatatcatttcaatttgcgtttgaaatgcaccttcaagaaaatgtggcatccatggctcggcagtatgtccgcagtatcatatcatctgttcagagagtggcattagcactctctccttctcgatttggccctcaaatgggttttcgcccactaccaggcactcctgaggcgcacacacttgctcggtggatctgtcagagctataggtgctatttgggagtggagctgctcaaacccagtaatgaaggaaatgaatccattctcaaaactctctggcatcactctgatgctgtcatgtgctgctcgttaaaggtaattgcactgccagtttttacatttgcaaatcaggcagggcttgacatgcttgagacaaccttagtagcccttcaggatataactctggagaagacctttgatgacaatggaagaaagaccctctgctctgagttcccacagataatgcagcagggttttgtgtgtcttcaaggtggtgtttgcttgtctagcatggggaggccggtctcctacgagagagcagtggcttggaaggtgttgaccgaagaggacaatgctcattgcatatgcttcatgttcatcaactggtctttcgtttgaaaccttaacataggattcagaaaagaaagaaaatgaaaagaaactagattagtaaactcttttttgttcttttggtatggagagagaccttgaaatgcctgaatactgtgtctaagcgttaagcaaagctacaccaaagcatctgtagcaccctctttttgtcatccaactctgtattttgccttttcctttatctatgaatatttaggc

SEQ ID NO: 10614 - DNA, 3080 bp, Citrus trifoliata
ctctctctctctcttatatttttcttgtttatattctctctatcattcattgattcatttaatacaagaagtgaggaaccgagcacaactccaaggtctttttcttttaactgtgtcttgttccggtacgtgtaacgttaatggctcgtataacaccaccaccaccatcttcttattagctttcctcgtttgaagcagcagcagtcacacagctgtgatcgatcggatcatcttgaaggttcaagaaattacgagatcatgatggcggtgagctcggggggcagcagggacagcagggacagcggcggacagaagatgatgatggacaacgggaagtacgttcggtacacgcccgaacaagttgaagcgcttgaaagattgtaccacgagtgccccaaaccaagctctatgcgccgccagcagctcatccgagagtgtcctattctctctaacattgaacctaagcagatcaaagtctggttccaagacagaaggtgtcgggagaagcaaaggaaagaagcgtctcgccttcaagctgtgaacagaaagctgacggctatgaacaagctgttgatggaggaaaatgatcggctgcaaaagcaagtgtcacagctggtgtatgagaacacttttttccgccagcagacacaaaatgccgcgacgctggccaccacagacactagttgtgaatcagtggcgacgagtggtcagcaccatttgactcctcagcagcagcatcagcatccaccaagggatgctagccctgcaggacttttgtcgattgcagaggagactttaacagagtttctttcaaaggccactggaactgctgtggagtgggtccaaatgcccgggatgaagcctggtccggattccattggaatcgttgctatttctcatggttgcactggtgtggcagcacgcgcttgtggccttgtgggtctagatcctacaagagtcgctgaaatcctcaaagataggccatcatggtatcgtgattgccggtctgtggaggttgtaaatgtgctgcccactggaagtagtggaaccattgagttgctatacatgcagctctacgcaccaacaaccttggctccagctcgtgacttctggttgttgcgttacacatctgttttggaggatggtagtcttgtggtctgtgaaagatcacttaacaacacacagaatggtccaagtatgcctcaggcaccacattttgtgcgagcagaaatgctgcctagtgggtatctgattagaccttgtgaagggggcggatccattattcatatagtggatcatatggatttagagccttggagtgtccctgaagtgttgcgcccactttatgagtcatcaacattgattgctcagaagacaacaatggcggctttacgccatctaaggcagatttctcaagaagtttcacagccaagtgtcactggttgggggagaaggcctgcagccctacgtgctcttagtcagagattgagcaggggctttaatgaagctctgaacgggttcaccgatgagggatggtctatgttggaaagtgatggcattgatgatgttaccgttcatgttaactcatctcctagcaagatgatgggcgtacaactttcttatgtgaacggatttccatccatgagcaatgcagtgctatgtgccaaagcatccatgttattacaggatgtgcctccagcaatacttctcagattcttgcgagaacaccgatcagagtgggcagacagcagtattgatgcttactcagctgctgctgttaaagctggtccctgcagcttaccggtgcctcgagctggaaattttgggggtcaggttattcttccactggctcacacaatcgaacatgaagagtttcttgaggtcattaagcttgaaaatatggcccactatcgggaggacatgataatgccgagtgacatcttcctcctgcaactttgcagtggagtggatgagaatgctgtaggcaactgtgctgaactggtctttgctcctatcgatgcctcattttctgatgatgcacctattattccttctggtttccggatcattcctctggactccgggaaggatacccctagtccaaaccgcactctcgatcttgcctcagctcttgaagtaggaccaactggaaataaagcatctggtgactcttccactcaatgtggcagcaaaaaatctgtgattacaatagcatttcaatttgcatttgagatgcaccttcaagaaaatgtagcatcaatggctaggcagtatgtccgtggtattatagcctctgtccagagagttgcattggcgctctccccttctcgatttggctctaatgctggacttcgacctcctcctggttctcctgaagcacacacacttgctcgttggatctgccaaagctatcggtgctatctaggagcggaactacttaaatgtgaaggaaatgaatccattctcaaaacactttggcatcactctgatgcggttttgtgctgctcgctaaaggctttgccagttttcacctttgcaaatcaggcaggacttgacatgctggagacaaccttggttgcgcttcaggatataactctggaaaaaatttttgatgagagtggaagaaagaccttgtgctctgagttcccacaaataatgcaacagggctttatgtgtcttcaaagtggtatttgtttgtcaagcatgggaaggccaatctcttatgaaagagcagtggcttggaaagtgttgaatgaagaagagaatgctcactgcatttgcttcatgttcatcaactggtcattcgtctgaaagacagaagagacttcggtcaaaacctagaatctagatgcaggtttagagtagaacaatcttctttatagtcttttttctgtggaaaacatcattgtattggcttaaatagtttcatgaaaatgcagcagctaccaccaaatgcatatggcaacagtgaccacattttttttgttttgctttatcctttattgtcaatccctatgcttctgcctttgcctctactttttataattttattccctctactctaaaaaaaaaaaaaaaaa

SEQ ID NO: 10615 - DNA, 692 bp, Antirrhinum majus; identical to SEQ ID NO: 10597
  misc_feature (351)..(351): n is a, c, g, or t

SEQ ID NO: 10616 - DNA, 3046 bp, Glycine max; identical to SEQ ID NO: 10584

SEQ ID NO: 10617 - DNA, 3227 bp, Glycine max; identical to SEQ ID NO: 10595

SEQ ID NO: 10618 - DNA, 2724 bp, Medicago truncatula
atggcactttctatgcataaagaaatggatgccggtaaatatgtgaggtacactcctgaacaagttgaagctttggagagagtttattcagaatgtcctaagcctagttctttgagaagacaacaactcattagagaatgtcctatcctttctaacattgaacctaaacagatcaaagtttggtttcaaaaccgaagttttctgcatttattggtgattgtggttactaagcaagtttctcatctggtttatgagaatggatacatgaagcaacagattcatactgtgagtgcttctgctgcaactaccacagacaatagctgtgattctgtggtaatgagtggtcaaaaccaacagcaaaacccaactcagcgtcctcaaagggatgcaaacaacccagctggtcttctcgccgtggctgaggagaccctggcagagttcctatctaaggctactggaactgctgtcgactgggtgcagatgattgggatgaagcctggtccggaatctattggtatcgttgctgtttcccgcaactctagtgggatagcggcgcgagcctgtggccttgtgagtctagagcccactaaggttgctgagattcttaaagatagactgtcatggtatcgtgactgccgatgcgttgatgtattgagtattgttcccactggtggtggtggtacaatagagcttatgtacatgcaggtcctattttattctacaaaagaactcacaatgccgtttctatttctgttgacttcacgagacttttggacactgagatatactacaagtttggaagatggaagtcttgtgatatgtgagagatcgttgaatgcttctactggtggccctacagggccttcgccgtctaattttgtgagagctgaaatgcttccaagtggttttcttattagaccatgcgaggggggtggatccattattcatattgttgatcacgtggatttagatgtttggagtgtccctgaagttctgaggcccctctatgaatcatcaaaaatcttagctcagaaattgactattgctgcattgcaacacataaaacagatagcacaagaatccagtggagaaattcagtatggtggcgggcgccaaccagctgttttgagaacttttagtcagagactttgcagggggttcaatgatgctgtgaatggatttgtcgatgatggttggtcgttgctgggaaatgatggtgttgaagatgtaaccattgctgtgaactcgtctccaaacaagtttttggggtccaattattcatccatgtttccaacatttggaggtggtgtcttgtgtgccaaggcatcaatgctgctgcagaatgttcctcctgctttgcttgttcgatttttgagggagcatcgatcagaatgggctgattatggcgttgatgcgtactctgctacttgtctcaagtctagcccctatgcggttccatgtccaagacctggtggcttccccagcagccaggtcattttacctcttgctcctacgatcgagcatgaagagtttctggaggtagttcgtatagaggggcatgcattctccccagaagatgttgcactggcacgtgatatgtatcttttgcagctttgcagtggaattgatgaaaattcagttggcgcatgtgctcaacttgtgtttgcgcctatagatgaatcctttgcagatgatgccctcttactgccttctggttttcgagttattcccttggatcctaaatcagatggtccaaccacgtcaagaactttggatttacttgaaggatctaggaatgctcgtccatctggtgaaggtgctggttcaaatggatacaaccttaggtctgtccttacaattgcattccaatttacctttgagaatcatttgcgcgacaacgtggcttctatggctcgccagtatgtgcgtagcgttgtggcatcagttcaaagagttgccatggcaattgcgccctctcggccaggtactcagctagggccaaagtctcttcctggttcgccagaagctcatgctttagcacgatggatatctagaagctacaggatgcacactggtgccgagctttttagagtcgagtccgcagcgagtgatgcaatactgaaacaactttggcaccattctgatgcaattatgtgctgttctgtgaaaacaaatgcatctccaatattcaccttttcaaaccaggctggactagacatgcttgaaactactctagttgctcttcaagatattatgcttgataaagttcttgatgaagctggcaggaagattctttgctctgagttctctaagattatgcaacagggttatgcatctctgccaggagggatttgtgtatcaagcatgaataggccagtgtcttatgagcaagccattgcatggaaagttcttaatgatgatgatgccaatcactgcttagctttcatgttcatcaactggtcctttgtctgatggagaaaccataatcaagaaacctaactttatatctatatctatatctatattatattatattatattatatgaagatatatattaagttattttcagttcttcaactacctgatactatttaaagacagttgtactaattttcagctttgttttatgtgccttttgaactattctaatgctcctctatgactatatatgaatatcctttaaatatttaaaatgcaagttttattttgagtatatatattt

SEQ ID NO: 10619 - DNA, 3048 bp, Glycine max; identical to SEQ ID NO: 10609

SEQ ID NO: 10620 - DNA, 2682 bp, Medicago truncatula; identical to SEQ ID NO: 10608

SEQ ID NO: 10621 - DNA, 2727 bp, Glycine max; identical to SEQ ID NO: 10585

SEQ ID NO: 10622 - DNA, 2769 bp, Glycine max; identical to SEQ ID NO: 10594

SEQ ID NO: 10623 - DNA, 2963 bp, Glycine max; identical to SEQ ID NO: 10589

SEQ ID NO: 10624 - DNA, 3797 bp, Glycine max; identical to SEQ ID NO: 10600

SEQ ID NO: 10625 - DNA, 2694 bp, Vitis vinifera; identical to SEQ ID NO: 10598

SEQ ID NO: 10626 - DNA, 2708 bp, Zinnia violacea
tgcaggtcaacaccagcaacacaaagagatgaatgataataatagcatcaccaaacaccagttggataatggaaagtatgtaaggtatacaactgagcaggttgaagctttagaaagggtttatgcagaatgccctaaacctagttctttgagaagacaacagctgatccgagaatgtcctatcttgtccaacatagaacctaaacaaatcaaagtttggtttcaaaatcgcagatgtcgagagaagcaacggaaagagtcttctagacttcaaactgttaacaagaagctatctgcaatgaacaagttattaatggaggaaaatgatcgcctgcaaaaacaagtgtctcagcttgtatgcgaaaatggttatatgcgccaacagatgcacactggttctgcagctacggatgcgagttgtgagtctgtggttaacactccacagcattctctgagagatgctactaacccggctggacttctctcgattgccgaagagacgttggcagagttcctttcaaaggctacaggaactgctgttgattgggtccagatgcctgggatgaagcctggtccggattcggttgggatctttgccatttcacagagttgcagtggagtggcagctagagcctgcggtcttgtaagtttagagcccacaaagattgtggagatccttaaagatcgtccttcttggtttcgtgactgccggagccttgaagttttcacaatgtttcccgctggaaatggtgggacaattgaacttgtatatatgcagacctttgctccaaccacattggctcctgcacgtgatttctggactttaagatacactacgagtttagacaacggaagtcttgtggtgtgtgaaagatccctatcaggttctggtgcaggcccgaatccagctgccgtagctcagtttgtaagaggggaaatgttaccaagtggctaccttatccgtccttgtgaaggcggtggttccgttatacacatagttgatcacctgaatcttgaggcatggagtgtgcctgaagttctccgtccactttatgaatcttccaaagttgtggcgcaaaagatgaccattgcggcgctgcgctatattaggcaaatagctcaagagtcgagtggcgaggtagtttatggattgggaagacaaccggctgttttgagaaccttaagtcaaagattaagccgaggcttcaatgatgccataaatggatttagtgatgacgggtggtcgttaatgaactgtgatggtgttgaagatgtaattattgcagtgaattcaaccaaaaatcttaacaactctatgaatccttctaattccatatcgtatcttggagggattctctgtgcaaaggcctccatgctatttcaagatgtgccgcctgcggtgttggttcggtttttgagggagcataggtcagagtgggctgacttcaatgtagatgcttattctgctgcatcggttaaagcgaattcgtgtaatacgtatcccggaatgagacccacccggttcactggcagccaaattattatgcctcttggccacacaattgaacacgaagagatgcttgaagttgtaagacttgaaggtcatgcacttgggcaagaggatccttttacatctcgtgacattcatctcttgcagttgtgcaatgggattgatgaaaatgctgtgggagcttgttctgagctcgtttttgccccaatcgatgaaatgtttcccgacgatgcaccacttgtaccctcaggatttcgtataatccccttagaccccaaatcaggtggtggaaaaaatgcattggtaaccacacacagaacacttgacttaacttctagtctagatgtgaccccagcgaataaccatggttcaaccgatttgtcaacatgccaaacttcaaggtcggttctaaccattgcctttcagttcccttttgagaacaatctagccgaaagtgtagccacaatggctcgacagtatgttcgaagtgtgatcaattcagttcagagagttgcaatggccatatcaccttcgggtttgagcccatgtgtgggtcccaaaccgtctcccacatcgcccgaagcagtaactctagctcaatggatctgccagagctacacgtaccatttaggagcagatttgctaagctcgggttcacttgttggtgactctctattgaaagatctttggcaacatcaagatgccattttgtgctgttctctaaagtctcttccggtttttacgtttgcaaatcaagccgggcttgatatgttggagacgactcttgtttcactacaagacatcactctagacaaaatatttgatgattctggacgaaaggcgttggttccagaatttgccaagataatgcaacagggatatgcgcatttacctggtgggatttgtatgtcaacaatggggcgtcacattacgtatgaacaagctgttgcatggaaggttctagcagctgatgaaagtactgtccattgtcttgctttctcttttgttaactggtcatttgtgtagttgtgctatggttttttgaacactgcgcccatttcgtaaattgtagcataaccaaaacgcccggataagaacttggttaggattcggaggatttgcttttgtatgaactataaagcattggctagttgttaccattgctgccattttttgtttattagaactttgttttgtt

SEQ ID NO: 10627 - DNA, 3794 bp, Glycine max; identical to SEQ ID NO: 10602

SEQ ID NO: 10628 - DNA, 2376 bp, Glycine max
atccaatcatgggaatcaatatttgtctctctctttgcttcttctacatcactacccttcaccgcacaatttccacgttggcccagtctgagaattatatcatccacatggacatatcagccatgcccaaagcatactcctcccatcacacttggtatctctccactctctcttcagcattggagaattccaaagccaccaccgacaaccttaattctaagctgatttacatctacaccaatgtcatcaatggtttcagtgcaaacctgtcacctaaagagcttgaagctctcaaaacctcccctggttacgtttcttccatgcgagatttacgcgccaagcgtgacacaacacactcaccacagttccttggcctcaacaagaatgtgggggcgtggccagcgtctcaatttggcaaagatatcattgttggtttggtggacactggaatttctcctgaaagcaaaagctataacgatgagggattgactaaaattccttctcgatggaaaggccaatgtgaaagtagcatcaaatgcaacaacaaactcattggagcgaggttcttcatcaaagggtttctggcaaagcaccccaacaccaccaataatgtttcttcaacgcgtgacactgatggtcacgggactcacacatcaagcactgcagctgggagtgttgttgagggtgcatcatactatgggtatgcttctggatcagccacaggaatagcttcacgtgcgagagtggccatgtacaaggccttgtgggatgaaggagattacgcatctgatataatagctgcaattgatagtgctatatcagacggggttgatgttctttccttgtcatttggttttgatgatgtacccttgtacgaagaccctgttgctatagccacgttttcagcaatggagaaaggaatttttgtgtccacgtcagcaggaaacgaagggcctttccttggaagacttcacaatggaataccatgggtcataaccgtggctgctggcaccttggaccgtgaatttcatggtactcttacacttggcaatggtgtccaaataactggcatgtctctctatcatggaaacttctcttccagcaatgttccaattgttttcatgggcttgtgcgacaacgtgaaggaactagccaaggtgaaaagcaagattgtggtgtgtgaagacaagaatggaactatcattgatgttcaggcagctaagctgattgatgcaaatgttgtcgcggctgtgttaatttcaaacagctcttacagttcgtttttcttagacaatagctttgcgtctattattgtttccccaataaacggggaaactgtcaaagcttacattaagagtactaactatggcacaaaaggaaccttgtcttttaagaagacagttttgggttctagaccagctccgagtgtggatgattacagttctagagggccttcaagtagtgttccatttgtgttgaaaccggacatcactgctcctggtacatcaatcttagctgcatggcctcaaaatgttccggtggaagtgtttgggtcccaaaatattttcagcaacttcaatttgttaagtggcacatccatggcatgcccccatgttgctggtgtggcagcactgttaagaggagcacaccctgattggagcgttgcagccattaggtcagccattatgacaacatcggacatgtttgacaacaccatgggactcatcaaagacgttggtgatgattacaaaccagccactcctttagccatgggagctggtcatgtcaacccaaatagagcccttgaccctggacttgtttacgatgtgggagttcaagattatgttaatcttctctgtgcacttggctacacccaaaagaacatcaccgttatcacaggaacctcttccaatgattgttcgaaaccctctttggacctcaactacccttcttttattgctttcttcaagagcaacagttcaagtacaacacaagaatttgagagaaccgtgaccaatgttggggagggacagacaatctatgttgccagcgttacacccgtcaaagggtaccacgtgagcgttatccccaagaaattggtgttcaaggagaagaatgagaagcagagttacaagttgagaattgaaggtccaataaagaagaaagagaagaatgtcgcttttgggtatctcacttggacggacttgaagcatgtgattcggagccccattgtggtctctaccctcacattcgatttctagaacaatttattgtggctgagatatatatgctcaaatatatgaatcaagtgaaaaatgtatattaactagagaaatcttctaatgaaaataataaccatttctcacttgaccaaca

SEQ ID NO: 10629 - DNA, 2259 bp, Glycine max
atggctacccatatttgtctctctctttgcttcttctacatcacaacctatcaccttgcaatttccacgttggctcagtctgacaactatatcatccacatggacatatcagccatgcccaaagcattctcctcccaacacacttggtatctctccactctctcttcagcattggacaattccaaagccaccagcgataatcttaactctgttattaactctaagctgatttacacctacaccaatgtcatcaacggtttcagtgcaaacctgtcacctaaagagcttgaagctctcaaaacctccccgggttacgtttctagcatgcgagatttacgtgccaagcgtgacacaacacactcaccacacttccttggcctcaaccccaatgtaggggcgtggccagtgtctcaatttggcaaagatgtcattgttggtttcgtggacactggaatttcgcctgaaagtgaaagcttcaacgatgagggattgactaaaattccttctcgatggaaaggccaatgtgaaagcactatcaaatgcaacaacaaactcattggagcaaagttcttcaacaaagggttgctggcaaagcaccccaacaccaccaataatgtttcttcaacgcgtgacactgaaggtcacgggactcacacatcaagcactgcagctgggagtgttgttgaaggtgcatcatactttggctatgcttctggatctgccacaggagttgcttcacgtgctagagtggccatgtacaaggcattgtgggaacaaggagattatgcatctgatataatagctgcaattgatagtgcaatatcagatggggttgatgttctttccttgtcatttggctttgatgatgtacctttgtatgaggaccctgttgctatagccacgtttgcagcaatggagagaggcatttttgtgtccacgtctgcaggaaacgaagggccattccttgcagtgcttcataatggaataccatgggtcataactgtggctgctggcactttggaccgtgaatttcagggtactctcacgcttggaaatggagtccaagtaactggcatgtctctctatcatggaaacttctcttccagcaatgttcctattgttttcatgggcttgtgcaacaaaatgaaggaactggccaaggcgaaaaacaagattgtggtgtgtgaagacaagaatggaactatcattgatgctcaagtggctaagctgtatgatgttgtcgcggctgtgttcatttcaaacagctccgagagttcttttttctttgaaaatagttttgcatctattattgtttccccaataaatggggaaactgtcaaaggttatattaagagtactaactctggtgctaaaggaaccatgtcttttaagaggacagttttgggcactagaccagctccgagtgtggatgattacagttctagagggccttcaagtagttgtccatttgtgttgaaaccagacatcactgctcctggtacatcaatcttagctgcatggccacaaaatgttccagtggaagtgtttgggtcccataatattttcagcaacttcaatttgttaagtggcacatcaatggcatgccctcatgttgctggtgttgcagcattgttgagaggagcacaccctgaatggagtgttgcagccattaggtcagcaattatgacaacatcggacatgtttgacaacaccatgggactcatcaaagacattggtgatggttacaaacaagcctctcctttagccttgggagctggtcatgtcaaccctaatagaggcctagaccctggactggtgtatgatgtgagagttcaagattatgttaatctcctctgcgcacttggctacacccaaaagaacatcaccatcatcacgggaacctcttcaaatgattgttccaaaccctctttggacctcaactacccttcttttattgctttcatcaatagcaacggttcaagtgcggcacaagaatttcaaagaacggtgaccaatgttggggaggggaaaacaatctatgatgccagcgttacacccgtcaaagggtaccacttgagcgttattcccaaaaagttggtgttcaaggagaagaacgagaagctgagttacaagttgacaattgaaggtccaacaaagaagaaagtggagaatgtcgcttttggatatctcacttggacggacgtgaaacatgtggttaggagccccattgtggtcaccaccctcaaattggatttctag

SEQ ID NO: 10630 - DNA, 2262 bp, Glycine max
atggctacccatatttgtctctctctttgcttcttatacatcacaacactcaacctcgtttccacgttggctcagtctgacaattatatcatccatatggacatatcagccatgcccaaaacattctccacccaacacagttggtatctttccactctctcctcagcattggacaattccaaagccaccaataatcttaactctgttagttcttctaagttgatttacacttacaccaatgccatcaacggtttcagtgcaaacttgtcacctaaggagcttgaatccctcaaaacctccccgggttacgtttcttacatgcgggatttaccagccaagcgtgacacaacacactcaccacagttccttggcctcaaccctaatgaaggggcgtggccagtgtctgaatttggcaaagatgtcattgttggtttggtggacactggaatttggcctgaaagtaaaagcttcaacgataagggaatgactgaaattccttcacggtggaaaggccaatgtgaaagtacaatcaaatgcaacaagaaactcattggagctcagttctttaacaaaggaatgctggcaaatagccccaacattaccatagctgcgaactcaacacgagacactgagggtcacgggactcacacatcaagcactgcagctgggagtgttgttgagggtgcatcgtactttggttatgcttctggatcagccacaggaatagcttcaggggcgagagtagccatgtacaaggcattgggggaagaaggagatttggcgtcagatataatagctgcaattgatagtgcaatattagatggggttgatgttctttccttgtcatttggctttgattacgtacccttgtacgaggatcctgttgcaatagccacgtttgcagccatggagaaaggaatttttgtgtccacatcagcaggaaacgaagggccttaccttggaagacttcacaatggaataccatgggtcataaccgtggctgctggcaccttggaccgtgaatttcatggcactcttacgcttggaaatggagttcaagtaacgggcatgtctctctatcatggaaacttctcctccagcaatgttcctattgttttcatgggcttgtgcgacaatgtgaaggaactggccaaggtgaggagaaacattgtggtgtgtgaagacaaggatggaactttcattgaagctcaagtgtctaatgtgtttaatgcaaatgttgtggcggcagtgttcatatcaaacagttctgacagtatatttttctacgataatagctttgcatctatttttgttaccccaataaacggggaaattgtaaaagcttacatcaagatcactaactctggtgcaaatggaaccttgtcttttaagacaacagctttaggtactagaccagcaccgagtgtggatagttacagttcaagagggccttcaagtagtgctccatttgtgttgaaaccggacatcactgctcctggtacatcaatcttagctgcatggcctccaaatgttccggtggatgtgtttattgcgcccaaaaatgttttcactgacttcaatttgttaagtggcacatccatggcatgcccccatgttgctggtgtggcagcattgttaagaggagcacaccctgaatggagcgttgcagcaattaggtcagcaatcatgacaacatcggacatgtttgacaacaccatgggactcatcaaagacattggtgatgattacaaaccagccactcctttagccatgggagctggtcatgtcaaccctaatagagcccttgaccctggacttgtttacgatgtgggagttcaagattatgttaatctcctctgtgcacttggctacacccaaaagaacatcactgtcatcactggaaactcttccaatgattgttccaaaccctctttggacctcaactacccttcttttattgctttcttcaatagcaacagttcgagtgcatcacaagaatttcaaagaacggtgaccaatgttggggagggacaaacaatctatgttgctagcgttacacccgtcaaagggtactacgtgagcgttatccccaacaagttggtgttcaaggagaagaacgagaagctgagttacaagttgagaattgagggtccaacaaacaagaaagtggagaatgtcgcttttgggtatttcacttggacggacgtgaaacatgtggttaggagccccattgtggtcaccaccctcaaagtgaatttctag

SEQ ID NO: 10631 - DNA, 785 bp, Glycine max
gggacttgagttgagtgtgttatttccctccctccctcaaggaaaagcagcaggcaaatggcgatgagaaatatgatagtgataacagttacgacgacaatggtgacggtgatgataagcatagtgggaggatcagcgagttggtgcgtggcgaagattggcgcgagcgaggaagcactgcagacggcattggactctgcatgtgaagccggtggtggagctgattgtgcacccattcagcctgatggcctctgctacgttcccaacactcttcaagctcatgcttcttatgctttcaacagcttctaccagcgcaacactagagctccccatgcatgcctcttccacggtgcttccaccatcgcacaaaccgatcccagctatggatcttgcgtgtacccatcctccgcaaccccaagtactgctggagttacaaatacaaatacaacagtgacaacacctgcagcgatgccgaatgtggcagcacctaccacaacaactccaatccatggcggggatggtgtaggaatgaaccctctaatccctgaaaattctacatcagcacccaattcgaacacaatattaaccactacctcatttttagttttccttctcattatgtcccttatcccttaattggcttgcctgtgcctcagtgcttgtgtctgtttacggttttgtggaattggaatataactatctggctcgatgcaactacatattacgtaagtgggaggtgcagagctacaattgttttttttatgacaatatatcattaacgtttt

SEQ ID NO: 10632 - DNA, 1008 bp, Glycine max
atggcttgcactgataaaacggccaccgtcaccgacgaagctagcggcggcggagccactacaatcttcgccgtgcaccccgacataatccaaacccacatcctcacgtgcctggacggtcgcgcactcgcctccgtcgccagcacgtgctctcaactccacgcgctctcagaccacgagcctctctgggagaacatttgccactccacgtggccctccacgaactcgccacgcgtccgccacgtcatatccacgttcccatgcgcgtctcgctcctttttctccgactcgtttccttccttcgccgcgcgcgaaggttcgaacatcgatcgcgcgccggagctgatttccgcggtggacatcttccaccggcggcgggtggtgctgtcgagagtggtggagacggagacggagtccggctggttccggtgctcgccgtttagaatcgatgttcttgatcagaaggaggcggtggcgacggcgatggagtatccactgagcgatggagcatgtgagattctcggtgaggatttgaggttgagttggatagtggtgaatccgaagggaaagcgtgcggtgaatgtgtcaagtggaacggcggtgtcggtggagcggcactggctgagcggggaggtgaaggtgcggttcgcgacggtggtggacggcggtgagagggggacgccggcggaggtggcgctgtgcagcgtgactgtgacattcgggaatgagatgcaggtgagggaagcgtgtctacagatggaggacatggatggaatgttcctgaatggtagggagagtttggggattttgaagcgggcgttggagggtaaaaggggaacattactgaaggacggaaaggaagaaggaaggagtagatacttggaattcatgaacagaaagatggagagaaaagaaaagaaacaaagagatgagaggaggttggatatgctctgcttggctctcgcggttttgtcctttgcggctttttcaacactctttctcttctga

SEQ ID NO: 10633 - DNA, 1008 bp, Glycine max
atggcttgcatcgataacacggccaccacctctactgacgaagcaggcggagccaccaccatcaccgccgtgcatcccgacataattcaaacccacatcctcacgtgcctggacggcccgtcgctcgcctccgtcgccagcacgtgctcccaactccacgctctctcagcgcgcgagcctctctgggagaacatttgccactccacgtggccctccacgagctcgccacgcgtccgccacgtcatgtccacgttcccacgcgcgtctctgtcctttttctccgactcgttcccttcgttcgccgcggcgcgcgaaggttcttcttcgcgcgcaccggagctgatttccgctgtggacatcttccaccggcggcgggcggtgctgtcgagagtggtggagacggagacggagtccgactggttccggtgctcgccgtttcgaatcgatgttcttgatcagaaggaggcagtggcgacggcgatggagtatccacggagcgaggaagcgtgtgagattctgggcgaggatttgaggttgagttggatagtggtggatccgaatggaaagcgtgcggtgaatgtgtcgagtgggagagtggtgtcggtggagcggcactggctgagcggggaggtgaaggcgcggttcgcgacggtggtgggcggaggggagagggggacggcggtggaggtggcgctgtgcagcgtgactgtgactttcgggggtgagatgcaggtgagggaagcgtgtctgcagatggaggacatggatggaatgttcctgaatggtagggacagtttggggattttgcagcgggcattggagggtataaggggaacattactgaaggacggaaaggaggaagaagggaggaatagatacttggaattcataaagagaaagatggagagaaaagataaaaaagaaagagatgagaggaggttggatatgctctgcgtgcctctcgcgcttttgtcctttgcggctttttctacactctttctcttctga

SEQ ID NO: 10634 - DNA, 619 bp, Glycine max
ctccctctctaaaattcgaaaaaataacctaaaacaaatagaaatggaaagcaatacacctgtaatagcaaagaaagaattgagcataatacatgtggccttgttcatgttgaggaaaggcatctctaaggggaagctaatgatgcacctcaacaacatgatgctcaaacgccccggcaaagccatcgccaacctcatgttccaccacaaccacggtgtctccggcaacagcctccatttctccgccgccagggagtacgagttcagctgcagcaacactccaaacaacttcttcgcggccattgccagcagcaacaagcgccaccgccacattcccttcttcacgtgcgctcacgcgccgcccaccctcgacgacgacgtggctacggttaatgcagttaagggcgtgttggagatgctgaacaatgagaccgtcgtggaggcatcaccggccgcgcttcccgggttcggacgtagccctatggtgaggcagttgatcagggtgacggactctccgttcccacttgttgagtcccaggatgacaaggacaaccaagtggacaaggctgcggaagagttcataaagaggttctacaaagagttgaggaagcagacttga

SEQ ID NO: 10635 - DNA, 594 bp, Glycine max
atggaaagcaatacaccagtaatagcaaagaaagtgttgagcataatacgtgtggccttcttcatgctgaggaaaggcatatcaaagggtaagctaatgatgcacctcaacaacatgatgctcaaacgccccggcaaagccatcgccaacctcatgttccaccaccaccacaaccacggtgtctccggcaacaacctccaattctccaccgccagggagtacgagttcagctgcagcaacacacccaacaacttcttcgcggcagcccttgccagcaacaacaaacggcaccgccacaaccccttcttcacgtgcgctcacgcgccgccaacccttgacgacgacgcggtgaccgttaatgccgttaagggcgtgttggagatgctgaacaatgaggccttcgaggaggcgtcgccggctgtggccaccgcgctttccgggttcggacgtagccctatggtgaggaagttgatcagggtgacggactctccgttcccacttggtgagtctgaggatgacaaggacaaccaagtggacaaggctgcggaagagttcataaagagattctacaaagagttgaggaagcagacttga

SEQ ID NO: 10636 - DNA, 836 bp, Glycine max
atggaaagtaacgcaccagtactagcagagaaagtgtggagcatggtacgtgtgctgttgttcatgcttcgaaaaggcatatcaaaggggaagctaatgatggatctcaacatgatgctcaaacgccgcggcaagctcgccggcaaagccattgccaatctaatgtcccacaaccacaaccaccgtgggtcccacaagtcgcaacttcggttctctgctccaagggagtacgagttcagctgcagcaacactccccacaacttgttccccacagcagggaagcgccaccgccacttcttcgcctgcgtccacgcgcctcccacgcaggacgacgacgtcgtgacggtgaacgcaatgaaggcagtgttggagatgctcaacaacaacgacgtcgttaaggttgaggcgtcccctgcgctgccagggtttggacggagccctattgtgaggcagcttagggttacggactccccattccctctgcgagactccgaccatgacaacgaccaccaggtcgataaggcggcggaagagttcataaagaggttttacaaggacttgaagaagcaggattaattatttatttaattaattaagcctatgcctatctaccttgtttaattgtccatctctacgttccatattctccctttgttaataacaagtgtgattatattgttgatttaccaacgttagttcaccatcatttttggatatttccatgtttttgttgttgtcccacttctgatttaagatgggattatgcatgtgttgtgtttaattatttcttacatacaataaaagaggaaagtgcagagtatatatatgtttagatg

SEQ ID NO: 10637 - DNA, 931 bp, Glycine max
cacctttaaacctctctctctctcaaattattcgaaatccaaaaaacaaaaacaagtttcttattataaaaaatgaaacaaatagaaatggaaagtaacgcatcagcactagcaaagaaagtttggagcatggtacgtgtggtgttgttcatgcttcgaaaaggcataacaaaggggaagctcatgatggacctcaacatgatgctgaaacgccgcggcaagctcgccggcaaagccattgccaacttaatgtcgtcccaccaccaccacaaccgcggtgggtcccacaactctcaccaccttaagttctctgccccaagggagtacgagttcagctgcagcaacacgccccacaacttcttcttccccacaggagggaagcaccaccgccaccacttcttcgcctgtgtccacgcgcctcccacgcaggacgacgacgttgtgacggtgaacgcaatgaaggcagtgatggagatgctcaacaacaacaacaacgacgccgttaaggttgaagcgtcccctgcgctgccagggtttggacggagccctatggtgaggcagcttagggttacggactcgccgttccctctgcgagacgccgatcaagacaacgaccacctggtcgataaggccgccgaagattttataaagaggttttacaaggagttgaggaagcaggattaattttttctctctttaattcaccctatctaccttgttttcttttttattttctgtaccttcattctcttttcttaatcataaatgtgatcgttacttcaccatcatttttggatattttcatgttgccgtacgtacttgtcccccacttctgatttaagattaagatggattatgcgtgtttttagtttaatttaattatatattgcttacatacaataaaagaggaactctttaatttcgagctaaa

SEQ ID NO: 10638 - DNA, 588 bp, Medicago truncatula
atggaaaacaatctaccagtgatatcaaagaaagtgtggagtatggtacgtgtggccttcttcatgttgagaaaaggtatgtcaaagggcaaactaatgatgggcctaaacatgatgctcaaacgccgcagcaagctcgccggaaaagccattgccaatctaatgttccaccatcaccacaaccacggtggctccacctcaagccgccgctcacaccaccaattcaccgcctcaagggagtacgaattcagctgtagcaacactcccaaccacttcttcccaattgggaagcgtcaccgtagccacaacaacttctccacttccgctcaagcaccacctacacaagatgatgatgtggcaacaatgagcgcaatgaaggcagtgctggagatgcttagcaatgatcagtcgattgtagaagcatctccagcactgccagggttcgggcgtagcccaatggtgaggcaattgagggtgactgactcaccattccctttaagagaagatgacgagaaggacgatcaagttgataaggctgctgaagatttcataaacaggttttacagccagttgaggaatcaagcttga

SEQ ID NO: 10639 - DNA, 821 bp, Medicago truncatula
gtcctcaaatcaaattcatctcctaatatctctccttctctctctctctctcaatctctctctttcaaaatcactctcctcaaattattccaaacaaaaaaaaaaaaacaatttctatataaaataaaaaatggaaaacaatctaccagtgatatcaaagagagtgtggagtatggtacgtgtagccttcttcatgttgagaaaaggcatttcaaagggaaaactgatgatgggcctaaacatgatgctcaaacgccgcagcaagcttgccggaaaagccattgccaatctaatgttccaccatcacagccaccacagctcctcctcaagccgctctcacgactcacgccaccaatttaccgcatcaagggagtatgaattcagctgcagtaacactcctcatcactttttcccaatagggaaacgtcaccgcagcaacaaccacaatcacaacaatttcttcacttgcgctcatacgccacctacgcaggacgatgatgtggcgactatgagcgcaatgaaggccgtgctggagatgcttaacaatgatcaagcaatcgtagaagcatctccagcactacctggattcgggcgtagcccaatggtgaggcaattgagggtgactgactcaccattccctctaagagaagatgatgagaaagacaaccaagttgataaggctgctgaagatttcataaacaggttttacagccagttgaggaagcaagattgattgattaaataattcaaccttccttgtttagttaataattaattaatatgtgtaatcgtttgttgtgaatgttaagtaaaccattttt

SEQ ID NO: 10640 - DNA, 2678 bp, Glycine max
atgtgtgcacccttcaacattctagttctcttgttatcacttttactcacttcttcttcttgttcttcttctttttcacagcctcgccgtgttctccatcaaccactttttccgagaatatctgttccgccagcacaagctccaagctatttatctcctgagcctcaaccgaagcaacaacatctacaacccaagcttccattttcttctatttcatcttcttcaccaccaccgccgcagaaatctttcttcccttcctaccattctccgccactgccaccttcccccgccgtcctcgctacttttccggccaacatctcctccctccttctcccccgccccatctcccgtcaccaccgctccgccgctgccctcgccgtctccctctctctttgctcaatcgccctcctcgccgccgccgccgccttcctcctccaccaccgccgccgcacacactcctcctctgatgtcaacgacgacgacgacgacaaggcctcgagatcggacagcctccgcctgttcccgccgaacaccgccgcctccgacggcgccgaacgtaaaccccgcggcaaaacgagtcccacatcggagcttctctacctcggcacggtggcgaactccgtaaccaccaccaccacctcaactacaacaacagcaaccactgactcaagctccagccaccatgaaagttttcggccaccgtatcagaaactcggcgactcgccagagctcaacccgctgccgccattgccacgtcacaaattcaaaccatggaccactgaagaagagaataatgataaagatatcatagaaaaggaaaatgaagaagaagaagaagaagaacagtttttttctccaagtggttcttctggtgggaaaattaacaaacaacaaaagagttctccttctccttctggtgttgttgcttccagctcacgtgttttccacgtggataaattcggttccagaagcttcacttctcgaaccccttcttacccacgctccaattcactctctttttctcgttccccttctctgaatttcagccccccaagtgttaaatcattgccaccgaacaacaaccctgcttccccttctttctcttcatcctcttcttctccgagggaagaatggcatgttccatctcagaggaaaaattctccagcggccaccgatttacctactcctccgccgccacctcctccgccaccgccgcagttttgggaggctccggttgataaaagtgttacttttaggaacgagagtgaggagactccgaagccaaagttgaaagctttacattgggacaaagttaaggccagctcggacagggtcatggtttgggatcgcttgggaccaagttcttttcagttgaacgaggacatgattgaaacacttttcatggtaaataataataataataattccaaggagggtttcgttcattctgcgtctccaatgcccttggagaatagggtgcttgaccctaagaagtctcagaacattgccattttgcttagagcgctgaatgtgactattgatgaagtttgtgatgctcttagggaaggcaattgtgatacgttggggacggaacttcttgaaagtttattgaagatggctccaactaaagatgaagaatctaagctgaaggagtttcaagatgaatcgcccttcaagcttggcccggctgagaaatttcttaaagtcgtgcttgatataccttttgcttttaagagagtggatgctatgctctacattgcaaactttgattctgaattagaataccttaagaagtcctttgaaactctggaggtggcctgtgaggaattaaggaaaagccgcatgtttctgaagatactcgaagctgttctcagaacaggaaatcgaatgaatgttggaaccaatcgtggtgatgctcatgcgttcaaactggacacacttttgaagttagttgatattaaagggactgatggaaagaccactctcttacatttcgttgtatgggaaattgttagaactgagggttctcatatttctggttctaacaataaccatgccgccgacaatgaccaccaatatactcttcaagatgaggttgacttcaaaaagcttggtctgcaagttgtttcaggtttgagtggggagctcaccaatgttaagaaaacagctgctatggattcggacatgctcagtagtgatgttgctaaacttgccagaggaatcgaaaaaattgtgcaagttgtaaaattgaacgaggagtcacctttgaaagaaactaaccaaaaattttctgacgcaatgaaatgtttcttggagaggggagagcaagagatttcaacaatccagggccaagagaaaaatgccctctcttcagtgaaggagataactgagtatttccatggaaattcagcaaaggaagaagctcatccttttagaattttcatggttgtgagggatttcctttcaatcctagatggtgtttgcaaggaaattggtaaagtaaatgagaggacgttggttggttcccgtcaatctgtaatgcctgcaaatcctataatgcaaacctttttccctgaaattattggttgaagtagtttgggcatgtttggtcattgatgggttggattttcatcatccaaatattatcatgtgaagtgacattttcactcaaatctcac

SEQ ID NO: 10641 - DNA, 2946 bp, Glycine max
gttgttgttttagctatcaattttaagtcccacgtaaataggtgtgttaaatatttaggaatttttttttatcgtttataataattacttgaatataattatttctaataaaatatatctataatataaggaaattaattatcaaaaaaatcttatgaaaaaatagtagcattttcagcacttacattcctaccagtctcttgtttttatctcttcctcccaccagtgtctctctccctttcatcacttgattaacttgaacaccaatatttttctcacagcaccaccatcagcaccataatcatgtgtgcaaccttcaacattcttgttctcttgttatcacttttactcacttcttcttcttcttttttacagcctcgccgtgttctccatcaaccactttttccgacaatctctgttccgccagcagaagctccaagttatttacctcctgagcctcaaccaaagcaacaacaccaacccaagattccattttcttctatttcatcatcttcaccacctccgccgcagaaacctttcttcccttcttaccattctccgccattgccaccttctcccgccgtcgtcgccacttttccggccaacatctcctccctcctcctcccccaccccgtctcccgccaccaccgctccgccgccgccctcgccgtctctctctctctctgctccctcgccctcctcgcagccgtcgtcgccttcctcctccaccaccaccgccgtacacactcctcctccgatgacaacgacgacgacaaagcctcgagatcggatagcctccgcctgttcccgccgaacaccgacgcctccgacggcgccgaccgcaaaccccacgataaagccagccccacatcggagcttctttacctcggcacggtggcgaactcggtcatcaccaccaccaccaccacaacaacaacaaccatagactcaagctccagccaccacgaaattttccggccagcgtatcagaaattcggcgactcgccggagctcaacccgctgccgccactgccacgtcacaaattcaaaccatggactactgaagaacagaacaatgataaagatgtaacagaaaaagaaaaagaagaagaagaagaagaagagtttttttctccaacaggttcttctggtgggaacattaacaaacaacaacagagtcctccttctccttctgcacttgcttctgcttcaagctcacgcgttttccacgtggataaattcggttccagaagcttcacttctcgaaccccttctcacccacgttcaaattcactctctttttctcgttccccttctctgaatttcagccccgcaagtgttaaatcattgccaccgaacaccaaccttgcttccccttctttctcttcatcctcttcttctcccagggaagaatggaatgttccttctcatgggaaaaattctccggcgaccaccactttacctactcctcctccgccgccgcctcctcctccaccgccgccgcagttttgggaaactccggttgataaaagtgttacttttaggaatgagagtgaggagactccaaagccaaagttaaaagctttgcattgggataaagttaaggccagctcggacagggtcatggtttgggatcgcctgagaccaagttcttttcagttgaacgaggacatgattgaaacacttttcatggtaaataatcataataatttcaaggagggttttggtgttgcgattagagataataataatcctcggcgtcaaatggttcattctgcttctccaatgcccttggaaaatagggtgcttgaccctaagaagtctcagaacattgccattttgcttagggcgctgaatgtgaccattgatgaagtttgtgatgctctcagggaaggcaattgtgatacgttggggacggaacttcttgaaagtttattgaagatggctccaactaaagatgaagaatctaagctaaaggagtttcaagatgaatcttccttcaagcttggcccggctgagaaatttctgaaagccgtgcttgatattccttttgcatttaagagagtggatgctatgctctacattgctaactttgactcagagttagaataccttaagaagtcctttgaaactctggaggtggcctgcgaggaattaaggagcagccgaatgtttctgaagattctcgaagcagtgctgagaacaggaaatcgaatgaatgttggcaccaatcgtggtgatgctcatgccttcaaactggacacgctcttgaagttagttgatattaaaggaaccgacggaaagactactctcttacatttcgttgtacaggaaattgtcagaaccgagggttctcatatttctggttctaatcatccccatgcctctgacaatggccaccaatatactctccaagatgaggttgacttcaagaagcttggtctgcaagttgtttcaggcttgagtggtgagctcaccaatgttaaaaaagcagctgctatggattcggacgtgctcagtagtgatgttgctaaactttccagaggaatcgaaaaagttgtgcaagttgtaaaattgaacgaggagttgcctttgaaagaaactaacaaaaaattttcggacgcaatgaaaggtttcttggagaggggagagcaagagctttcaacaatccaggcccaagagaaaaatgccctctcttcagttaaggagataactcagtatttccatggaaattcagcaaaggaagaagctcacccatttagaattttcatggttgtgagggatttcctttcaatactagatggtgtttgcaaggaagttggtaaagtaaatgagaggactttggttggttcccgtcagtctgtaatgcctgcaaattctataatgcaaacctttttccctgagattattggtaagcaaccatctgattcctctgaatctgattaa

SEQ ID NO: 10642 - DNA, 1870 bp, Glycine max
gtgttcattgtgtgttgccactctcctctcttgttaaaggaacatggaagctgtgtgtgctttttctgttggcacacttcacatcccaacagcacatgaaacatcaaactcctttaggaaatccatattcttgagcaaccaagtggcttcaccagtttcattggtttttctcaggggcagttcaaaatccaagcttttaactgccttgtcaccccctccattgacagaatccagtaaccaacctgaggctgagccagaatttgaaagtcatgcagagaaatttgactggtactctcagtggtaccctttgatgccaatttgtgaccttgacaagaggaagccacatgggaagagggtgttgggaattgatgtggttgtgtggtgggataggaatgagggtgcttggcaggttcatgatgatgcttgtcctcatagattagcacccttgtctgatggaaggattgatcaatggggcaggttgcagtgtgtgtaccatggttggtgtttcaatggcaaaggagaatgccagctcattcctcaggcactccctgatggccctccggtacatacgtccaaaaaagcatgtgtagctgcttacccaagtactgtgcagaatgatatcttgtggttctggccaaatactgatcctcaatacaaagatattattacaagaaaaagacccccattcataccagaaatagatgatccatcgtatactaaatcaatgggaaacagagacattccttatgggtatgaagtactgatagaaaatcttatggatcctgcacatgttccatatgcacactatggactaatgcgtactccgcaaccaaaagtgaaagctgatagagaagggggcaggccacttgacatgtctattgaaaagttagatatcaatggcttttcagcaaatcaggcttggggcaaaagcaaatttatgccaccatgcattttttatgcatatactccagatcaacctgcctcatctggtgaaactaagaaatcatcagctaagaagaaaatgtgtttaatctttgtttgcgttccggttagtcctggtaaaagcagattgatatggtgcttcccaagaaactttggattgtggatggacaaaattgtaccacgatggatatttcatgtgggacaaaacctgattctggattcagatttatatctcctccatgttgaggaacataaactaaaggatattggtccaaacaattggcacaaagcctgttttgtgccaacaaagtcagacgcccttgttattggttatagaacgtggctaaggaagtatgcaggtggtcaggttgattggagaggaaaatatagtggagctcttcctccaacacctccgagagaacagcttttggacaggtactggtcccatgtggtgaattgcaagagttgcaattctgcttataagagcctcaatgcggttgaagtaatgctgcagatcatatctgttgcttcaattgggattgttgccgtcatgaagcatggtacaatgtcagtggcaaaaagaaattcaatggttgccttagcagtgctatcatttgcactgtcacggtggttagctcacttcatatacaaaaacttccgttatcatgactatgagcatgccttccgctgaaatgtgttttccatatttcttcatgtctaaaaatatgtgtatagactatagtgaaggtccactagaatgaagtcactggcacttcatttgactttttaaattttaaaagttaattcctctatgacaagtattcgcaacctcttcatacagaggacaaataagttgatatcaatctcatgtaaatctaatttacattgtccgacgtaaaatgtgtagaattgtagaaatattgtatct

SEQ ID NO: 10643 - DNA, 1878 bp, Glycine max
aagcattgtccattgtgtgttgccactttcctctcttcttgtacactcttgttccttctggattgcagaaaggaacatggaagctgtgtatgctttttctgttggcacacttcacatcccgacagcacatgaaacaccaaactcatttaggaaatctatattcttgagcaaccaagtggcttcaccagtttcattggttctcaggggcgcttcaaaatccaagcttttcactgccttgtcaccccctccattgacagaatccagcaacaaccaacctgaggaggctgagccagaatttgaaagtcatgcagagaaatttgactggtactctcactggtaccctttgatgccaatttgtgaccttgacaagaggaagcctcatgggaagagggtgttgggaattgatgtggttgtgtggtgggataggaatgagggtgtttggcaggttcatgatgatgcttgtcctcatagattagcacccttgtctgatggaaggattgatcaatggggcaggttgcagtgtgtgtaccatggttggtgtttcaatggcaaaggagaatgcaagctcattccccaggcaccccctgatggccctccggtacatacgtccaaaaaagcatgtgtagctgcttacccaagtactgtacagaatgatatcttgtggttctggcccaatactgatcctcaatacaaagatattattacaagaaaaagacccccatacataccagaattagatgatccatcgtatactaaattaatgggaaacagagacatttcttatgggtatgaagtactgatagaaaatcttatggaccctgcacatgttccatatgcacactatggactaatgcgtactccgaaaccaaaagtgaaagttgatagagaagggggcaggccacttgaattgtctattgaaacgttagatatcaatggttttactgcaaatcagggttggagtaaaagtaaatttatgccaccatgcattttttatgtatatactgattcagatcaacctgcctcatctgctgaaactcagaaatcatcagctcagaagaagtttgctttaatctttgtttgtgttccggttagtcctggtaaaagcagattgatatggtgcttcccaagaaactttggagtgtggattgacaaaattgtgccacgatggatatttcatgttggacaaaaccggattctagattcagatttatatcttctccatgttgaggaacaaaaaatagttgatattggtccaaagaattggcacaaagcctgttttgtgccaacaaagtcagatgcccttgttattggttatagaaattggttaaagaagtatgcaggtggtcaggttgattggagaggaaaatatagtggggctctccctccaacacctccaagagaacagcttatggacaggtactggtcccatgtggtgaattgcaagagttgcaattctgcttataagagcctcaatgtgattgaagtaatgttgcagatcatatctgttgcttcaattgggattgttgccatcatgaagcatggtacaatgtcagtggcaaaaagaaattcaatggttgcgttagcagtgctatcattagcactgtctcggtggttggctcacttcatatacaaaaacttccgttatcatgactacgagcatgccttccgctaaaatgtggtttccatagttcaagtccaaatatatgtatagactatactgaaactccactagaataaagtcacttgcactttattttactttaattttagaagttaatttaaaatggtcttttacctccatggaaataatctgtcagaatctctccatacaaagagttaagtgagaaagggaatctatctattgtgattttgtgatta

SEQ ID NO: 10644 - DNA, 2135 bp, Medicago truncatula
tttcatttcataccttgcataataacaaaaaaacctgagcctctagtttcattatctctaagctaaatcatctaacattgaagtgtttccactttcttctcttgttccattactctgcagaaagggaacaatggaagctttttctgttagttcacttcacataccaatagcacttgaaccacaaatcccattaaaaaaatctatgttcttcaactcacaagtgcattcaacacttccattaattcgtgggaacgcttcaaaattcaagcttttcactgccttatcaccttctccattaacagagtctagtagtagtaaccttgaagtggatgatgaaccagaagttgaaacaggttcagagaaatttgactggtactcacagtggtatcctttgatgccaatatgtgatcttgacaaaagggcacctcatgctaagaaggtgatgggaattgatgttgttatatggtgggataggaatgagagcgcatggcaagtttttgatgatgcttgtcctcatagattagcacctttgtctgaaggaaggattgatcaatggggtaggttacagtgtgtgtatcatggttggtgttttaatggatcaggtgattgcaagttcattcctcaggcacctcctgaaggacctccgattcatacgtccaaaaaagcatgcgtggctgcttacccaagcactgtgcagaatgatatcttgtggttttggccaaacagtgatcctcaatacaaagatattattacaaggaaaacacccccattcataccagaaatcgatgatccatcctttactagcttaatgggaaacagagatattgcttatgggtatgaggtacttattgaaaacctcatggacccttcacatgttccatatgcacactatggattaatgaaaactccacaaccaaaagtgaaagctgatagagaaggaggaagaccacttgaattgtcaattgaagagttagatgtcaacggtttcacagcaaatcagggttggagcaaaagcaaatttatgccaccaagcatcttttatgcttatactgatccaaataaacctgcatcttctgaagaaactaagaaatcatcagttcagaagaaatttgctttgatctttatttgtattcctgttagtcccggtaatagcagactgatttggtgcttcccaagaaactttgggttgtggattgacaaaattgtaccgcgatggatttttcatgttggacaaaacttgattctagattcagatttatatcttctccatgttgaggaaaaaaaaataatggatgttggtcaagccaattggcataaggcatgttttgttccaacaaaggcagatgctcttgtgattggttttagaaagtggttgaagaagtatgcaggtggtgaagttgaatggagaggaaaatataatggagcccttcctcctacacctcccagagaacaacttttggacaggtactggagccatacggtgaattgcaagagttgcaattttgcctataagagcctcaatgtggtggaagtgatgctgcagatcatatcagttgcttcaatcgggattgttgctacaatgaagcagggtgtggtttcagctacaacaagaaattcaatggttctgttggcagtactttcattcgcgttgtcacggttgttagctcacttcatatacaaaaacttccgttaccatgactacaaccatgcctttcgctgaaatgtgtttccttagttgttaatctccaactttgttgtgtgtgtgtatatatatagtgaagttatacaaagacaaaggcattaattattggtacttaagaggagcgttggaacatttgtgtggctaaaatatgaacataacaacagcatgaagagatgagtccatttaatttgaattcctgaagctaacatcctgctctaaaaaatttcccttctgttgtggaacatgtgatgggatgtatgttgctttgtttggagaaatcatgcagaaaaggtgacactttcttacagtgacccaaattcttattttctttgttggatgaatgagggcactgttaactttctagacatttttttcctataaaaaaataaataaataatttctagagattttgatatttattatgctttattgc

SEQ ID NO: 10645 - DNA, 1599 bp, Medicago truncatula
atgttcttgaagtcacaaatccattcaacacttccattaattcgtgggaacacttcaaaattcaagcttttcactgccttatcaccttctccgttaacagagtctagtagtagtaaccttgaagtggatgatgaaccagaagttgaaacaggttcagagaaatttgactggtactcacagtggtatcctttgatgccaatatgtgatcttgacaaaagggcacctcatgctaagaaggtgatgggaattgatgttgttatatggtgggataggaatgagagtgcatggcaagtttttgatgatgcttgtcctcatagattagcacctttgtctgaaggaaggattgatcaatggggtaggttacagtgtgtgtatcatggttggtgttttaatggatcaggtgattgcaagttcattcctcaggcacctcctgaaggacctccgattcatacgtccaaaaaagcatgtgtagctgcttatccaagcactgtgcagaatgatatcttgtggttttggccaaatactgatcctcaatacaaagatattattacaaggaaaacacccccattcataccagaaattgatgatccgtcttttactagctttatgggaaacagagatattccttatgggtacgaggtactggttgaaaacctcatggacccttcacatgttccatatgcacactatggattaactccagacccaaaagggaataatgctgatagagaaggaggaacaccacttgatttctcagttgaagagttagatatcaatggtttcactgcaaatcagggttggaacaaaagcaaatttatgccgccaagcatcttttatctctatagtgagccagataaacttgcatcttctgttgaaactaagaaatcatcagttcagaagaaattttctatgatctttatttgtatacctgtgagtcctggtaaaagcagactgatttggtgctttccaagaaactttggagtgtgggccgacaaaattgtaccacgatggattcttcatatgggacaaaacttgattctagattcagatttatatcttctccatgttgaggaacaaaaaataatggatgttggtcaaggaaattggcataaggcctgttttgtgccaacaaaggcagatgctcttgtgattggttttagaaaatggttaaagaagtatgcaggtgatcaagttgattggagaggaaaatatagtggtgctctgcctcctacacctcctagagaacagcttatggacaggtactggagccatacggtgaattgcaagagttgcaattttgcctataagagtcttaatgtggtggaagtgatgctgcagattatatctgttgcttcaattgggtttgttgccacaatgaagcagggaatagtttcagctgcaacaagaaattcaatagttgtgctggctatactttcattcgcattgtcgcggttgttagctcactttatttacaaaaactttcgatatcatgactacaaccacgtacgctcttcgatgaaatgtgtttccttaattatatttctccaagctggttacgtatatactccctccggtcctaaatttataatagacatttga

SEQ ID NO: 10646 - DNA, 1641 bp, Medicago truncatula
atgttcttgaagtcacaaatccattcaacacttccattaattcgtgggaacacttcaaaattcaagcttttcactgccttatcaccttctccgttaacagagtctagtagtagtaaccttgaagtggatgatgaaccagaagttgaaacaggttcagagaaatttgactggtactcacagtggtatcctttgatgccaatatgtgatcttgacaaaagggcacctcatgctaagaaggtgatgggaattgatgttgttatatggtgggataggaatgagagtgcatggcaagtttttgatgatgcttgtcctcatagattagcacctttgtctgaaggaaggattgatcaatggggtaggttacagtgtgtgtatcatggttggtgttttaatggatcaggtgattgcaagttcattcctcaggcacctcctgaaggacctccgattcatacgtccaaaaaagcatgtgtagctgcttatccaagcactgtgcagaatgatatcttgtggttttggccaaatactgatcctcaatacaaagatattattacaaggaaaacacccccattcataccagaaattgatgatccttcttttactagctttatgggaaacagagatattccttatgggtatgattttaattttgaaaacattacattatgcatacccctgacagtaacttacatgtatgaggtactggttgaaaacctcatggacccttcacatgttccatatgcacactatggattaatgaaaactccacaaccaaaagtgaaagctgatagagaaggaggaagaccacttgaattgtcaattgaagagttagatgtcaacggcttcacagaaaatcagggttggagcaaaagcaaatttatgccaccaagcatcttttatgcttatactgatctaattaaacctgtatcttctgaagaaactaagaaatcatcagttcagaagaaatttgctttgatatttttttgtattcctgtgagtcccggtaacagcagactgatttggtgcttcccaagaaactttgggctatggattgacaaaattgtaccgcgatggatttttcatattggacaaaacttgattatagattcagatttatatcttctccatgttgaggaaaagaaaatattggatgttggtcaagccaattggcataaggcatgttttgttccaacaaaggcagatgctcttgtgattggttttagaaagtggttaaagaagtatgcaggtgatcaagttgaatggagaggaaaatataatggagcccttcctcctacaccttccagagaacagcttatggacaggtactggagtcatgtggtgaattgcaagagttgcaatcttgcctataagagcctcagtgtggtggaagtgatgctgcagatcatatcagttgcttcaattgggattgttgccacaatgaagcagggtttggtttcaactacaacaagaaattcaatggttgtgttggcggtactttcattcgcgttgtggcggttgttagcgcacttcatatacaaaaacttctgttaccatgactacaaccacgcctcgtcaaattgtttcccaccatatcctattctaattgttgatgaagattttaactcatttgtatctaagaaataa

SEQ ID NO: 10647 - DNA, 1459 bp, Vitis vinifera
ttcaattgggaaccccagataaggtttctcttgaaaaatattgtccattcatttttctcccctctttgatttggtattagtgttgtacaaggatttgcttggaaaatttgcattgttggagcttggttgtttctttttttttgagggtttttgttttgtttgaagatttggtggttgggatttctggtgatctttgtgaaatggccgaggagaagtgtttcattgccaaagatgttacagaattaattgggaaaacaccattagtatatctgaacaatgtggtagatggctgtgtagctcgtattgctgcaaagcttgaaatgatggagccttgctctagtgtcaaggacaggatcgggtacagtatgatcacagatgcagaagagaagggcctcattacgccaggggagagtgtcctcattgagcctaccagtggtaatactggcatagggttggcatttatggcggcagctaagggttataagctcatcattacaatgcctgcttcgatgagtcttgagagaagaataattctccgagcttttggggctgaattggttctcacagatccagccaagggcatgaagggggctgttcagaaagctgaagagatactggcaaagacacctaattcctatattcttcagcaatttgaaaaccctgccaatccgaagattcattatgaaaccactggacccgagatctggagaggcactggtgggaaagttgatgcttttgtctctgggatagggactggaggtaccataacaggtgcagggaagttcctcaaagagcaaaattctgacattaagctgtatggtgtagaacctgtggaaagtgcagtactgtctggaggaaaacctggcccgcataagatccaaggaattggcgctggtttcatccctggagttttagatgtcaatttgcttgatgaagttgttcaagtttcaagtgaagaagctattgaaactgccaagcttcttgcattgaaagaaggtttgctggttgggatatcatctggtggtgctgcagctgctgcaataaagttagcaaagaggccagaaaatgctgggaaactcattgttgtggttttccccagctttggagagcgttatctgtcctcggtgttgttcgactctgtgaagcgggaggcagagaatatgctgtttgaaccctgagggagctccctggcctctaccaagtgctgtacccctttcttgctgagtagtttgaaatttacattgtggagtggatagcatggtgttttcaagttgcaaattggttgttgtctgggtgtttttttgcttctctctataggaatctaaataataaataagctttgctggtagttgtattaagaagactatgcaatctgaatccgtaactgggattggaatgatgagataaaagcttgatatatcaatgaatgaaagaacagcagtctgcttttttctcctaa

SEQ ID NO: 10648 - DNA, 1432 bp, Glycine max
cggaaatatcagaatcagaccatccaaacgaagcagaaagagctcatagaagttctcgtcctcttctctctatcttgaatcttcttctcttatcagaaacgcgcgttgctcggataaggttgtgctgcgccgactcactggtactttgcttaatatggcggctgagaagtcaaacattgcaaaagatgtgactgaattaattggcaaaactccattggtatatctcaaccacatcgtggatggttgtgttgccaaagttgctgccaagcttgaaatgatggaaccttgctccagtgtcaaagacaggataggatatagcatgattgtagacgctgaggagaaaggactcatcacaccgggtgaaagtgtcctcattgaacctaccagtggaaacactggcataggtttggcattcatggcagctgctaagggttataaacttattataaccatgccttcttcgatgagtcttgaaagaagaaccattcttcgtgcttttggagctgagttagttctcactgatcccgccaagggtatgaaaggagctgttcagaaggcagaagagataagggataagactcccaattcttatatgcttcagcaatttgaaaatcctgccaacccaaaggtccattatgaaaccactggaccagagatctggaagggctctagtgggaaggttgatgctcttgtctctgggattgggactggaggtacagtaacaggtgctggaaaatatctgaaagagcagaatcctgatataaagctatatggcattgaaccagtagaaagtccaatactgtctggaggaaaacccggccctcataagatccaaggaattggtgctggcttcatccctggtgttctggatgttgatttacttgatgaagttgttcaaatttcaagtgaagaagctattgaaactgctaagcttcttgcattgaaagaaggtttactggtgggaatatcatctggtgctgctgcagctgctgcagttaagatagcgaagaggccagaaaatgctggaaaactcattgttgcggtcttcccaagttttggagagcgttatctatcgtctgtgctctttgaatccgtgaagcgagaagcagagagcttggtctttgagccttgaatgtcaagtcatacgagccatttgctgcttctcaagttgcattctgtccttgggttgtgtatatattttttctcttatggatctaaaaaataaaaaggatttctgtttgcttgttaattgactaagattcaataaaaatatagtagtttgctgaaatgttcaaactcgctcataatttgtagatcatgatgccgcgaactcatgcttgtactattttatttactagttaaattttgcttcttaaaacttgtaatggagaaaacactattacttattaacatgtggcatgctttttttttt

SEQ ID NO: 10649 - DNA, 1286 bp, Glycine max
gggatccaaacgaagcagaaagagctcatagaagttctcgtcctcttctctctatcttgaatcttcttctcttatcagaaacgcgcgttgctcggataaggttgtgctgcgccgactcactggtactttgcttaatatggcggctgagaagtcaaacattgcaaaagatgtgactgaattaattggcaaaactccattggtatatctcaaccacatcgtggatggttgtgttgccaaagttgctgccaagcttgaaatgatggaaccttgctccagtgtcaaagacaggataggacatagcatgattgtagacgctgaggagaaaggactcatcacaccgggtgaaagtgtcctcattgaacctaccagtggaaacactggcataggtttggcattcatggcagctgctaagggttataaacttattataaccatgccttcttcgatgagtcttgaaagaagaaccattcttcgtgcttttggagctgagttagttctcactgatcccgccaagggtatgaaaggagctgttcagaaggcagaagagataagggataagactcccaattcttatatgcttcagcaatttgaaaatcctaccaacccaaaggtccattatgaaaccactggaccagagatctggaagggctctagtgggaaggttgatgctcttgtctctgggattgggactggaggtacagtaacaggtgctggaaaatatctgaaagagcagaatcctgatataaagctatatggcattgaaccagtagaaagtccaatactgtctggaggaaaacccggccctcataagatccaaggaattggtgctggcttcatccctggtgttctggatgttgatttacttgatgaagttgttcaaatttcaagtgaagaagctattgaaactgctaagcttcttgcattgaaagaaggtttactggtgggaatatcatctggtgctgctgcagctgctgcagttaagatagcgaagaggccagaaaatgctggaaaactcgttgttgcggtcttcccaagttttggagagcgttatctatcgtctgtgctctttgaatccgtgaagcgagaagcagagagcttggtctttgagccttgaatgtcaagccatacgagccatttgctgcttctcaagtcgcattctgtccttgggttgtgtatatattttttctcttatggatctaaaaaataaaaaggatttctgtttgcttgttaattgactaagatccaataaaaatatagtagtttgccaaaaaaaaaaaaaaaaaaaa

SEQ ID NO: 10650 - DNA, 3313 bp, Cucumis melo subsp. melo
atggttgatacaaagtctacaatagctaaagatgttactgaagtgagccactgaccttcctccctctctttttcctcaattgaatttcaaggattgtcttagcttattattaagaacttttgaatttccttacatccatttttcatatattaaaattttcagctaattgggaatacaccacttgtatatctcaaccgtgttgttgatggctgcgtggctcgggtagctgccaagttggagatgatggagccttgctctagtgtcaaagataggtactttttatttttaattatagtttttttttttgtttctaaataattattgtaatccaaaaattggccttaaaatctatgcaaggatactgatcgggcattttattgctacagcggaacaagaaatcatatttaactaagaaaaaagaaagacatgtctacttatttacttctttctgtttctgtgtaattggttttgtactgttagctgtaatttggacaaattgtattagtttttaagtaataaaaatagatggagcttttatattcatgctgaatactgtatcccattgccagtttccttcttgttgcacttctattagatttgaaattgtctgcaacaagcattggacttctattaggatttgaatttatctgcaacaagcgtgataaggaaaaacgttctgttctttcaggattggctatagcatgatttcagatgcagaaaagaacggtttgatctctcctggggaggttagcaatggcaattggtcttttttaaaatctgaatggcacttttacattgcatggatttcttcttttcttttctttttttggtaggttgatttgatttaccttttttccctttcatagagtgtcttgatcgaacctaccagtggtaatactggtataggcttggccttcattgctgctgccaagggttataagcttataatttgcatgcctgcatcaatgagtcttgaaagaagaaccatccttcgagcttttggagctgaactggttctcacagatccagctagggggatgaaaggcgcagttcagaaggccgaagagataaaagcaaaaacacctaattcttacatccttcagcaatttgaaaaccctgctaacccaaaggtattctctgagccaattcgatgtgaaacatattctgttttatatagctttctgttctaatttccaatttttgtcagatccactatgagaccactggcccagagatatggaagggatcgggtggaaaggttgatgcacttgtctctggtatagggactggaggtacggtgacaggtgcagggaagtatctcaaagaacaaaatcctagtattaaggttcgctattctcatcatctgaacccttgtattgctgttagctaagacaagcttactgaatttcggatgtgctttctcccctcccatctttagttatatggcgtggaacctgttgaaagtgcaattctatctggaggaaagcctggtgagtcatgaaatcccccctcccctaaaaaagagtgttttcccaatccgtttgctcctcttagtcatgaatattaatttccaattcataaatcggtctttatgtttcaagtgcctaccttaaatgaatatgtattctgtatgtgaacattgcaggcccacataaaatccaaggaattggggcaggcttcatccctggagttttggacgtcaatttgctagatgaagttgttcaagtaagcatcaaaccttttgtttcgttgtattttccagcgacggtctctttttattcgaaaattgcttttcctttaaaagaaaatagtgtaagcatcaaacttctattaggtttctttcaatagaggatggtggtgtgttacaaactgaaatggttaataacaagcatttggagacataatgcatggacatttaactttgagcatcataattcattttgaaataggcccacgtccaacttcaagacttagtacctattgctaggagtttaatctccggtttcaagaacttgtataatagatgtctggtaatgcagaagttagaaaaagtttgcatacttttaggcgaaggtgtcaatagactcaaatactaagggttgggatgttaattgcccccacccacccacaaacgcacaccaaaaaaaaaaaagtcagtactacatctttttgcacaattcacaattttgagttattcactcgcaaatgattcacaatttttgtaaaatcaatgaccataatgtctctataccctatcattggcttgttgtccatcattcgctcatttgactaatggacaataaattctcaaatttctgtccgttggagtccattgttcaaacctttaatcacctctcatggatcactgagtttcttgaatacttgcaggtatcaagtgaagaatctattgaaatggcaaagctgcttgcattgaaagaaggtctactggtaggttgcgacatataggcatcaaaaaggaatttccaattttgtttgattctattttcatccgaatttttgagccaattggatccgagatctgattatcaaagccttttgttctttctatatgttatgacaacattgtctatatgtaggttggtatatcatccggtgctgctgcagctgctgcaattaagcttgcaaagagaccagaaaatgctggaaaacttattgttgtaagtgctccttttccttctcgtgtaatacctcttttgacatttcatggccgtgtctatacattaattcttctgctttggactacttttataatggaataattcctgatcatttagcgaaccatttactcatttgcattattcaacgaattccacgacaatatcttaccttatacaaattgtttgaagaaatagactttgatagctggagatcaaaaaactaaatatgttttaacaattgaaacaccttattagtatctttttcaactcgacaatagtgaatctagggaactattggccgaacctactacgtttctgtctgataaggtttagctattcatatggtgatggtgggggggggggacactgaaatcatagttagaccttcacttgctacatagctcaggcagctaacacccttaagtttagaacaaaaaggaaaatcattcagcggattcggataattgttctctattgttcagcttgaatggatttctccacttctctttacctggctaaacttaccatccaaatgtgaaacaggcggtgttcccgagttttggagaacgatacctctcaactgtgctgttcgagtctgtgaaacgagagaccgagaatatgactttcgagccatg

SEQ ID NO: 10651 - DNA, 1111 bp, Medicago truncatula
atttttgtttgcaaacacaaatcacattgaaaaaattagggtttataatttacagtatcattctcttctccgtgttattgcgatctaacaaactatgtcgattttcgagtacaacggaagtgccctagtagccatggttggcaagaattgcttcgccattgccagcgatcgaagactcggtgttcagcttcaaaccatagctaccgattttcaaagaatttccaaaattcatgataaactcttcatcggtctttctggactcgccaccgattctcaaacactgtatcagcgtcttgtgtttcggcacaaactgtatcagcttcgtgaagaacgtgatatgaagccggagacttttgctagtttggtgtcttctatgcaatacgagaaacggttcggtccatacttttgccagcctgtaattgctgggttaggggatgatgacaagccattcatttgcacaatggatgcgattggagcaaaggaacttgcaaaagactttgttgttgctggaactgcgtccgagtctctgtatggtgcttgtgaatcaatgtttaagcctgacatggaagctgaggaattgttcgagaccatctcccaagcactgttatcatctgtagaccgtgactgtcttagtggctggggtggacatgtctatgttgtcactccaacagaagtaaaggaaaggattttgaagggaagaatggattaagttttaagccagctggtcaactactcaagttcactatgttttctgtttaattctgagctgaatggcgaacatgtaccgtctgttgttaatgggtacctttgttattgtgaacttaaattaaatgtacctagaaaattatttacaaacgagttcagctgttctatatagaattttcagtgaaagtagactctggaatcgggtatgctgtggaattaaattatgagtatatgtattggaatgtttttaggatagactggcattgcaagacacatattgttcaccgaaattgtttgtccctgaatccaattcatcgtttttccccgtaagatgttgatgttagtcacatgtgagtaattaagtgactttgttgattgattgagtgaggaatatagggtttggagc

SEQ ID NO: 10652 - DNA, 852 bp, Medicago truncatula
gacattgaaaaaattagggtttataatttacagtatcattctcttctccgtgttattgcgatctaacaaactatgtcgattttcgagtacaacggaagtgccctagtagccatggttggcaagaattgcttcgccattgccagcgatcgaagactcggtgttcagcttcaaaccatagctaccgattttcaaagaatttccaaaattcatgataaactcttcatcggtctttctggactcgccaccgattctcaaacactgtatcagcgtcttgtgtttcggcacaaactgtatcagcttcgtgaagaatgtgatatgaagccggagacttttgctagtttggtgtcttctatgcaatacgagaaacggttcggtccatacttttgccagcctgtaattgctgggttaggggatgatgacaagccattcatttgcacaatggatgcgattggagcaaaggaacttgcaaaagactttgttgttgctggaactgcgtccgagtctctgtatggtgcttgtgaatcaatgtttaagcctgacatggaagctgaggaattgttcgagaccatctcccaagcactgttatcatctgtagaccgtgactgtcttagtggctggggtggacatgtctatgttgtcactccaacagaagtaaaggaaaggattttgaagggaagaatggattaagttttaagccagctggtcaactactcaagttcactatgttttctgtttaattctgagctgaatggcgaacatgtaccgtctgttgttaatgggtacctttgttattgtgaacttaaattaaatgtacctagaaaattatttacaaaaaaaaaaaaaaaaaaaaaa

SEQ ID NO: 10653 - DNA, 1151 bp, Medicago truncatula
tataaattgaagatcagggttcatactttacagcatcattctcatgacgattttcaagcacaacggaagtgccgtagtagccatggttggcaagaattgcttcgccattgccagcgatcgaagactcggtgttcagcttcaaaccatagctaccgatttccaaagaatttccaaaattcatgataaactctacatcggtctttctggactcgccaccgattctcaaacactgtatcagcgtcttgtgtttcggcacaaactgtatcagcttcgtgaagaacttgatatgaaaccggagacttttgctagtttggtctctgctatgcaatacgagaaacggttcggtccatacttttgccagcctgtaattgctggattaggggatgatgacaaaccattcatttgcacaatggacgcgattggagcaaaagaacttgcaaaagactttgttgttgctggaactgcgtccgagtctctgtatggtgcttgtgaatcgatgtttaagcctgacatggaagctgaggaattgtttgagaccatctcccaagcactgttatcatctgtcgaccgtgactgtcttagtggctggggtggacatgtctatgttgtcactccaacagaagtaaaggaaaggattttgaagggaagaatggattaagttttaagccatctggtcaagtatttcatgttcactatggatagtgataaatatttggttgtttctagggtgagggctctagcaagtccctcaccaatggaccactttgaattacaattaggagccacttgattaattgagtgtacggatctaattatacattgtacacattagatcacacatctttttttaacttctcttctagctcatcaaaaaaaaaaaaacttaccctctctcccaaaccgccatacccatcgtcacagattccttccctcctccttttgtcacacatttatattttatgtgatcgtatgctgacgtttcctacttgggtttcattacattatgcctcttgatttctttatttaattgtatattcaaaatgatgcaaatgggttctttatatttatcgtgtcccatgtttttctttatatttatcgtggacaaattttgacccacgctgtgttattcatcaatgatatttttatgtatc

SEQ ID NO: 10654 - DNA, 866 bp, Glycine max
ggggtagcgaaagaaagatgtcgatcttcgagtacaacgggagtgccctagtggctatggtggggaagaactgcttcgccatcgcgagcgatcggagactcggggttcagctccagaccattgccaccgatttccagaggatttcaaaaatccacgacaagctcttcatcggtctctccggcctcgccaccgacgcccagaccctctaccagcgcctccttttccgccacaaattgtatcagctccgcgaagagagggacatgaagccccaaacctttgccagcctagtctccgctattctctacgagaaaaggtttggtccatacttttgccagcctgtaattgctggactaggagatgatgacaaaccattcatttgcacaatggatgccattggagcaaaggaacttgcaaaagattttgtagtggctggcactgcatccgagtctctttatggtgcttgtgagtcaatgtttaagcctgacatggaaccagaagaattgttcgagacaatctcccaagcactgctatcatctgtagatcgtgattgtttaagtggctggggtggacatgtttatgttgtcaccccaaccgaagtaaaggaaaggatactgaaaggaagaatggactaacttttaagcgtgtttgttttgacgtactcctactttccgaggagcctgaacgtgaaaggggaaatttgttggattgacgttcatcaccatttcaaatggaaaaacaaatatgctatgatccaaccaaatcactcttttcttgtcattttgttatcctagtttggatttaattgaaaatcatttaccatcaatttgtgcagacgctataccttatactgtagaagtttactctgt

SEQ ID NO: 10655 - DNA, 918 bp, Arabidopsis thaliana
aagccaccgtcgactttacttagtactccctctctctcccctcctccttcccagatttcgtctccgttctgaaaaaaactccaaattctactctgaaaccctaagtttccgatgtcgatcttcgagtacaatggaagtgctgttgttgctatggtaggtaagaattgtttcgccatcgccagtgatcggagactcggtgttcagctacagacaatcgccactgatttccagagaatctccaagatccacgatcgtgtcttcatcggtctttctggtctcgccaccgatgttcaaacactataccagcgcttggtgtttcgtcataagctttaccagcttagggaagagagagacatgaagcctgaaactttcgctagtcttgtctcagccatcctttacgagaagagatttggtccttacttatgccaacctgtgattgctggcttgggagatgatgacaagcctttcatttgcacgatggactctatcggagccaaagagttagctaaagattttgttgtatctggaactgcttcagaatcactctatggagcttgtgaggcaatgtacaagccagatatggaagctgaggaattgttcgagacaatatcgcaagcacttctctcatctgttgaccgtgattgtctgagtggttggggagggcatgtttacattgtaacaccaacagagattaaggagaggatcctaaagggaaggatggattgatctgcttcttctattcaagttgttttccgctgtaatccggttttaagtagtgtaaccttcacatcccggtttaattatatgatcattccttggctgaaattatgggttatgtatgaagtttgattttcctcttggataatggattatatgattttaattcgtagagttatcgaagaataacacttttaactc

SEQ ID NO: 10656 - DNA, 776 bp, Glycine max
gggacgacttaaccccaaacgaagaaaaaagactgagagcaattgcatcaacaacaaattgaaaggatgtcgatcttcgagtacaacggaagcgccgtggtggctatggtcggcaagaactgcttcgccattgccagcgaccgaaggctcggcgttcagctccaaaccatagccacggatttccaacgcatttccaagattcacgacaagctcttcatcgctctctctggcctcgccaccgatgctcaaacattgtatcagcgtcttgttttccggcacaaactgtatcagcttcgtgaagagagggatatgaaaccagagacctttgccagcttagtctctgctctgctttatgagaaaaggtttggtccatacttttgtcagcctgtaattgctggattaggggatgaagacaaaccattcatctgcacaatggattgtcttggggcaaaggagcttgcaaaagattttgttgtttctgggactgcatctgagtctctgtatggtgcttgtgaggcgatgtttaagcctgacatggaaccagaggaattgtttgagaccatctcccaagcactgctatcatctgtagatcgtgattgtttgagtggctggggaggacatgtctatgttgtcacgccaaccgaagtgaaagaaaggattttgaagggaaggatggattaacttgtaagccacctgagttttctgtttagtttggagttgaatggcatgacatttacaatcctttgttaaaggtacctttgttattgtggctcttt

SEQ ID NO: 10657 - DNA, 1002 bp, Arabidopsis thaliana
caagccatcgtcgactttaataattgttcttctcttgctcagatttcttctccgataggaaaactcccgaagcttcactcagtaaaccctaattttccgatgtcgatcttcgagtacaatggaagtgccgtcgtagctatggtagggaagaattgcttcgctatagctagtgatcggaggcttggtgtgcaattacaaaccattgctaccgattttcagagaatatctaagatccacgatcatctcttcatcggactttccggtctcgccaccgatgtccagacattgtaccagcgactcgtatttcgtcataagttatatcagcttagggaagaaagagacatgaagcctgaaactttcgctagtcttgtatcggctattctttatgagaaaagatttggcccattcttgtgccaacctgtgattgctggattgggagatgataacaaacccttcatttgcactatggattctattggagccaaggagttagctaaagattttgttgtctcgggaactgcttcagaatctctatatggtgcctgtgaagccatgttcaaaccagatatggaagctgaggaactattcgagacaatttcacaagcacttctctcttcagttgaccgcgattgtcttagtgggtggggaggacatgtctacgttgtaacaccaaaggaggtgaaggagagaatcctgaagggaaggatggattgatctgatatcacatatctgcttttgtccaagttcggtatactccttaacccggttatgtagaagctctcgtcccatagtaactatgttccttctctgaaactggatattgtggttcgttctctcggatgttttatttgctattgatagagttcaatgaaaatgaagaaatagcagttgttatcttgttccagtactcgatcattctatgtaccttgttgtttctgttttaatttcgtaccaagtgttccagatttctggtttgtcgcagtctttagttttcaaggttgg

SEQ ID NO: 10658 - DNA, 898 bp, Arabidopsis thaliana
aagccaccgtcgactttacttagtactccctctctctcccctcctccttcccagatttcgtctccgttctgaaaaaaactccaaattctactctgaaaccctaagtttccgatgtcgatcttcgagtacaatgtaagtgctgttgttgctatggtaggtaagaattgtttcgcaatcgccagtgatcggagactcggtgttcagctacagacaatcgccactgatttccagagaatctccaagatccacgatcgtgtcttcatcggtctttctggtctcgccaccgatgttcaaacactataccagcgcttggtgtttcgtcataagctttaccagcttagggaagagagagacatgaagcctgaaactttcgctagtcttgtctcagccattctttacgagaagagatttggtccttacttatgccaacctgtgattgctggcttgggagatgatgacaagcctttcatttgcacgatggactctatcggagccaaagagttagctaaagattttgttgtatctggaactgcttcagaatcactctatggagcttgtgaggcaatgtacaagccagatatggaagctgaggaattgttcgagacaatatcgcaagcacttctctcatctgttgaccgtgattgtctgagtggttggggagggcatgtttacattgtaacaccaacagagattaaggagaggatcctaaagggaaggatggattgatctgcttcttctattcaagttgttttccgctgtaatccggttttaagtagtgtaaccttcacatcccggtttaattatatgatcattccttggctgaaattatgggttatgtatgaagtttgattttcctcttggataatggattatatgattttaattcgtagagttatcg

SEQ ID NO: 10659 - DNA, 2864 bp, Glycine max
aacactaaacaagagagagaaaaaaaaagacacttcactccaattccaaacctgttgctgaaaccccaaaaaacttacaacattctatgtttctgttcagaggaagaaggaaaaaaaaaaagttagcgtggttttgttgagttgaaaccgattcagctcaagtcaatccaaacacacatttggagaagaaacaataagtttcatttcgattttcaattattcaatgatggtccaagagcgttcacttcccaaatcagtgaactcgaagccccacgcgcgcacggcggcactggcctccacgaagagcctcgatttctccgcgtgggtctccgacaacctcgtcaggatcgtggcagtggtgctccttgtcgccaccgtcgccgccgtgttcttcctccgcaacgccggcgacaccgccgcgctgctctgcttcgagaaccaggcgcgggagctcgagaggatcgcgtacccgcgcgtggactggtccgcgattgcgccgatcgcggaccggacctcgaagttctcgagctttcgatcggagaaatggatcgtggtgtcggtgtcgggttacccgagtgacgcgctccggcgcctcgtgaagatgaaggggtggcaggtggtggcggtcggagggtctaatacgccgtcggattggaccctcaaaggtgcgatctttttgtctttggaggaacaggtcaatttagggtttagggttgtagattaccttccatatgattcgtttgttaggaagagtgtggggtatttgttcgcgattcagcacggtgctaagaagatttttgatgctgatgatagaggggaggtgatagatggtgatttggggaagcattttgatgtggagttggtaggggaagctgctaggcaagaggttttgttgcagtatagtcatgataaccctaatcgaacagttgtgaacccttatgtgcattttgggcagcgttcggtttggcccagagggttgcccttggagaatgtgggggagattgggcatgaggagttttacactcaggtttttggagggaagcagttcattcagcaggggatttcgaacggcctgccggatgtcgattcggtgttttatttcactaggaagtcggggttggaggcgtttgatatccagttcgatgagcacgcgccgaaggtggcgttgccgcagggcatgatggtgccagtgaattcctttaacacgatgtaccattcgcccgcgttttgggccttgatgctcccggtgtcggtcagcacgatggcctccgatgtgttgagaggttactgggggcagagactgctttgggaggttggtgggtatgttgtggtttaccccccaactgtgcataggtatgataggattgaggcatatccgttttcggaggagaaggatcttcatgtgaatgtaggaaggttgattaattatttgatttcgtggcgatcggataagcataggttgtttgagaagatattggatttgagctttgcgatggcggaggaggggttttggactgagaaggatgtgaagcttacagctgcttggctgcaggatttgttggctgttggctatcagcagccgaggttgatgtcattggagttgggacgtccgagggcaaatattggtcatggggatcagaaagagtttgtgccacaaaagttgccatcagtgcatcttggtgttgaagaaacgggaacggtgaattatgagattgctaatttaatctggtggaggaaaacttttggaaatgtagtgcttatcatgtattgcaatgggccggtggaacgaactgcccttgaatggaggttgctctatgggaggatattcagatctgttgttattttgtcagaaaagaaggatgtagatcttgttgtagaggagggtcatttggactacgcatacaggtacttgcccaaaatttttgatcaatttagcagtgcagaaggatttttgttcgtacaggataataccattcttaattactggaacttactacaagcagataaaactaaactgtggatcactaacaaggtatccgagtcttggtcttctatattaacaaatggtgaggactcagattggttatcacaacaagcaagaatggtacagaaggttgttagcacgatgccagcgcactttcaagtcagttacaaagaaacaagcgacaacgataaaaacctcctaatatgcagttctgaggtgttctatgttcctcagcgccttatcagtgattttgttgagcttgttaaccttgtgggcgacctagaaatccatcagaaggttgcaattcctatgttctttgtctccctagattctcctcagaattttgaccccgttcttgatacaatgatctacaagcaaaatcctcctgcaaattccaccactctttattcggcaaaagtccctgctgttcatccatggagtgtatcaagtgagcaagaatttataaagcttatcagaataatggcagaaggggatccactccttatggagttagtttgaaagtagaaccctttcttcttgataatactacatggcgagagaggatgcaagaaacatgtaacactcagatagcgctcctacacggtctcttcttaatcttaaacagtgttacacagtctttttgtttcttgggtggttttttaacccttctcttttcaccttccttttattgtgtagagatttgttccacagaaaatgtatcattcctaattttttgccccttttttttgtgaaaaatgaaatgaaaatgtatttgtattcaatattgcaattcaagctctccattaagagattctttttttgttatcaacttgatgcgtgtctgatatacagtgcttcctgggaatttgcatgtcgatgc

SEQ ID NO: 10660 - DNA, 2838 bp, Glycine max
gttgcattcaagcttaaggaaccgacacacctgtcggcaaccccaacactaagcaagagaaaggaaaaacacttcactccaattccaaacctgttgctgaaaccccaaaaaaacttagcaacattctatgtttctgttcagaggaaaaaagaaaaaaaacatagcgttgttgtgttgagttgaaaccgattcagctcaagactcaggtcaatccaaatacacatttagaagtttcaattcaatttttcaactcaatgatggtccaagagcgttcacttcccaaatcagtgaacccgaagccccacacgcgaacggcggcactggcctccacgaagagcctcgatttctccgcatgggtctccgacaacctcgtcaggatcgtggcggtgcttctcctggtggccaccgtcgccgccttgttcttcctccgcaacgtcggcgacaccgccgcgctgctctgcttcgagaaccaggcgcgggagctcgagaggatcgcgtacccgcgcgtggactggtccgctatcgcgccgatcgcagacaagacctcgaagttctcgagcttccggtcggagaaatggatcgtggtgtcggtgtcgggttacccgagcgaggcgctccggcgccttgtgaagatgaaggggtggcaggtggttgcggttggagggtccaatacgccgtcggattggaccctcaaaggtgcgatctttttgtccctggaggaacaggtcaatttagggtttagggttgtggattaccttccttatgattcgtttgttaggaagagcgtggggtatttgtttgcgattcagcacggtgctaagaagatttttgatgctgatgatagaggggaggtgatagatgatgatttggggaagcattttgatgtggagttggtaggggaaggtgctaggcaagaggttttgctgcagtatagtcatgataacccgaatcgaaccgtcgtgaacccttatgtgcattttgggcagcgttcggtttggcccagagggttgcccttggagaaggtgggggagattgggcatgaggagttttacactcaggtttttggagggatgcagttcattcagcaggggatttccaatggcctgccggatgttgattcggtattttattttactaggaagtcggtgttggagacgtttgatatccggtttgatgagcatgcaccgaaggtggcgctgccgcagggcatgatggtgccggttaattcgtttaacacgatgtaccattcgtctgcgttttgggccttgatgctcccggtgtcggtcagcacgatggcgtccgatgtgttgagaggttactgggggcagaggctgctttgggaggttggtgggtatgttgtggtttaccctccaactgtgcataggtatgataggattgaggcgtatccgttttcggaggagaaggatcttcatgtgaatgttggaaggttgattaattatttgatttcatggcgatcggataagcataggttgtttgagaagatattggatttgagctttgcaatggcggaggaggggttttggactgagaaggatgtgaagcttactgctgcttggctgcaggatttgttggctgttggctatcagcagccgaggttgatgtcgttggagttgggacgtccgagggcaaatattggtcatggggatcagaaagagtttgttccacaaaagttgccatcggtgcatcttggtgttgaagaaacgggaacagtgaattatgagatttctaatttaatccggtggaggaaaacttttggaaatgttgtgcttatcatgcattgcaatgggccagtggaacgaactgctcttgaatggaggttgctttatgggaggatattcagatctgtagttattttgtccgaaaagaaggatgttgatcttgttgtaggggagggccatttggactatgcatacaggtacctgcccaaaatttttgatcaatttagcagtgcagaaggatttttgttcgttcaggataataccattcttaattactggaacttactacaagcagataaaactaaactttggatcactaataaggtatcggagtcatggtcttctatattaacaaatggtgaggactcagattggttatcacaacaagcaagaatggtacaaaaggttgttagcatgatgccagcccactttcaagtcagttacaaagaaacaagtgacaatgacaagaacctcctaatatgcagttctgagttgttctatgttcctcagcgccttatcagcgattttgttgagcttgttaaccttgtgggggacctagaaatccatcagaaggttgcaattcctatgttctttgtctccctagattctcctcagaattttgaccccgttcttgatagaatgatctacaagcaaaatccccctgcaaattccaccactctttattctgccaaagtccctgctgttcatccattgagtgtatcaagtgagcaagactttataaagcttatcagaataatggcagaaggggatccactcctcatggagttagtttgaaagtagaactctttcttcttgataatacctacatgacgagagaggatgcaagaaacatgtaacactcagatagcgctcctacatggtctcttaatcaaaaacagtgttacagtcttttttgtttcttgggtggttttttaacccttctctttccccctcccctttattgtgcagatttgttccacagaaaatgtatcattcctgattttttgccccttctttttttgtgaaaaatgaaatgaaaatgtatttgtattcaatattgcaattcaagctctccattaagagattcttttttgtgatc

SEQ ID NO: 10661 - DNA, 2537 bp, Vitis vinifera
atgttggtccaagatcgttcaactccgaaatcaccaaaaacccatatcagagcgcttcattctctacacccagatcgcttcactgagcccaaaaacctcgatttctctacatggttctccgaaaacctctacaagatcgtcaccatttcgctcctaatcgccacagtcgcagctctcttcttcctccgcaacgtcgccgacaccgctgctctcgtttcctacgaaacccaagcgaagagccttgagaagatcgaattccctcaaattaattggaattcagttgcactcgtttcagataagtccccttacgcgaattttcgatccgagagatggattcttgtttcggtgtcgaattatccgaccgattcgcttcggaaactcgtgaagattaagggctggcaggtcctcgcaattggcaattcgaagacgccttcagattggagcctcaaaggtgcgatctttttgtctttagaacagcaggcgaatttagggtttcgggtagtggatcacctcccttatgattcctttgttaggaaaaatgttgggtatcttttcgcgatccaacatggcgcaaagaagatctttgatgctgatgatcgtggggacgtgattgataacgatctcggaaagcatttcgatgtagaattgattggtgagggtgctaggcaagatattatactgcaatatagtcacgaaaaccctaatcggaccattgtgaatccctatattcatttcggtcagcggtcggtttggccgaggggattgccattggaaaatgtaggcgagattgggcatgaagaattttacactgaggtgtttggtggcaagcaatttatacagcagggaatttcaaatggcctccctgatgttgattcagtgttctatttcacccgaaaaccaggtttggaggcttttgatattaggtttgatgagcacgctcccaaagtggccttacctcaaggtacaatggtgcccgttaattctttcaatacgctttatcattcttcagcattttgggctttgatgcttcctgtttctgttagtacaatggcttctgatgtgttaaggggttactggggacagaggcttttgtgggaaattggtgggtatgttgtggtttatccccctacagttcatcgatatgatagaattgaatcatacccattttccgaagagaaagatcttcatgtgaatgtaggtcgtttactcaagttcttggtttcatggaggtcaagtaaacatagattgttcgagaagatattggagttaagttatgttatggctgaggagggattttggactgagaaggatgtgaagtttacggctgcttggcttcaggacttgcttgccgttgggtaccagcaaccaaggctaatgtcactagaattggatcgaccaagggcaagcattggtcatggcgaccggaaggagtttattcctcaaaaactaccatcagtccatctcggagttgaggaaacaggggtggtgaataacgagattgggagtttgattcggtggaggaagaattttggtaatgtagtgcttatcatgttctgcagtgggcctgtggaacgtactgcactggagtggcgattgctttatggcaggatattcagaactgtagttattttggcagagcagaagaatgcagatcttgctgttgaagaagggcgcttggactttgtatacaagcaactgctcaatatattttctcgctttacaagcgcagaaggttttttattccttcatgacaataccattcttaattactggaatttgctgcaagcagacaagagcaatctgtggattacagacaaggtatccaagtcttggtcaactgtttcgaccagtggcaactcagattggttttcaaagcaagctgatatggtaaagaaagtagtcagcatgatgccagttcacttccaagtcaattacaaggaaactataaacagtgaccagctcctcacggtatgcagctctgatgtattttacattcctcggcgcttcattgctgactttaccgagcttgttaatctagtggacaatctggaaatccatcacaaggttgcaatacccatgttctttctatcaatggattcacctcagaattttgacccagttcttagtaggatgatttatgaagaaaacccaccttctaccaattcctcaacattttattctgacaaagtaccagctgttcacccctggaatgtgtcaagtgagcaagagttcataaagcttattagaatcatggcagcaggtgaccttcttctgctggagttagtttgaaggcaaggagaggtttttgattcaggggcaaacccaagagaaaggaagaaagaacatgtaccaccttgttagttgttacgccaagttctgtaatttttttcttttttcctgggggaggtttcctattttcttttcccttttgtagattaccttgtatgattcatttactggttggggatctcctccaaaaagaattgttaccttttccactagtttgtgggtatatgaaaaaaaatgttttgttggca

SEQ ID NO: 10662 - DNA, 4463 bp, Vitis vinifera
atgttggtccaagatcgttcaactccgaaatcaccaaaaacccatatcagagcgcttcattctctacacccagatcgcttcactgagcccaaaaacctcgatttctctacatggttctccgaaaacctctacaagatcgtcaccatttcgctcctaatcgccacagtcgcagctctcttcttcctccgcaacgtcgccgacaccgctgctctcgtttcctacgaaacccaagcgaagagccttgagaagatcgaattccctcaaattaattggaattcagttgcactcgtttcagataagtccccttacgcgaattttcgatccgagagatggattcttgtttcggtgtcgaattatccgaccgattcgcttcggaaactcgtgaagattaagggctggcaggtcctcgcaattggcaattcgaagacgccttcagattggagcctcaaaggtgcgatctttttgtctttagaacagcaggcgaatttagggtttcgggtagtggatcacctcccttatgattcctttgttaggaaaaatgttgggtatcttttcgcgatccaacatggcgcaaagaagatctttgatgctgatgatcgtggggacgtgattgataacgatctcggaaagcatttcgatgtagaattgattggtgagggtgctaggcaagatattatactgcaatatagtcacgaaaaccctaatcggaccattgtgaatccctatattcatttcggtcagcggtcggtttggccgaggggattgccattggaaaatgtaggcgagattgggcatgaagaattttacactgaggtgtttggtggcaagcaatttatacagcagggaatttcaaatggcctccctgatgttgattcagtgttctatttcacccgaaaaccaggtttggaggcttttgatattaggtttgatgagcacgctcccaaagtggccttacctcaaggtacaatggtgcccgttaatactttcaatacgctttatcattcttcagcattttgggctttgatgcttcctgtttctgttagtacaatggcttctgatgtgttaaggggttactggggacagaggcttttgtgggaaattggtgggtatgttgtggtttatccccctacagttcatcgatatgatagaattgaatcatacccattttccgaagagaaagatcttcatgtgaatgtaggtcgtttactcaagttcttggtttcatggaggtcaagtaaacatagattgttcgagaagatattggagttaagttatgttatggctgaggagggattttggactgagaaggatgtgaagtttacggctgcttggcttcaggacttgcttgccgttgggtaccagcaaccaaggctaatgtcactagaattggatcgaccaagggcaagcattggtcatggsgaccggaaggagtttattcctcaaaaactaccatcagtccatctcggagttgaggaaacaggggtggtgaataacgagattgggagtttgattcggtggaggaagaattttggtaatgtagtgcttatcatgttctgcagtgggcctgtggaacgtactgcactggagtggcgattgctttatggcaggatattcagaactgtagttattttggcagagcagaagaatgcagatcttgctgttgaagaagggcgcttggactttgtatacaagtaagttgttactatcacatatctttaccttccaactaaattttcactgtcagtggcacggcatctagtttagattctgaatttgttttactttattcttttagataatttwttttttttaatcagaaacaagaaatgtgtatatttgtttcattcttttagataattgaggagaagggattagcagttggaggatagtctggcattatattctgtatggattgttacatttcaagatataggtatactttaatctcggataatctgtcaatcacaatattaggaaaaaatattgttgggcatggctaaaccatgcacatagcaaaagtcatgggaaaatttggacattggctgccaaaatgatttttgacgagtaaatataaatatgacaatggtctagtctgggttttgcactaatagtccttttgtcactttataattgcttgagcctcctttattaagttatctatattgaagattttttmacttttggtttaacttctttcattccagaagtgatataaattataatttacwgaagcaaaaaagaagaatgaagacatgcctatgttatgtgatactataattctatgacattaatatataaaaaaattatagctgcaaaagttgagatgtttgaacacactgccatggagtaaacttgagagcttactagttcaagcatattttcttcaatcaagcacattccttgtctaaagaattaaatttaacctttatgaatatgacaactctagktggtacatgcctatgaacccccckaaaaaaatactctttcgatgttacatatcagttatgaaattatgaatttgagtagatattgtgattgttgctgggttgcaggggggcaggaaagtacatgctagattataagcagtagttgtcatcattacttggtaatggctataagtgataagttcaaaattcctctttaaatgttctcaaagttgaaggtgggatgggttaccacagtttgttctcttggaggtagtttttccaaactggtgttatgttaggtgacagaatatggctaggtttgtctttattagccattacacaggagttgaaatatggcttttatatagtcatacaatagttcagcataatgcccactattactaccaataccctagctgagttgtctacttgtcttgatagccatatactgcaccatctgaggttggtttagggatctcatccaggcaaaagaggtggctttcatcaagtaagaggagacccctttgttccaaatcactgcttccatggacttgggctgtaagaactgaactgtattgacttggttatggttcacatactcaatagaagtaggcaaaagttcaaaattaagtggttggacaacgtcactggtgggttggtttcagaattgacttctagttgaaagcctcttgctaaccgtgtcattattcctgcgcttgtgaaaaggagggtatttatgaagcaagatggctttatatattattgaggttgtgctgatgctcatttgcagcyctattaaactacttttgtaaaattagaaggatgagaagtggacttccctgggaagcttccctctaaaactagaaaaagtgggcactttctgcttttgctgtagagaaggtagtgtaggttttctagaaaaaaaaaattggatctagtctttcctagtaataaatagtccttaggtgttgctttctctatatttttccacttcaaatttcttccatctaaattctggttagggataatgtcaattttaagttgttgcttgctttwaaatttaagtttcttgcaagctttggttgttatgttgtcaatttcttttggctttaggcatgaggttgttgttgatagtgatggaaaaccaattggttgatgtggcattggaaaagttctttctgtattgttgtagctaccccatatcattcatctgaaattttgctaaggtagccccttttcacattttcccttttcttctttctgataatattgtctaattttgcttttcaggcaactgctcaatatattttctcgctttacaagcgcagaaggttttttattccttcatgacaataccattcttaattactggaatttgctgcaagcagacaagagcaatctgtggattacagacaaggtaatatgagtttcaaatactctacatccgggtttttcaataaagagtatgtatgttggccatgcatggggacttgtgctattttattgccatttgccaataaccaacataatcacttaactcttttaactctcaaattcaatggcgttcaggtatccaagtcttggtcaactgtttcgaccagtggcaactcagattggttttcaaagcaagctgatatggtaaagaaagtagtcagcatgatgccagttcacttccaagtcaattacaaggaaactataaacagtgaccagctcctcacggtatgcagctctgatgtattttacattcctcggcgcttcattgctgactttaccgagcttgttaatctagtggacaatctggaaatccatcacaaggttgcaatacccatgttctttctatcaatggattcacctcagaattttgacccagttcttagtaggatgatttatgaagaaaacccarcttctaccaattcctcaacattttattctgacaaagtaccagctgttcacccctggaatgtgtcaagtgagcaagagttcataaagctmattagaatcatggcaycaggtgaccttcttctgctggagttagtt

SEQ ID NO: 10663 - DNA, 4438 bp, Vitis vinifera
atgttggtccaagatcgttcaactccgaaatcaccaaaaacccatatcagagcgcttcattctctacacccagatcgcttcactgagcccaaaaacctcgatttctctacatggttctccgaaaacctctacaagatcgtcaccatttcgctcctaatcgccacagtcgcagctctcttcttcctccgcaacgtcgccgacaccgctgctctcgtttcctacgaaacccaagcgaagagccttgagaagatcgaattccctcaaattaattggaattcagttgcactcgtttcagataagtccccttacgcgaattttcgatccgagagatggattcttgtttcggtgtcgaattatccgaccgattcgcttcggaaactcgtgaagattaagggctggcaggtcctcgcaattggcaattcgaagacgccttcagattggagcctcaaaggtgcgatctttttgtctttagaacagcaggcgaatttagggtttcgggtagtggatcacctcccttatgattcctttgttaggaaaaatgttgggtatcttttcgcgatccaacatggcgcaaagaagatctttgatgctgatgatcgtggggacgtgattgataacgatctcggaaagcatttcgatgtagaattgattggtgagggtgctaggcaagatattatactgcaatatagtcacgaaaaccctaatcggaccattgtgaatccctatattcatttcggtcagcggtcggtttggccgaggggattgccattggaaaatgtaggcgagattgggcatgaagaattttacactgaggtgtttggtggcaagcaatttatacagcagggaatttcaaatggcctccctgatgttgattcagtgttctatttcacccgaaaaccaggtttggaggcttttgatattaggtttgatgagcacgctcccaaagtggccttacctcaaggtacaatggtgcccgttaattctttcaatacgctttatcattcttcagcattttgggctttgatgcttcctgtttctgttagtacaatggcttctgatgtgttaaggggttactggggacagaggcttttgtgggaaattggtgggtatgttgtggtttatccccctacagttcatcgatatgatagaattgaatcatacccattttccgaagagaaagatcttcatgtgaatgtaggtcgtttactcaagttcttggtttcatggaggtcaagtaaacatagattgttcgagaagatattggagttaagttatgttatggctgaggagggattttggactgagaaggatgtgaagtttacggctgcttggcttcaggacttgcttgccgttgggtaccagcaaccaaggctaatgtcactagaattggatcgaccaagggcaagcattggtcatggcgaccggaaggagtttattcctcaaaaactaccatcagtccatctcggagttgaggaaacaggggtggtgaataacgagattgggagtttgattcggtggaggaagaattttggtaatgtagtgcttatcatgttctgcagtgggcctgtggaacgtactgcactggagtggcgattgctttatggcaggatattcagaactgtagttattttggcagagcagaagaatgcagatcttgctgttgaagaagggcgcttggactttgtatacaagtaagttgttactatcacatatctttaccttccaactaaattttcactgtcagtggcacggcatctagtttagattctgaatttgttttactttattcttttagataattttttttttttaatcagaaacaagaaatgtgtatatttgtttcattcttttagataattgaggagaagggattagcagttggaggatagtctggcattatattctgtatggattgttacatttcaagatataggtatactttaatctcggataatctgtcaatcacaatattaggaaaaaatattgttgggcatggctaaaccatgcacatagcaaaagtcatgggaaaatttggacattggctgccaaaatgatttttgacgagtaaatataaatatgacaatggtctagtctgggttttgcactaatagtccttttgtcactttataattgcttgagcctcctttattaagttatctatattgaagatttttttacttttggtttaacttctttcattccagaagtgatataaattataatttactgaagcaaaaaagaagaatgaagacatgcctatgttatgtgatactataattctatgacattaatatataaaaaaattatagctgcaaaagttgagatgtttgaacacactgccatggagtaaacttgagagcttactagttcaagcatattttcttcaatcaagcacattccttgtctaaagaattaaatttaacctttatgaatatgacaactctagctggtacatgcctatgaaccccccaaaaaaaatactctttcgatgttacatatcagttatgaaattatgaatttgagtagatattgtgattgttgctgggttgcaggggggcaggaaagtacatgctagattataagcagtagttgtcatcattacttggtaatggctataagtgataagttcaaaattcctctttaaatgttctcaaagttgaaggtgggatgggttaccacagtttgttctcttggaggtagtttttccaaactggtgttatgttaggtgacagaatatggctaggtttgtctttattagccattacacaggagttgaaatatggcttttatatagtcatacaatagttcagcataatgcccactattactaccaataccctagctgagttgtctacttgtcttgatagccatatactgcaccatctgaggttggtttagggatctcatccaggcaaaagaggtggctttcatcaagtaagaggagacccctttgttccaaatcactgcttccatggacttgggctgtaagaactgaactgtattgacttggttatggttcacatactcaatagaagtaggcaaaagttcaaaattaagtggttggacaacgtcactggtgggttggtttcagaattgacttctagttgaaagcctcttgctaaccgtgtcattattcctgcgcttgtgaaaaggagggtatttatgaagcaagatggctttatatattattgaggttgtgctgatgctcatttgcagcgctattaaactacttttgtaaaattagaaggatgagaagtggacttccctgggaagcttccctctaaaactagaaaaagtgggcactttctgcttttgctgtagagaaggtagtgtaggttttctagaaaaaaaaaattggatctagtctttcctagtaataaatagtccttaggtgttgctttctctatatttttccacttcaaatttcttccatctaaattctggttagggataatgtcaattttaagttgttgcttgcttttaaatttaagtttcttgcaagctttggttgttatgttgtcaatttcttttggctttaggcatgaggttgttgttgatagtgatggaaaaccaattggttgatgtggcattggaaaagttctttctgtattgttgtagctaccccatatcattcatctgaaattttgctaaggtagccccttttcacattttcccttttcttctttctgataatattgtctaattttgcttttcaggcaactgctcaatatattttctcgctttacaagcgcagaaggttttttattccttcatgacaataccattcttaattactggaatttgctgcaagcagacaagagcaatctgtggattacagacaaggtaatatgagtttcaaatactgtatgtatgttggccatgcatggggacttgtgctattttattgccatttgccaataaccaacataatcacttaactcttttaactctcaaattcaatggcgttcaggtatccaagtcttggtcaactgtttcgaccagtggcaactcagattggttttcaaagcaagctgatatggtaaagaaagtagtcagcatgatgccagttcacttccaagtcaattacaaggaaactataaacagtgaccagctcctcacggtatgcagctctgatgtattttacattcctcggcgcttcattgctgactttaccgagcttgttaatctagtggacaatctggaaatccatcacaaggttgcaatacccatgttctttctatcaatggattcacctcagaattttgacccagttcttagtaggatgatttatgaagaaaacccaccttctaccaattcctcaacattttattctgacaaagtaccagctgttcacccctggaatgtgtcaagtgagcaagagttcataaagcttattagaatcatggcagcaggtgaccttcttctgctggagttagtt

SEQ ID NO: 10664 - DNA, 2747 bp, Arabidopsis thaliana
aaagaagaaaagaacccaaagttttgcaattgcattgaccttacagctcacagagactctcagacttggctttcctatcaaagctcttttacatttgcattcaagcttaagcaacgtcaattccaactacaacaaccgcattactttcacttgcaaacaaaacacgaatccaaaacttccatttttgttcacaaatctcagcttcttctgattcaaaaagttttgagctttattgatccaatgttggttcaggatcgtgcggcgccttctcctgccaagccgccgaaatctcagatcagagaactacctactcatcaacagatccgacgacgattcagtgaacccaaaaacttagatttctcgacttggttctctgagaatctctctagaattgctgtcttctctctcttaatcgtcaccatagtagctttcttcttcctctacaacaccaccgacactgcttctctcctttgtttccagtctcagtcaactcaatttcttcaatctctctctcgccctcaaatcaaatggaattcgatcccagtcgtccctgataaaacctccccgtacgctaatttccagacagagaaatggattgttgtgtcggttaccaagtacccaactgaggagctcaagagcttggtgaagattcgtggatggcaggttctagctattggaaactcggcgacacccaaggattggagtcttaaaggttccatctttttgtctctcgatgctcaagctgaattgggttatcgagttttagatcacttgccttatgattctttcgtaaggaagagtgttggttacttgttcgcgatccagcacggtgcgaagaagatctatgatgctgatgatcgtggtgaagtgattgatggagatctaggcaagcattttgatgttgagttagttggtctagattctaagcaagaaccgattttgcagtatagtcatgagaaccccaataggactgtggttaatccttatattcatttcgggcaacgttccgtttggcctagaggtttgccattagagaatgtaggtgagatcaatcatgaggagtattacactgaggtttttggtggtaagcagtttatacagcaagggatttctaacggtttaccggatgttgattcggtgttttacttcactaggaagacgactttagaagcttttgatattaggttcgatgagcattctcctaaagttgctttacctcaaggtgtgatggtgccggttaattcgtttaacactctttaccattcgtcagccttttgggggttaatgcttcctgtttcggttagttccatggcttctgatgtgctgagaggttactggggacaaaggcttttgtgggagcttggtggttatgttgctgtttatccacctacagctcaccggtttgatagaatcgaggcttacccttttgtagaggagaaggatcttcatgttaatgttggtcgtttgatcaagttcttacttgcttggagatcagagaagcatagtttctttgagacggtccttgatttgagctttgctatggctgaagaagggttttggacagaacaggatttgaaattcacagctgcttggcttcaggatttgattgctgttgggtaccaacaaccgagattgatgtcgctggaattggatcgcccgcgagcaagtatcggtcatggagatagaaaagagtttgttccaaggaagttaccttcggttcatctcggggttgaggagactggcacagtgagcactgaaatagggaacttgattaggtggaggaagaattttgggaatgttgtgctggttatgttttgtaacggtcccgttgaacgtaccgcactcgagtggaggttactttatggccggatattcaaaactgttgtgatactttcttctcagaagaactcagatctctatgtagaagaagccaaactcgatcacatttacaagcatctaccaaagatatttgatcgatacagcagcgcagaaggatttttgtttgttgaagatgatacagttctcaattactggaatctacttcaagctgacaaatctaagatttggactacagacaaggtatcaaagtcttggacatcagtgaaaccgaccgggaactctgattggttttctgtacaagcagagttagtgaagaaaactgtaagtacaatgccagctcatttccaagttaactacaaggacgccaccaagaacaatcatgagaccttaacagtatgcagttcagaggtattctatgtgcctaaaagactggtaactgactttatcgatcttgttgatctcgtgggcgatatggacttgcattacaaagtggctgtgccaatgttcttcttgtctatggattcgcctcagaattttgacccggttctcggttcaatggtatataagaggaaatcagcttcgtttaacacttcttcgagtctgtattctgctaaagcacctgcggttcacccgtggagcatatcaagcgaacaagatttcatcaaattggttcagcaaatggctgagggcgacccgcttctgatggagttggtatgatggactcagggtatagagcttgcagtaatgcaatgatagaaacagagttatacaaaaattgtgtttttgattcttttcttattggttcccttttcagaatttttttcttctgggggttgtgaagaaagtcatgtaatgttccattgtaaccatacgttttgtgagtgtatgatatttccccatctaaaatc

SEQ ID NO: 10665 - DNA, 1192 bp, Populus tremula x Populus alba
cgaattgctgccaagctggagatgatggaaccttgttcgagtgtcaaagacaggattgggtatagtatgatcacagatgcagaggagaaggggcttatcaaggcgggtgagagtgtcctgattgagcctacgagtggcaatactggcatagggctggcattcatggcagctgctaagggctacagattgataattaccatgcctgcttcgatgagtctagagagaagaatggttctccttgcttttggagctgagttggtccttactgatccagccagaggtatgaagggggctgttcagaaggcagaagagatatcggcaaagacacctaattcttatattctgcaacaatttgaaaatcctgccaacccaaaggttcactatgacacaactggaccagagatctggaaaggctcaggtgggaaagttgatgcctttgtttctgggatagggaccgggggtacaataactggagcagggaagtatctcaaggagcaaaaccctgatataaagctttatggtgtagaaccggttgaaagtgcagtgctgtctggagggaaacctggtccacataagatccagggaattggtgctggctttatacctggagttttgaatgtcgatttacttgatgaaactgttcaaatatcaagtgaagaagcaattgaaactgcaaagcttctcgccttgaaagaaggactgctggtagggatatcatctggagctgctgcagctgctgcaattaagatagcaaagaggcctgaaaatgctggaaaactcattgttgcgatcttccctagttttggagagcgttacctatcctctgtgctttttgaatcagtgaagaaggaggccgagaacatggtttttgagccttgaggtgaagaacatggctttcagcaaattctgattgaggttttgacaatttcctttttcatggtttatgagcctgacacttgggttgcaaataatgtggaggcatttctgctccatgcatttgtatttaacaaagggctcgtgggatggattaagaacttgaatcatagtgtcgggagaccaagttccataatagtgttttgaattgctattcactgtttgttcctcgttcaaatcacttctgtcatttgatttgaatgggcactcctttcatcttattactcacgattggtactaatattgaatgaattgcgtc

SEQ ID NO: 10666 - DNA, 951 bp, Glycine max
ccagcatttccaatcaaggtttgtgcagctgctaattattaaaatgacgagaacgaggataaagataaagaaaatcgacaacataacggcgaggcaggtaacattttctaagaggaggcgagggctattcaagaaagctgaagagctttctgtgctatgcgatgctgaggttggtctcattgttttctcatctaccgggaagctctttgattatagcagctccagtatgaatgacatagttacaaagtacagtacgcattcccatggcatcaacaaattggataagccatcactagaactgcagctagaagctagcaatagcgccaaattgagtaaggaaattgcagatagaacccaagaattaagttggttgaaaggcgacgatcttcaaggactaggtctaaatgagttgcagcaactggagaaaacacttgaaataggactcgatcgcgtgactgacataaaggaaaatcagataatgagccagatttctgaacttcagaaaaagggaatcctgttagaagaggagaacaagcatttaacgaaaaagctagcggagaaggagaaggaggctatgctgtgtaaggcaaaaattcctttcatggtggactcagataagggaataatgcaggaagaaggtgtctcgttagattctacaaataacattagtagttgcatcagtgatcctcctctcgaggatggttcctcggacatatctcttacgttagggctacccttctctaactgaagaggtaacatggtgaaagagtcttgccccgttttgagcgttattaagattttttttcttaaaactgtaccaatattttttttaattaagaaaaaaactgcaccactatatatatgtttttgttggatttgtttataagtgagaagtgtattaaaaagtaaaatgtatgattgttagctaaaccaatgaaatatattttatat

SEQ ID NO: 10667 - DNA, 702 bp, Glycine max
atgacgagggcgaagataaagataaagaaaatcgacaacataacggcgaggcaagtaacattttctaagaggaggcgagggctgttcaagaaagctgaagagctttctgtgctatgcgatgctgaggttggtctcattgttttctcatctaccgggaagctctttgattatagcaacgccagtataaatgacataattacaatttataatacgcactcccatggcgtcaacaaattgggcaagccatcactagaattgcagctagaggctagcaatagcgccaaatttagtaaggaaattgtagatagaacccaagaattaagttggttgaaagacgatgatcttcaaggactagggctaaatgagttgaagcaatttgagaaaacaattgaaataggactcgatcgcgtgattgagataaaggaaaagcaaataatgagtcagatttctgaacttcagaaaaaagggaatctgttggaagaagagaacaaacatttaaagaaaaagttagtggagacagagatggaggctatgctgtgtgagccagaaattcctttcatggtggacttagataagggaataatgcaggaagaaggtgtctcactagattctacaaatagcattagtagtttcatcaatgatcctcctcccgaggatggttcctcaaacatatctcttacgttagggctaccccttctctaa

SEQ ID NO: 10668 - DNA, 1441 bp, Vitis vinifera
cactgaggctctctgtaaaaccagaggctctctgtctctagggttctccataaaccctagatttgctgacaaaatctgacgccaacaatggccggattcgttcctccgccagcacctccggctcctcctgccccacctaagcccgatgagaaagtcgactacctcgatcttccttgccccatcccctacgaagaaatccaccgcgaagctctcatgtctttaaagccagagctttttgaggggatgcggtttgactttaccaaggggctcaatcagaaattctcactcagtcacagcgtgttcatggggcccactgaaattccttctcaatcctctgaaactattaaaatcccaactgctcattatgagtttggcgctaactttatagacccaaagttgatgctttttgggagaatattgaccgacgggaggctgaatgcaagagtgaagtgtgatttgactgaaaatctcactctgaaggctaatgctcagcttacaagtgagccacatatgtcacatggcatggttaattttgattacaagggtggtgattacaggactcaacttcaacttggaaatggtgctttatttggagctagttacatccagagtgtgaccccttatttgtctttgggtggtgaagttttttgggctggtcagcatagaaagtcaggaattggttatgctgctcgttacaataccgataagatggttgcaacaggacaagttgctagcactggcatggttgctctgagctatgttcagaaagtatcagagaaggtttctttagcatcagatttcatgtacaattatatgtcaagagatgtcactgcaagttttggttatgattacatccttcgacagtgccgtcttaggggaaagattgactccaatgggtgcacagctgcttttcttgaagagcgattgaatatgggtcttaatttcattctttctgcagagatagatcaccggaagaaagactacaaatttgggtttgggctgacagtaggagaatagaatagattagaaggcaatttgtgctgttttcttctcagttttatcacacattgttgccagcaactcagcaagttattctgggttggtttttccttggttggaaggttcacagatcggttttgtgcttctctctcggcaaacattatttgtggggcagcgtcagctgcttcaacagttttagcaatcgtaatttttggcatttcagagatgtaggaatcataatttatcaaaattgagatatgattttaatggtgtgtttgcatgatgaaataaacatgcagctagatgttggacattgatgatatgtatgataaagccaaaagtacagtgattgctattatgggagagacagtcgattcatctgcctattccaactttcaactataatagaaaattcatcaatgatactatctgttaaacctta

SEQ ID NO: 10669 - DNA, 1344 bp, Glycine max
agcagtggtggaagggttgttgagaaggggttttagaagtccacatttttcagatttgattcgcgttcctcttctctcttctcatcatcaatggcgacccccattcctccccctcctgccgccgccgccgccgccgccgccgacaccaaggtcgattacttgaaccttccatgtccgattcccttcgaagagctccatcgcgaagctatgatgtctttgaagccagatctttttgagggcatgcgttttgatttcaccaagatgctcaatcagaagttctccctcaatcacagcgtgttgatgggacctactgaggttccttctcagtccacggagacaattaagattccaactgctcactatgagtttggctcaaccttcattgatcaccctaggttgttgctctggggcagaattttgactgatgggaggctcaatgccagagtcaagtgtgatttgtccgaaaatctcacttttaaagccaatgctcagctcacaaatgagccgcatatgtctcatgcgatgatcaactttgattacaagggaaaagactataggacacaatttcaacttggtaatggagccttgctaggagcaagttatattcagagtgtgacacagcatttatcattgggtggggaggtattttgggctggtcagcatcggaagtctggtattggttatgctgctcgctacaacactgataagtcggttgctacagggcaagttgctagcactggaatggttcttctaagctatgttcagaaggtatctgagaaggtttctctagcatctgagtttatgtgcaactacttgtcaagagatgtcacagctagctttggttatgactacatccttagacagtgccgccttaggggaaagattgattccaatggctgtgtcgctgcttttttggaggagcggttaaatatgggtctgaattttattctttctgcagagcttgaccacaggaaaaaggactacaaatttgggtttggtttgactgtgggagaatgaataaaccgaactggagctgtgttttcattgctgtacccagcttagcaagctttcttgcatctttttccttgttggagatttttctttccaaaaaagaaaagaggaaatatcgtttgtgtcgggaaacactatttacaatccacaagtagctgcagaattttcaatagtcatcaatttatttggaacttgggcagaaaaaactcgatttatttggatctattgccctgttttcccttgagggggatgtagagtgatatcagtttaatccatattgtgagatcaatttccataatgtttctagtgctcgtgtatctatccctgtcctat

SEQ ID NO: 10670 - DNA, 1455 bp, Glycine max
cgcttggtacgggtcgggtccatgtgtaagccgcaaggaaggtgtgttatgtataagcataggagaaaagtaaactagggttttagcagtggaagctttgttgagaaggaaggggttttagaatagaactccacatttttaagatttgatttgtttttctcttctcttctcatcatcaatggcgaccctcattcctccccctcctccccctcctcctcctcctgccgccgccgccgaccccaaggtcgattacttgaacctcccatgtccaattcccttcgaagagctccatcgcgaagctatgatgtctttgaagccagatctttttgagggcatgcgttttgatttcaccaagatgctcaatcagaagttctccctcaatcacagcgtgttgatgggacctactgaggttccttctcagtccacggagactattaagattccaactgctcactatgagtttggctcaaccttcattgatcaccctaggttgttgctctgggggagaattttgactgatgggaggctcaatgccagagtcaagtgtgatttgtccgaaaatctcacttttaaagccaatgctcagctcacaaatgagccgcatatgtctcatgcgatgatcaactttgattacaagggaaaagactatagaacccaatttcaacttggtaatggagccttgctaggagcaagttatattcagagtgtgacacagcatttatcattgggtggggaggtattttgggccggtcagcatcggaagtctggtattggttatgctgctcgctacaacactgataaatcggttgctaccgggcaagttgctagcactggaatggttcttctaagctatgttcagaaggtatctgagaaggtttctctagcatctgagtttatgtgcaactacttgtcaagagatgtcacagctagctttggttacgactacatccttagacagtgccgccttaggggaaagattgactccaatggctgtgttgctgcttttttggaggagcggttaaatatgggtctgaattttattctttctgcagagcttgaccacaggaaaaaagactacaaatttgggtttggtttgaccgttggagaatgaataagccggactagagctgtgttttcattgctgtagccagcttagcaagctttcttgcatccttttccttgttggagatttttcttaacgaaaaagaaaagaggaaatatcgtttgtgtcgggaaacacactatttacaatccacaagtagctgcagaattttcagtagtcatcaatttatttggaacttagccgaaaaaactttatttatttggatctattgccctgttttcccttgcgggggatgtagagtgatatcagtttaatgcatattgtgagattcaatttcaataatgtttctagtgctcgagtatctatccatgtcctatacttttaaatgaccc

SEQ ID NO: 10671 - DNA, 1324 bp, Glycine max
gggcagtggtggaagggttgttgagaaggggttttagaagtccacatttttcagatttgattcgcgttcctcttctctcttctcatcatcaatggcgacccccattcctccccctcctgccgccgccgccgccgccgccgccgacaccaaggtcgattacttgaaccttccatgtccgattcccttcgaagagctccatcgcgaagctatgatgtctttgaagccagatctttttgagggcatgcgttttgatttcaccaagatgctcaatcagaagttctccctcaatcacagcgtgttgatgggacttactgaggttccttctcagtccacggagacaattaagattccaactgctcactatgagtttggctcaaccttcattgatcaccctaggttgttgctctggggcagaattttgactgatgggaggctcaatgccagagtcaagtgtgatttgtccgaaaatctcacttttaaagccaatgctcagctcacaaatgagccgcatatgtctcatgcgatgatcaactttgattacaagggaaaagactataggacacaatttcaacttggtaatggagccttgctaggagcaagttatattcagagtgtgacacagcatttatcattgggtggggaggtattttgggctggtcagcatcggaagtctggtattggttatgctgctcgctacaacactgataagtcggttgctacagggcaagttgctagcactggaatggttcttctaagctatgttcagaaggtatctgagaaggtttctctagcatctgagtttatgtgcaactacttgtcaagagatgtcacagctagctttggttatgactacatccttagacagtgccgccttaggggaaagattgattccaatggctgtgtcgctgcttttttggaggagcggttaaatatgggtctgaattttattctttctgcagagcttgaccacaggaaaaaggactacaaatttgggtttggtttgactgtgggagaatgaataaaccgaactggagctgtgttttcattgctgtacccagcttagcaagctttcttgcatctttttccttgttggagatttttctttccaaaaaagaaaagaggaaatatcgtttgtgtcgggaaacactatttacaatccacaagtagctgcagaattttcaatagtcatcaatttatttggaacttgggcagaaaaaactcgatttatttggatctattgccctgttttcccttgagggggatgtagagtgatatcagtttaatccatattgtgagatcaatttccaaaaaaaaaaaaaaaaaa

SEQ ID NO: 10672 - DNA, 1489 bp, Medicago truncatula
ctttgggaacgaacgaacgaaacaagggttttagaaaatcaattccgaatctctctctttctctgatctctaacaatggcgactatggttccaccgattcccaccgccgacgacaagaaggtcgatcagaaagttgattactctaacctttcttgtcccattgccttcgaagaacttcatcgcgaagctatgatgtctttgaagcctgagctttttgagggtttgcgttttgatttcaccaaaatgcttaatcagaaattctctcttaatcacagtgtttcgatgggacctactgagattccttctcagtctgcggaggttattaaaattccaactgctaactatgaatttggcgctaacttcattgatcatcctaagctgttgcttttgggaagagctatgactgatggaagagtaactgcaagagtcaagtatgatgtgtttgacaatctcactttgaaagctaatgctcagctaacaagtgagccacatatgtcgcaagggatgatcaactttgattacaagggaaaggattataggacacagtttcaaatggggaatggagccttgctaggggcaagttatattcagagtgtgacaaatcatttatcgttgggtggagaggtattttgggctggtcagcatcggaagtctggtgtaggttatgctgctcgctacaacactgataaaatggttgccacaggacaagttgccagcactggaatggttcttttaagctatgttcaaaaggtttctgaaaaggtttctctagctgctgatctgatgtgtaactacttgtcaagagacgtcactgctagctttggttatgactacatcctcagacagtgccgccttaggggaaaggttgattccaatggtgtttgtgctgcttttttggaggagaggttaaacatgggtctgaatttcattctttctgcagagcttgatcacaagaaaaaagactacaaatttggatttggtttgaccgttggagaataaattagagctggagtcagagctgtatttccatttcctttagccagactagccttgcaagttttcttgcttctttttacttgttgggaatttttctttttgaaaagaagaaaacaaaggaggaatatatcatttgtgtcggcaaacatcatttgttatccacaagttgacccaacaatacttcaaatttatttggaactcttgccctgttttcccttgagggggaaggatgtagagtgatagtagcagatcaatgcatattttgcgattcaatttcaacatgctcataatgctcgttatgctaatataaatcgatttcttacttttaatgatctatgaaactcggcagcaagaatgacttcttgaagtccttgaataatttggtgatttgttcaagatttggtgggttttcacacattcttgtaagacttcttggaggactttactatgtaagaattaatcaagttaataaaggttttagaaacagcttgtc

SEQ ID NO: 10673 - DNA, 765 bp, Glycine max
  misc_feature (397)..(397): n is a, c, g, or t
  misc_feature (430)..(430): n is a, c, g, or t
atgccgatggaactggagttggagctaggttcaacaacaattcaacgttccttcgacgcgcgctacacgcgccacacacgtgacttgcttgacgaattgcctgacagcttcaccgtcaccgacccctccatcctgggacaccccatcgtgtttgccagcccaggcttcctcaagctcacgggctattcccttcgcgaagtcctgggtcggcccacagccatcttccagggcccactaacattcccaaaatccgtaattgaaattcgcaaggttgttagagaggagcgaaacgcgcaggtcattttacccaaatctgtcgtgcactttgttgccgtataggtaccacttcagaaaaaggaagggtccggggtgagggatttcgggtttgagtgttgtncgaaggaagtgtgtgtggattcgttggcggagnatgattgcgtttgttcattagaacaagtgcccgaacctgatgtcagagaagtggagagagaagagttgtgtgaggcgagtgatgatgagaagtgaagtgttgttactgccatggacagtatattttatgtgctaacccattacagtgaggccacggggagattggtgtgtagaaagaggtccaacattcctgatgtaggtcttttaagcacatccttgattatttctcttggtagaatcaaacaaagctttgtattaactaatctgcatttaccagacatgcctattgtttatgccagtgacaccttcttggaattgacaaattctgtttcataa

SEQ ID NO: 10674 - DNA, 813 bp, Glycine max
  misc_feature (418)..(418): n is a, c, g, or t
atgagttcacttccttccaacagcttcaccatcaccgacccctccatcccgggacaccccatcgtcttcgccaacccaagcttcctcaagctcacgggctactccctccgcgaagtcctgggctggcccgcagccatcttctcgggcccattaacatcccaaaaatttgtaatcaaaattcatgaaatcgttagagaggagcgaaacgcgtaggtcattttgctcaactaccacagagatggtatgccgttttggatgcttttttgtgtttcccctattttcagtagcgacggtggcgctgtcgtgcactttattgttgtacaggtaccgcttcagaaaaaggaatgagggtccggagtaagggatttcgggttcgggtgctatcggaaggaagtgtgcgtggattcgttggcggagnatgatcgcatttgttcattggagcaattgctcgaacctgatgttagagaattggagagagaagagtcgtgtgaggcgagtgatgatgagaagcgaagtgttgttactgccatggactgtatattttctgtgctaacccattacggtgaggccacagggagattggtgtgtagaaagaggtccagcattcctgacgtgggtcttttaagcacatccttgattatttctcttggtagaatcaaacaaagctttgtattaactaatccgcatttaccagacatgcctactgtttatgctagtgataccttgttgaatttgacaggttttaaagtcgttaccttatataaattagatcaagttcaaatgaacttattaatattctcccatagttcatag

SEQ ID NO: 10675 - DNA, 1467 bp, Glycine max
gtggcattgccgtggacattttcttcttagctaaataagataaacacttccaattttgagacttttccttcgcacccttttgcatcttttagtgttttttctttatgagttttgctggttttggtccaacaacatagtgttttcatcatgggaaacgcttgtgcaaaaggaaaaccagttgctcatgtctcttcctccaatttttctggaggtaagaagcatgcaagtaggccaaagcagtattcaaattcttctgaacaactatctgctccaataacttcagaattaaatgttcccaaatccttctccagtaacctaaaatccttcagcttgaatgatcttaaagaggccactaagaacttccggcaagaaaatttaattggagagggaggattcgggcgcgtcttcaaaggatggatcgatgagaacacatatggtcccaccaaaccaggcactggaattgtagtggccattaaaaacctaaagccagaaagcttccaaggccacaaggaatggcttcaagaagtgaattatcttggacagcttcagcatgaaaatttggtgaaacttattggctattgcttggaaggtaaaaacaggcttctggtttatgagttcatgcaaaaaggaagtttggagaatcatttattcaggaaaggtgttcaacctatggcttgggttacaagggtcaacattgcaattggtgtagcaagaggattaacactcttacattccctggatcaaaatgttatctttcgtgatttaaaggcttccaacatcctacttgattcggacttcaatgcaaagctttcagatttcggcttggcaagagacggtcccactggagataatactcacgtttcaactagagttttaggaactcaagggtatgctgcaccagagtatgttgctacaggtcatttgaccccaaggagtgatgtatacagctatggtgtagtcttgttagagttactaactggaaggcgcgcggtggaagacgatagacctggattttcagaggaaaccctggtggattgggcaaagccattcttgagtgataacagaagagttttgagaataatggatacaaagttggggggtcaatactccaagaaaggagcacaagctgcagctgcacttgcattgcagtgcctcaacatagacccaaaatttagaccacctatggtggaagttctagcagcattggaagcacttaattcctcaaattcatttacaaggacaccaaaacatgagagtcatgcaaccaaacaatctggtggcccttcacaaaagtaaaatggaaatgcaaagtatatatgagctacttacttggcttgttctcattcactttttgggtgaatacttctatatccatccataaagataagaacaaaagaatactatatatgttataccaacaaatgatttgttctttcatttctttgcctatgaagaattgccatcttt

SEQ ID NO: 10676 - DNA, 1701 bp, Glycine max
catcgaagcaactattctatttttaattattttttggttgaacctgaaattgacgactctgcctcttctgctaactgtggcatagccgtggacattttcttattcttggttaaacttaaatcagataaatacttccaatttcgagacttctcgttcacaccctttttcatcttcttttgttttttcttcatgaattttgttggtttggtctaacaaaatagtttttcatcatgggaaacgcttgtgcaaaaggaaaaccagttgctcatgtttcttcctccaatttctctggaagtaagaagcctgcaagtaagccaaagcagtattcaaattcttctgaacaacgatctgctccaacaacttcagaattaaatgttcccaaatccatctccagtaaccttaagtccttcagcttgaatgatctaaaagaggcaactaagaacttccggcgagaaaatttaatcggagagggaggatttgggcgtgtcttcaaaggatggattgatgagaacacatacggtcctacaaaaccaggcactggaattgtagtggccattaaaaatcttaagccagaaagcttccaaggccacaaggaatggcttcaagaagtgaattatcttgggatgcttcagcatgaaaatttggtgaaacttattggttattgcttggaaggtaaaaaccggcttctggtttatgagttcatgcaaaaaggaagtttggagaatcatttattcagaaaaggtgttcaacctatggcctgggttacaagggtcaacattgcaattggtgttgcaagaggattaacattcttacattccctggatcaaaatgttatctttcgtgatttaaaggcttccaatatcctacttgattcggacttcaatgcaaagctttcggatttcggcttggcaagagatggtcctactggagataatactcacgtttcaactagagttataggaactcaagggtatgctgcaccagagtatgttgctacaggtcatttgaccccaaggagtgatgtatacagctttggtgtagtcttgttagaattactaaccggaaggcgtgcggtggaagacgatggacctggattttcggaggagaccctggtggattgggcaaagccattcttaaatgataacagaagagttctgagaataatggatacaagattggggggtcaatactccaagaaaggagcacaagctgcagctgcacttgcattgcaatgccttaacactgaccccaaatttagaccacctatggtggaagttctagcagcattggaagcacttaattcctcaaattcatttacgcggacaccgaaacatgagagtcattcaaccaaaatatctggtggtccttcacaaaagtaaaatggaaatgcaaagtatatctgagctacttggcttgttctctttcactttttgggtgaatactttctatattcatccgtaaagaaaagaacataagaatactatgttatacccacaaatgatttgtcctttcatttctttgcatatgcgaagaattgccatctttgcgggttattgagtgtagagtatacattgtggtagcagctatagattcttattacattgtatgaaattttttagcttttaggatggctatatacaaatttggaaaaaaaaaattaaagttaataatggatatgtttaagcgggtatttttttcttc

SEQ ID NO: 10677 - DNA, 1493 bp, Medicago truncatula
cttagatgagtgttgtgtacttttctgaggataacaaagagagaacaaaagaataacactttcatcatgggaaacacttgcagaaaaccagtttgtcatgattcctcaccaagtttatttggaagtacaaatactcaaagtaacataaagcagacttcggattctcctgaccagaaaaccgattcgaaaacttcatcatcaaatgatgacaaatcgatctctaaagatgttaagtccttcagcttcaatgatctaaaggaggcaactaggaactttcggcaagaaaatttaataggggaaggagggtttggattcgtctacaaaggatggatagatgaaaacactggtgctccaacaaaaccaggaaatggaattgtagtagccattaagaagcttaagccagaaagttttcaaggccacaaggaatggcttgcagaagtcaattatctaggccaacttcaccatgaaaatttggtgaagcttattggttactgttcagaaggtaaaaacaggcttctggtttatgagtttatgcagaaaggaagtttggaaaatcacctgttcagaaaaggtgttcaaccaatttcctggatgacacggatcagtattgcaatcggtgtggcaagaggactagcattcttacattcccttgatgcaaatgttatttatcgtgatttaaaggcttccaacatcctacttgattcggatttcaatgcgaatctttccgattttggcttggcaagagatggtcctaccggagataacactcatgtttcaactcgaattattggaactcatggttatgctgctccagagtatgtagctacaggtcatttaacactaaggagtgatgtatacagcttcggcgtcgtcttgttagagttactaacaggaaggcgtgtagtcgaagatgatagacaggtatacactgaagaaacgttggtcgattgggcaatgcctttcctgagtgacagcagaagaatattgagaatcatggatacaaagttaggcggtcaatactcaaagaaaggagctcaagctgcagctgcgcttgttctaaagtgtcttaatactgatcctaaacatagaccaaccatggtaaatgttctagctgcattggaagcattacactcctcaaattcatttccaaagaaaccaaaatctggaactgataatcataactcagtcccaaggacaccgaaatctggaactgaaaatcatcatccaaccaagcattctagtcatcatcatttacataagtcaattgccaatactactagaaaacattgagatgcttttctactagtgtggactaatgcttatgcattccaattagtggtttgttcttttcattatgtagccaagtgaacaatttcatgttcttattgagaagcatcattgttagctgtcttagacagctatggatggaaaaacttagacctgtaatttttagaccattatattcatttaatttatagatatagatttgtgtc

SEQ ID NO: 10678 - DNA, 1543 bp, Vitis vinifera
ccctttaactgggttgtctgttttctacaagacttacccatttccaaagagacttggtggcttacacacggcttcatctatggggaattgctgcagaagacctgctaaatgtgcccatgcttcttcgactcacttttctgtccagtctgatcgtacaaagcctcccagtaaggcaaataaggattcaacttcttccagccagcatacaccttttggaaccttgaacaaaattttggtatcatccaaaagtgatatatctgcctccaatagtgtcaaggactttagcttcaatgatctcaagaatgcctccaagaacttccgctcagaaagccttcttggtgagggaggatttgggtgtgttttcaaaggctggcttgatgagaacactttagctcccaccaaacctgggacggggatggtagtggccatcaagaaactcaagacagaaagctttcaaggccacaaggaatggcttgcggaagtaaactacttaggtcagcttcaccatgaaaatctcgtgaaactcatcgggtattgctcagagtctgagaatagacttctggtatatgagtttatgtcaaagggaagtttggaaaatcatttattcaaaaaaggtgttcaaccaataacttgggctacacggatgagtatcgctattgatgttgcacaaggaatatccttcttacatagtttagatgctaacgtaatctaccgtgatttaaaagcttccaacattctgcttgattcggattttaaagcaaagctttcagattttggcttagcaagggatggtcctactggagataacactcatgtttcaaccagagttgtgggaactcggggttatgctgcccctgaatatgttgcaacaggtcatttaaccccaaagagtgatgtatatagctttggggtagtcttgttagagctgctatcaggtagaagagcaatggatgatgagaaggctgggggtgttgaagaaactctagtagactgggcaaaaccttttcttagtgacaacaggcgagttctgagaatcatggatactcggttgggtggtcagtactcgaagaaaggagctcaagctgcagcatcacttgcattgcagtgcctccacacagaccccaaaaaccggccacttatgacagatgttctagccgcactggagcgacttcccacatcaaaggacattcctaggaccccatcgcctagggtagaatatcacattatgaagcattcatcaaatcccggtcacactcacaaggcaacagccggagccacaaacttggtatgatgggtgtattttggtttcctcattggtagatgcattcaaatagttgtaattggtacttagacacagaaaaatgtacaagagatactgcacatatttggatatgactgtaaggttgttgtcacctttgtagcagttttgttctttgtgaaaattttgttgtactgagaatccagacaggattttcttagtaaaatatgaactcagattcttacatcattttatttttttgaatgttttgtgaagccttgctcc

SEQ ID NO: 10679 - DNA, 2029 bp, Glycine max
tcgcagtcgcagagtttcccattcctggtttcctcaccctcgtgtcgatcgttctagggttagggttaggtccctattcaattcgcttcaatttctgcaagagacgctcctcccgagagacgccatgggaggtgacagtgccgttgaggaatccgaaggggtcaacgtcaacatcaacgttcgctgctccaacggttccaagttttccgttcagattgccgtcgattccaccgtcagttccttcaaagatgccgccgcttgcagctgcgacatccctgccgagcaacaacgcctcatatacaagggtcgcatcttgaaggatgatcaaaccctccgaagctacggtttggaggcagatcacactgtccatttggttcgtggctctgctcttgccaatccaactggtgggactaatactagtagcaccgataccaataccaataccaatatcccaacagataatgctagagttgctggtgcgaatgaaggtgagggtttgggagggcttggttttggagcttcactattccctggactaggtgtcaatgggactgggggcaatggtttatttggcgagggatttcctgatcttgaacagatgcagcaaccatttatttcaaatcccaatttagtgagagaaataatgaattcacccaccatgcagaatctaataaataatcctgaaatagtgcggaatcttataatgaataatccgcaaatgcaagagctcatggatcgaaacccggagctagcacacatacttaatgatcccagcactcttcgccagacccttgaagctacaaggaaccctgagatcatgcgtgaaatgatgagaaatacagacagagcaatgagcaacattgaatcttctcctgagggattcaacatgctgaggcgcatgtatgaaaatattcaagaaccatttttgaatgccactacaatggctggtaatacaggaaataataatgcagcagtttcagggactcatggtggccatgcaagggacccctcaactaatccctccaccactagttctgaagcaactgctggttctcctttacccaatactaacccgcttccaaatccttggtcctctacgggaaccggaggggctcaaaataacagcagaaggtcgttgactactggtgtggatgccagacagcaaggacctactggcttaggagggcatggtctgccagaccttgaaagcatgctgggtggtagtgctatgccagatcctgctttattgacccagctaatgcaaaatccagctatctcacaaatgatgcaaagtatgctttccaacccacaaacattgaatcagattcttggtgctaatactgagcagcgtggcatgcctgatttaaattctcttagagaagtaatgcaaaatccagaattccttcgtttgttttcttcacctgagacattgcagcaactcttgtctttccagcaaactcttatgtctcagcttggccagcaacaatcaacatgggaatctggtcaaactggcggaggcactggaccaatgaacaacttgggattggagatgttatcgagcatgtttggtggacttggagctggtagcctagctgttccaaatagatcaaatgagccaccggagcagctgtatgcctcccaactttcacagcttcaagagatgggattctttgattcacaagagaacattagagcccttattgccacttcaggtaatgttcatgccgcagttgaacggctattggggaactctggtcagtagcggacaatgttggcaagttctcttctgtcgatttccacggttggtcactatgaaatcagtggtgttcaagtgccttgttgaatattaaataaaatcagaaatctgtccaaattatagtggtcagagctgaaatggtgtaggttatatacattggactgtgattgtttcttctaatggtccacttttcttcatgtacatacttaaattgaaactagttttagacgcagcagatcttaaatatttcaaatgaattgatttttgtgcttt

SEQ ID NO: 10680 - DNA, 2304 bp, Glycine max
actttcggtgatccgcgtctcaagtcggcagctcgcagagtctcttgatcctggtttcctcaccctagggttagggtttggtccctcttcaattaacttcaatatctgcgagagagcgtgagagtgacgcgcctcccgagagacgccatgggaggtgacagtgccattgaggaatccgaaggggtcaacgtcaacatcaacgttcgctgctccaacggtttcaagttttccgttcagattgccgtcgattccaccgttagttccttcaaggacgttgtcgctcgcaactgcgacatccctgccgaacaacagcgcctcatttacaagggtcgcatcttgaaggatgatcaaaccctacgaagctacggtttggaggcagatcacactgtccatttggttcgtggctctgctcctgccaatccaactggtgggaccaatactagtagcaccaataccaataccacaacaaataatgctagaggtgctggtgccaatgaaggtgggggcttaggagggcttggttttggagcttcactattccctgggctaggtgtcaatgggactgggggcaatggtttatttggtgagggatttcctgatcttgaacagatgcagcaaccctttatttctaatcccaatttagtgagagaaataatgaattcacccaccatgcagaatctaatgaataatcctgaaatagtacggaatcttataatgaataatccgcagatgcaagagctcatggatcgaaaccctgagctagcacacatacttaatgatcccagcactctccgccagacccttgaagctacaaggaaccctgagatcatgcgtgaaatgatgagaaatacagacagagcaatgagcaacattgaatcttctcccgagggattcaacatgctgaggcgcatgtatgaaaatattcaagaaccatttttgaatgccactacgatggctggtaatacaggaaataataatgcagcagtttcagggactcatggtggccatgcaagggaccgatcaacaaatccctccaccactagttctgaagcaactgctggttctcccttacccaatactaacccgcttccaaatccttggtcctctacgggaactggaggtgctcaaaataaccccagaaggtcgttgactactggtgtggatgccagacagcaaggacctactggcttaggtgggcttggtctgccagaccttgaaagcatgatgggtggtagtgctatgccagatgctgctttattgacccagctaatgcaaaatccagctatctcacaaatgatgcaaagtatgctttccaacccacaaacattgaatcagatccttggtgctaatactgagcagcgtggcatgccggatttaaattctcttagagaagtaatgcaaaatccagaattccttcgtttgttttcttcacctgagacgttgcagcaactcttgtctttccagcaagctcttatgtctcagcttggccagcaacaatcaacacgggaatctggtcaaactggcggaggcactggaccaatgaacaacttgggattggagatgttatcgagcatgtttggtggacttggagctggtagcctagcggttccaaatagatcaaatgagccgccagagcagctgtatgcctcccaactttcacagcttcaagagatgggattctttgacacacaagagaacattagagctcttatcgccacttcaggtaatgttcatgcagcagttgaacgactattggggaactctggtcagtagcagacaatgttggcaaattccttttggcaagttctcctctgtcgatttccaaggttagccactttgaaatcagtggtgtttaagtgccttgttggatattaaataaaatcagaaatctgtccaaattatagtggccagagctgaaatggtgtaggttatatatattggactgtgattgttccttctaatggtccaattttcttatgtacatacttatattgaaactagttttagacgcagcaggcgatcttaaatatttcaaatgaattgatttttgtgcttttttgtttctattattaatgcttaataactccacaattactgatttggccggtgggaagggacaggagactatccgttaaatatcaattggtagaatgtgatgtgaactaccgtattgattgatttaaattcgactttggtcatgttattttgcacaaatctgttcaaaatctttttcacttaagtttgtctcaagtttgatgtctaagttagcttaatgttacatccataaattttttgccagtcatt

SEQ ID NO: 10681 - DNA, 2340 bp, Glycine max
actttcggtgatccgcgtctcaagtcggcagctcgcagagtctcttgatcctggtttcctcaccctagggttagggtttggtccctcttcaattaacttcaatatctgcgagagagcgtgagagtgacgcgcctcccgagagacgccatgggaggtgacagtgccattgaggaatccgaaggggtcaacgtcaacatcaacgttcgctgctccaacggtttcaagttttccgttcagattgccgtcgattccaccgttagttccttcaaggacgttgtcgctcgcaactgcgacatccctgccgaacaacagcgcctcatttacaagggtcgcatcttgaaggatgatcaaaccctacgaagctacgaatgttttgccagcatagcttgtattaggcagaaaggtttggaggcagatcacactgtccatttggttcgtggctctgctcctgccaatccaactggtgggaccaatactagtagcaccaataccaataccacaacaaataatgctagaggtgctggtgccaatgaaggtgggggcttaggagggcttggttttggagcttcactattccctgggctaggtgtcaatgggactgggggcaatggtttatttggtgagggatttcctgatcttgaacagatgcagcaaccctttatttctaatcccaatttagtgagagaaataatgaattcacccaccatgcagaatctaatgaataatcctgaaatagtacggaatcttataatgaataatccgcagatgcaagagctcatggatcgaaaccctgagctagcacacatacttaatgatcccagcactctccgccagacccttgaagctacaaggaaccctgagatcatgcgtgaaatgatgagaaatacagacagagcaatgagcaacattgaatcttctcccgagggattcaacatgctgaggcgcatgtatgaaaatattcaagaaccatttttgaatgccactacgatggctggtaatacaggaaataataatgcagcagtttcagggactcatggtggccatgcaagggaccgatcaacaaatccctccaccactagttctgaagcaactgctggttctcccttacccaatactaacccgcttccaaatccttggtcctctacgggaactggaggtgctcaaaataaccccagaaggtcgttgactactggtgtggatgccagacagcaaggacctactggcttaggtgggcttggtctgccagaccttgaaagcatgatgggtggtagtgctatgccagatgctgctttattgacccagctaatgcaaaatccagctatctcacaaatgatgcaaagtatgctttccaacccacaaacattgaatcagatccttggtgctaatactgagcagcgtggcatgccggatttaaattctcttagagaagtaatgcaaaatccagaattccttcgtttgttttcttcacctgagacgttgcagcaactcttgtctttccagcaagctcttatgtctcagcttggccagcaacaatcaacacgggaatctggtcaaactggcggaggcactggaccaatgaacaacttgggattggagatgttatcgagcatgtttggtggacttggagctggtagcctagcggttccaaatagatcaaatgagccgccagagcagctgtatgcctcccaactttcacagcttcaagagatgggattctttgacacacaagagaacattagagctcttatcgccacttcaggtaatgttcatgcagcagttgaacgactattggggaactctggtcagtagcagacaatgttggcaaattccttttggcaagttctcctctgtcgatttccaaggttagccactttgaaatcagtggtgtttaagtgccttgttggatattaaataaaatcagaaatctgtccaaattatagtggccagagctgaaatggtgtaggttatatatattggactgtgattgttccttctaatggtccaattttcttatgtacatacttatattgaaactagttttagacgcagcaggcgatcttaaatatttcaaatgaattgatttttgtgcttttttgtttctattattaatgcttaataactccacaattactgatttggccggtgggaagggacaggagactatccgttaaatatcaattggtagaatgtgatgtgaactaccgtattgattgatttaaattcgactttggtcatgttattttgcacaaatctgttcaaaatctttttcacttaagtttgtctcaagtttgatgtctaagttagcttaatgttacatccataaattttttgccagtcatt

SEQ ID NO: 10682 - DNA, 2155 bp, Glycine max
tcccagtttgcttcaattgtttgttctagggttagggttttcgatccatttccccctcaaatttcaattattaacaagtgcagagcctgattttcctcccgtcgtgctttgaggaggccatgggaggtgacgccactgccgccgctgagagtgcgaccgcggagtcgaacgccgcaaatggagtcaacatcaacattcgctgctccaatggttccaagttttccgttcagattggccttgattccaccatcagatccttcaaggacgcggttgcacgcaactgtgacatatccgcggatcaacagcgcctgatttacaagggccggattctcaaggatgatcaaaccctccaaagctatggtttggaggctgatcacactgttcatttggttcgtggttttgctccatctaacactactggtggaactaatagtgttggtggcggcaataccacaactgctaacacgagaggggctggtgctaatgagggtgggggtttaggagggccaggatttggagcttcactgtttcctggacttggtggtaacaatgggatggggggcggtggtctcaatggtctatttggagcaggctttccggatcttgaacaaatgcagcaaccatttttgtcaaatcccaatttaatgagagatataatgaacacacctgctatgcagaatttaataaataatcctgacatagtgcggaatcttataatgaataacccgcagatgcaagaactaatggataggaaccccgagctggcacacatacttaatgatcccagcactcttcgtcagacacttgaagctacaaggaaccctgagatcatgcgcgaaatgatgaggaatacagatagagcaatgagcaacattgaatcttctcctgaaggattcaacatgctgaggcgcatgtatgaaaatgttcaagaaccgtttttaaatgccactacaatggctggtaacactggaaatgatgctgcagcagtcaggaaccaatccacaaatccctcaactactaattctgaagctacttcccctgtacccaatacgaacccacttcctaatccttggtcctctactggaactggaggaggccagaataacaccagaaggtcaactactactggtggggaagctcgacagtcaacacccactggtctaggagggcttggactgccagatcttgaaggcatgttgggtgggactgggatgccagatgctgctatgttgacccagttaatgcaaaacccagccatttcacaaatgatgcaaagtatcctttccaatccacagactatgaatcagattcttggggtcaataacgagcagcgtggcatgcctgatttgaattctctaagggaggtgatgcaaaacccagagtttctacgcctgttttcctcacccgagacactgcagcaactcttgtcttttcagcaagctcttctgtctcagcttggtcagcaacaatcaacacaggaaccaggtcaaacaggtggaggcactggaccgatgaacaacttggggctggagatgttatcaagcatgtttggtggactcggagctggtagcctggctgttcctaacagatcaaatgagccgccggagcaattgtatgccacccaactttctcagcttcaggagatggggttctttgacacgcaagagaacataagggctcttattgctacatcagggaatgttcatgcagcagttgagcggcttttggggaactccggacagtagcaggtggtaagaagggacacaagactagcaattaaatcccaaacactagaatctggtgtgagatatttgtccatttagctttgattttcatcatggaattatgttcaaacaaatctattgatttttttttcatttacatgatatccagagtttagtattatatccaatactcagatgtccaatgattaattataccttcagctacaagaaagtacaaagccttttgtaccatatatatgtaattctaacttgcctgtttgcaaggattgggttcacagatacattcaaagaaggggtttatattggaacatgaatttagacatatgattatgaacttttgtttgtcatttagttgttaatcttgttgtaaattccataacaatattaatgacccgtggcaaccaaatctt

SEQ ID NO: 10683 - DNA, 1629 bp, Medicago truncatula
atgggaggtgacgcaaccgctgaaaccaccacggagccacaatcaaccgacggaggagttaagatcaacattcgttgttccaatggttccaaattttccgttcagattagcctcgattccaccgttgtttccttcaaggatgttattgctcagaactgcgatatttctgctgatcaacaacggttgatttataagggaagaattcttaaggatgatcaaacgcttcaaagctacggtttggaggcagatcacactgtccatttggttcgtggctttacgcctgccaatacaactggtggggctaataccactggtgccaatacgactactactaatgctagagctgctggtgctaatgagggtgggggattaggaggacctggacttggagcttcactgtttccaggactaggaggtatcaatgggatgggaggaggtggtggtctcaatagtttatttggagcagggcctccagatcttgaacaattgcagcaaccatttatgtcaaatcccaatttagtgagagaaataatgaactcacctgccatgcaaaatttattaaataatcccgagatagtgcgcaaccttctaatgagtaacccacagatgcaagagctcatggatagaaaccctgagctggcacacatacttaatgatcctagcacacttcgccagacacttgaggctacaagaaaccctgagatcatgcgtgaaatgatgaggaatacagacagagctatgagcaacattgaatcttctcctgaggggtttaatatgctgaggcgcatgtatgaaaatgttcaagaaccatttttaaatgccaccacaatggcaggaaatgacagttccagaattttggggactcaaggtggccaaacgaggaatccatcgaccaatccctcaactactaatgctgaagcaacttcccctgtacccaatactaacccacttcctaatccttggtcatctgctccaactggaggtgcccaaactaatgtcaggagatcaacacctactgctgcagatgctcggcagcagacacccactggcttaggcgggcttggtatgccagatctcgaaggcatgttgggtggtatgccagatgctggttcattgacccaattaatgcaaaatccagctatttctcaaatgatgcaaagtatcatgtccaatcctcaaacaatgaatcagattcttggtatgaatactgatcagcgtgggatgcctgatatgaattcaatgagagaagtgatgcaaaacccggagtttcttcgaatgttttcctcacccgagacaatgcagcaactcttgtctatgcagcaagctcttatgactcaacttggacagcagcaatcaacacaggaaccaggccaaacaggtggaggcactggaccagtgaacaacttggggttggagatgttatcgagcatgtttggtggacttggagctggtagcctagctgttccaaacagatcaaatgagcctccagagacattgtatgctacccagcttacccagcttcaagagatgggattctttgacacacaagagaacttaagggctcttattgctacatcagggaatgttcatgcagcggttgagcgacttttgggaaactctggacagtag

SEQ ID NO: 10684 - DNA, 1620 bp, Medicago truncatula
atgggaggtgacggtgccgttgaagattccgcttcagaatcgaagaccgaagttaacatcaatgttcgatgctctaacggtacaaagtattccgttcaggtttctctcgattccacggttggatcgttcaaggatctcattgcgcgtaactgtgatatccccgcacaacaacaacgtctcatctacaaaggtcgtatattgaaggatgatcaaacgcttcaaagctatggtttggaggcagatcatgctgtgcatttggttcgtagctttgcacctaccaatgcgagtggtgggaccaatagtagtggcaccaataccacaacaaatgatgccgcaggcgctggagctaatgctgctgggggtttaggagggctcggttttggagcttcattgtttcctggactaggtgccaatggcactgggagaaataccttatttggcgagggatttccagatcttgaacaaatgcagcaaccatttatttcaaatcccaatttaatgagagaaatgatgaattcacctgctatgcagaatctagtaagtaaccccgagatagtgcggaatcttataatgaacaacccacagatgcaagagctcatggatcgaaaccctgagctagcacacgtacttaatgatcccagtactctccgccagacccttgaagctacaaggaaccctgagatcatgcgtgaaatgatgagaaatacagatagggcaatgagcaacattgaatcatctcctgagggattcaacatgctgaggcgcatgtatgaaaacgttcaagaaccatttttaaatgccactacaatggccggtaatacagcactttcagggactcagggtggcctatccagggaccaatcaactaatccctcaaccactaattctgaaacaactgctggctctcccattcccaatgctaacccacttcctaatccttggtcctctacaggaactggagctccccaaaataacaccaggagttcaaccactggtggggatgctaggcagcaagcacctactggcttaggagggcttggtttgcctggccttgaaggcatgctgggtggtagtggtatgccagatcctgctttattgactcaattaatgcaaaatccagctatctcacaaatgatgcaaagtatgctttccaacccacaaactttgagtcagattcttggtgctgctaatactgaacaacgtggtggcatgcctgatttaaattctcttagagatgtgatgcaaaatcctgagttcctacgtttgtttcaatcacctgagacaatgcagcaactcatgtctttccagcaagctcttctgtctcagcaacaatcaacacgggaatcgggtcaaactggtcaaactggtggagggactggaccatttaacaacatggggttggagatgttatccagcatgtttggtggccttggagctggtggccttggagctgctccaaatagatcaaatgagccaccagagcaattgtatgccacccagcttacacagcttcaagagatgggattctttgacacacaagagaacataagggctcttattgccacttcagggaatgttcatgcggccgttgaacgtcttttagggaacactggtcagtag

SEQ ID NO: 10685 - DNA, 2494 bp, Glycine max
gcaaagagacggttgccatctttggtctttggtcaggcgcaggttgagcacttgcatccaactttcttgaaaaagaccaacatcaattcttttttgggcctaggtgggtttaagaagcgtggctccttctctctttctctcagttctctcatttcttgccttctctatttattttaatttttaattgtccgatttcacagccatagcataagcctagcaacacagtattttttttattttcttaattaattttccgtccggattcctgtgtgtcatctctcaattttccagttttcaatttctcccaaattctttcaattcttcctcaatctttctagggttagggtttcaattcctttctccctcaatttcaattatcaaggagtggtgaacatcaatctcctcccccgccgtgctttggacggacaacatgggaggtgatgacgctgccgctgagagtgccaccacagagcggaacgccgcaaacgaagtcaacatcaacatccgctgttccaatggttccaagttttccgttcagattggcctcgattccaccgtcagatccttcaaggaggcggttgctcacaattgtgatatatcctctgatcaacagcgcctgatttacaagggtcggatcctcaaggatgatcaacccctccaaagctacggtttggaggctgatcacactgtccatttggttcgtggtttttctccttctaacaccactggtgggactaatagtggtggtggcggtggtggaaataccacaactgccaacacgagaggtgctggtgctaatgagggtgggggtttaggagggccaggatttggagcttcaccgtttcctggacttggtggtaacaatgggatggggggcggtggcctcaatggcttatttggagcgggctttccggatcttgaacaaatgcagcaaccatttttgtcaaatcccaatttaatgagagatataatgaacacacctgctatgcagaatttaataaataatccagacatagtgcggaatcttataatgaataacccgcagatgcaagagctaatggataggaaccctgagctggcacacatacttaatgatcccagcactcttcgtcagacactcgaagctacaaggaaccctgagatcatgcgcgaaatgatgaggaatacagacagagcaatgagcaacattgaatcttctcctgagggatttaacatgctgagacgcatgtatgaaaatgttcaagaaccatttttgaatgccactacaatggctggtaacactggaaatgatgctgcagcagtcaggaaccaatccactaatccctcaactactaattctgaagcaacttcccctgtacccaatacgaacccacttcctaatccgtggtcctcaactggaactggaggaggaggccaaactaacaccagaaggtcaactactactggtggggacgcccgacagccggcacccactggcctaggagggcttggactgccagatcttgaaggcatgatgggtgggatgccagatactgctatgttgacccagttaatgcaaaacccagccatttcacaaatgatgcaaagtatcctttccaatccacagaccatgaatcagattcttggggtcaataatgagcagcgtggcatgcctgatttaaattctctaagggaggtgatgcaaaacccagagtttctacgcctgttttcctcacctgagacactgcagcaactcttgtctttccagcaaactcttctgtctcagcttggtcagcaacaatcagcacaggaaccaggtcaaacaggtggaggcactggaccattgaacaacatggggctggagatgttatcaagcatgtttggtggacttggagctggtagcctggctgttcctaacagatcaaatgagccaccggagcaattgtatgccacccaactttctcagcttcaagagatggggttctttgacacgcaagagaacataagggctcttattgctacatcagggaacgtacatgcagcagttgagcggcttttggggaaccccggacagtagcaggtggtagggacacaagactagcaattaaatcccaaacactagaatctggtgtgagatatttgtccatttagctttgattttcgtcatggagttatgttcaaacaaatctattgatttttttttcattttacatgatatccagagtttagtattatatccaatgctcaaatatccaatgattaattataccttcagctacaagaaagtacaaagccttttgtaccatatacatgtaattctaacttgcctgtttgcaaggattgggttcatagatacattcaaaagaaggggttatattggaacatgaatttagatatataattatgaactttttgtttgtcactgtagttgttaatcttgttgtaaattccataacaatattaatgactcgtggcaaacaaatctttataaataaactttgggttaaacatataa

SEQ ID NO: 10686 - DNA, 2358 bp, Glycine max
atgctaacaccaaccccaaaccctccctcccattccgatgcatgcgtgcaccttctccaatctgcaatcaaatcacgagacccattcatcggaagatgcattcacgctcgaatcatcaaacacggccttcgctacctcggcgtcttcctcacaaacaacctcctcaacctctacgtcaaaaccggctcctcctctgacgcccatcgcctgttcgatgaaatgccccttaagaccaccttctcatggaacaccattctctccgcgcatgccaaggctggcaacttggactccgcgcgccgagtgtttgatgaaattccccaaccagattctgtgtcctggaccaccatgatagtggggtataaccacttgggtcttttcaaaagcgctgttcacgcgtttctccgaatggtttcctctggaatttcgccgacccagttcacgtttaccaatgttcttgcctcatgtgctgcagctcaggctctggatgttggaaagaaggttcattcctttgtcgtaaaactggggcaatccggggttgttcccgtggcaaactcactgcttaacatgtatgcaaagtgtggtgattctgttatggcaaaggttgtttttgaccggatgaggctgaaggatacatctacttggaatactatgatttctatgcatatgcagttttgtcaatttgaccttgcacttgcactctttgatcaaatgactgacccggatattgtctcttggaattccatcatcactgggtactgtcatcagggatatgacatcagagccttggaaacattttcttttatgcttaagagttcgtctttgaagccagataagttcaccttgggaagtgttctgtcagcttgtgccaatcgggaaagcttgaaacttgggaaacaaatccatgcacatattgtaagagccgatgttgacatcgctggggcagtggggaatgccctgatctcaatgtatgcgaaatcgggtgctgttgaagttgctcataggattgtagaaataaccggtactccaagtcttaatgttatagcattcacgtcactgttggatggctatttcaaaattggggatatagaccctgcaagagccatatttgattcattgaagcaccgtgatgtagttgcctggactgccatgattgttggttatgcacagaatggcttaattagtgatgctttggtgctgtttaggttaatgattagagaaggtccaaagccaaacaactataccctggcagcggtattaagtgtcatttcaagtttggcttctctggatcacggtaagcagcttcatgcagttgccataagattggaagaagtatcatcagtttctgtgggtaatgctttgattaccatgtactcaagatctggtagcatcaaagatgctagaaaaatattcaatcacatatgctcctacagggatacattgacttggacttccatgattttatctctagctcaacatggtcttggaaatgaggccatagaactgtttgaaaagatgctgagaattaacctaaagcctgatcacattacttatgttggtgtgttgtctgcttgcacgcatgtgggattggtagaacagggtaaaagttactttaatttgatgaaaaatgttcataacattgaacccacttctagccactatgcatgcatgattgacctgcttggacgtgctggattgcttgaagaagcatataattttattagaaatatgcctattgaaccagatgttgtagcttggggttcgcttttgtcttcgtgtagggttcataaatatgtcgatctggctaaagtggctgctgaaaaattgcttcttattgatcctaataatagtggggcttacttagcgcttgctaatacactttcagcctgtggtaaatgggaggatgctgctaaggttaggaagtcaatgaaggacaaagcagtaaagaaagaacaaggattcagttgggttcaaatcaagaacaaagtccatatttttggggttgaggatgctcttcacccgcaaagagatgcaatctactgtatgatttccaaaatatggaaggagataaagaaaatgggctttattcctgacaccaattctgtattgcatgacctagagcaagaagtgaaagaacagatccttagacatcatagtgaaaaactcgccattgcatttgcattaataaatacaccaaagcatactacagtgaggatcatgaagaaccttagagtctgtaatgactgtcattctgccataagatatatctctttgcttgtggaaagagaaattatagtaagagatgcaacgcgttttcatcattttaaggatggttcttgctcctgtcaggattactggtag

SEQ ID NO: 10687 - DNA, 2304 bp, Vitis vinifera
ttcctccaaagaagcctcaaattcaaagacccgtttaccggaaaatcgatccatgctcgaattatcaaagccgggcttcacctcggcgtgtttttgatgaataatctcatgaatttttatgctaaaactgggtttatttatgatgcccaccgcgttttcgatgaaatgcctgtgaagagtgtcttctcttggaatattattctgtctgggtatgcaaaagggggtcggcttgaggaggcccatcgcgttttcgaggaaatgcctgagcctgattctgtttcatggaccgccatgattgtggggtataatcagatgggtcagtttgagaatgcgattgggatgtttcgggagatggtttcagatgatgttccacctacccaattcacacttactaatgttcttgcctcgtgtgccgctgtagagtgtttgggcattgggaggaaggttcactcctttgtggttaagcatgggctcagtagctatattagtgtagcaaattcccttctgaatatgtatgcaaagtcgggtgatccagtgacggcaaagattgtctttgataggatgaaattgaagagcacttcaagttggaatacaatgatttcatcacatatgcagtccggactggttgatcttgctcaggtccagtttgagcaaatgattgaacgggacgtggtttcctggaatgcaatgatttcaggttataatcaacatggatttgatcgagaagcactggatattttctcaaaaatgcttatggattcttcttcgaagcctgacaaatttacccttgcaagtgctttatcagcttgtgccaatcttgagaatttgaaacttggtaaacaaattcatgctcatattatcagaacagagtttgatacttttggagcagttggaaatgctctgatttcaatgtactcaaaatccggaggggttgaaattgctcaaaagatcatagagcaaagcatgatttcaaatcttgatgtaatagcatttacagccctcctggatggatacgtgaagctcggtgacataaacccagccagacggatctttgactcattgagagtccgtgatgttgttgcatggacagccatgattgtagggtatgtgcagaatggcttcaatcaagatgcaatggagctcttcagatccatgattaaagaagggcccaagccaaacaactatacacttgcaaccatgttgagtgtcagttcaagcttagcctctcttgatcatgggagacaaatccatgcaagtgccacaagatcagggaatgcatcatcagtttctgtgagcaatgctctaattaccatgtatgccaaatctggaagcatcaatgatgcaaggtgggtattcaatctgatacattggaagagagatactattacttggacttccatgattattgctttagcccaacatggtcttggagaagaagccctaacactgtttgagagaatgctggagaatggtattaagcctgaccacataacttatgtcggtgttctttctgcctgtacacatgtgggattggtagaacaaggccgaagctattataatttgatgcagaatgcacacaaaatcataccgacaccaagccactatgcttgcatgattgacctatttgggcgtgccggattattgcaagaagcacatgcttttatagaaaatatgccaattgaacctgatgttatagcttggggttcgcttttagcttcttgtaaggttcataaaaatgtggagcttgcagaagttgcagcagagaggttgcttctcattgaacctgaaaacagtggggcctattcagcccttgctaatgtctattctgcttgcggacaatgggaaaatgctgctaatattagaaagtctatgaaggataaaggagtcaagaaagaccaaggatttagttgggtccaaataaaaaacaaggttcatatttttggcgttgatgatggacttcacccacagagagatgcaatctatgagatgatggcaaaaatctggaaggagataaagaagatgggttttgttccagacacagaatcagtattgcatgatctggaagaagagttgaaggagcagattcttagtcatcacagtgagaagcttgccattgcctttggactgatatgtactccagagaatactaccttgagaatcatgaagaacctaagagtctgcaatgactgccattccgccattaagtttatatccaagcttgtgggcagagaaataattgtgagagatgctactcgttttcaccatttcaagaatggtttgtgttcttgtcgggattattggtag

SEQ ID NO: 10688 - DNA, 1098 bp, Glycine max
gggagtatgaagtgtagcaactaagacgtgtgatcctggtgtatccacaatggataagaaacagagtgactaagattctaacatcaaccttaaaccttgtccttcatattacacacatttcaccaacattaattcccccaatctgaaatgtcaacctttgcattcacttctttattccaaatcacagtctcatcttcatcttcatctttgcatgctatcagagcctcagcttctgagtatgttccctcccaacacacccttagaagggaattcttgaagggtgttgctgctttgatgcctcttccacttgttgtgctgatagagccacccccttcagatgctagagaagttgaggttggctccttccttccaccttcaccctctgacccttctttcgttctcttcaaggcctctgccaaggacactccagcccttcgtgcaggaaatgtgcagccatacaagtttatcctccccccgacgtggaaacaggctcgtgtagcaaatatactatctggaaattactgccagcctaaatgtgcagagccctgggtggaggttaagtttgaagatgaaaaacaaggaaaagttcaggtagtggcttcgcccttgatacgccttaccaacaaaccaaatgcaacaattgaggacattgggagcccagaaaaactgattgcttctcttggaccatttgtcactggaaacacttttgatccagaagagctccttgagacttcagttgaaaagcttggtgatcagacatactacaaatacgtgctcgaaacaccatatgctctcacaggcacacacaatcttgcaaaagcaacagcaaagggaaacactgttgttttgtttgtggttagtgccaatgacaagcagtggcaaacttctgaggagactctaaaagccgtgcttaattcctttgaagtttagttttctgtcaaaggtaaataagagaagtttatttctttctagtttttgtttatacaaaattactcagaaagaattgcattggccaccatttcaattttttgtgttccgaggttaaactttaacttttaacagtctggcatttttcttcttagtatatacctaattgag

SEQ ID NO: 10689 - DNA, 1047 bp, Glycine max
tcatacacacatttcactaacatcaatcccctcaatctgaaatgacaacctttgcattcacttccttgctcccacttacagtctcatcaccatcttcatcttccaaattctcagcttttcatgctatcagagcctcattagattctgagtatgttgcctcccgacacacccttagaagggaattcttgaagggtgttgctttgatgcctctgccacttgttgtgatgagagaaccacccccttcacatgctagagaagttgaggttggctccttccttccaccctctccctctgacccttctttcgttctcttcaaggccactcccaaggacactccagcccttcgagcaggaaatgtgcagccatacaagtttatcctccccccgacttggaaacaggctcgtgtagcaaatatattatctggaaattactgccagcctaaatgtgcagagccctgggtggaggttaagtttgaagatgaaaaacaaggaaaagttcaggttgttgcttcgcctttgatacgccttaccaacaaaccgaatgcatcaattgaggacatcgggagcccagaaaaactgattgcttctcttgggccatttgtcactggaaacactttggatccagatgagctccttgagacttctgttgaaaagattggcgatcagacatactacaaatacgtgctcgaaacaccatatgctctcacaggaacacacaatcttgcaaaagcaacagcaaagggaaacactgttgttttgtttgtggttagtgccaatgacaagcagtggcaaacttctgaggagactctaaaggccgtgcttaattcctttgaagtttagttttctctcaaaggtaaataagagaagtttaccttcagtttatttccttctagtttttgtttatacaaaattactcagcaagagctgcattggcacccatttcaattttgtgttccgtagttaacctttaacttcaacagtctggcctttttcttctttgtatatatatacctgattgagtaaatgacatatgtattgattatcttta

SEQ ID NO: 10690 - DNA, 1036 bp, Glycine max
ggaatctgaaatgacaacctttgcattcacttccttgctcccacttacagtctcatcaccatcttcatcttccaaattctcagcttttcatgctatcagagcctcattagattctgagtatgttgcctcccgacacacccttagaagggaattcttgaagggtgttgctttgatgcctctgccacttgttgtgatgagagaaccacccccttcacatgctagagaagttgaggttggctccttccttccaccctctccctctgacccttctttcgttctcttcaaggccactcccaaggacactccagcccctcgagcaggaaatgtgcagccatacaagtttatcctccccccgacttggaaacaggctcgtgtagcaaatatattatctggaaattactgccagcctaaatgtgcagagccctgggtggaggttaagtttgaagatgaaaaacaaggaaaagttcaggttgttgcttcgcctttgatacgccttaccaacaaaccgaatgcatcaattgaggacatcgggagcccagaaaaactgattgcttctcttgggccatttgtcactggaaacactttggatccagatgagctccttgagacttctgttgaaaagattggcgatcagacatactacaaatacgtgctcgaaacaccatatgctctcacaggaacacacaatcttgcaaaagcaacagcaaagggaaacactgttgttttgtttgtggttagtgccaatgacaagcagtggcaaacttctgaggagactctaaaggccgtgcttaattcctttgaagtttagttttctctcaaaggtaaataagagaagtttaccttcagtttatttccttctagtttttgtttatacaaaattactcagcaagagctgcattggcacccatttcaattttgtgttccgtagttaacctttaacttcaacagtctggcctttttcttctttgtatatatatacctgattgagtaaatgacatatgtattgattatctttaaaaaaaaaaaaaaaaaaaaa

SEQ ID NO: 10691 - DNA, 780 bp, Medicago truncatula
atggcaacctctccattcacctcccttttcccattcacatcttcatcaactacatctcattcaaagctctcacattttcgtgcattcatcaaagcctcatcttctatctcagttccaagaagagaattcttgaagggcattgctctttcactaccacttattgctctcacagaaccaccacagtcacaagctagagaagtttcagttggttctttcctccctccttcatcatcagacccttcttttgttctcttcaaagcttctcctaaagatactcctgcccttcgtgctggaaatgtgcagccataccagttcatccttcccccaacatggaaacagcttcggatagcaaacatactatcaggaaactactgtcaaccaaaatgtgcagagccatgggtggaggttaaatttgaagatgaaaaacaaggaaaaattcaggttgtggcttcacctttgatacgcctaaccaacaaaccaaatgcaacaattgaggacatcgggagcccagaaaagcttatcgcttctcttggtccatttgtcaccggaaacactttagatccggatgagctcctcgaggcttcagttgaaaagattgatgatcagacgtactacaaatatgtgcttgaaactccatatgctcttactggttcacacaatcttgctaaagcaaccgcaaagggaaacactgttgttttgtttgtggctagtgccaatgacaagcagtggcaaacttctgagaagattctaaagaccatgcttgattcctttaaagtttag

SEQ ID NO: 10692 - DNA, 1052 bp, Vitis vinifera
cgcagcgaaatccacacttccaactcttccacccttccaactctttcaccccatcaaatccatggctactgcttctttcgctccactttcccacgttttctcgcgactttcccacatttcatcttcgaaatctgcaacctctattctcccacattcttctcctttcaagaactccccaaaccaactcacttttagaagggagttcctcaagggactggctttggctcctcttatttttatctctgaggaagcccttcctgcgcatgctcgagaggtggaagtagggtcctacctccccacatctccatctgacccatctttcgtccttttcaaagcctctcccaaagacactcccgcccttcgcgcaggaaatgtgcagccctatcagtttgtcctcccaccaacttggaaacaaacacgtgtagccaacatactgtctggtaattactgccaacccaagtgtgcggagccttgggttgaagtgaaattcgaagatgaaaatcagggaaaggtgcaggtggttgcttctcctttgatccgcctcactaacaaacccaatgcatcaattgaagacattgggagccctgagaagttgattgcctctcttggcccttttgttactggaaacacgtatgattctgatgagctcctggaaacttcagttgaaaagcttggtgatcagacgtattacaaatatgtgcttgagactccatttgctctgacggggtcgcataatcttgcaaaagcaacagcaaagggaaatagtgtcgtcttgtttgtggctagtgcaaatgataaacagtggcaggcatctcagaaaactctaaaagccatgcttgattccttccaagtgtagtttttgcccaagagaagacaagacggttatatttaattcatttattttaaatttgtatagatagaaggacttctggacaagatcgatatgttatcaactatggaatttttggttctgttcgatccaaatccctccccatccctccccatccctacctacccataaaagcatgaaaggagattcacactcccttttg

SEQ ID NO: 10693 - DNA, 2304 bp, Glycine max; identical to SEQ ID NO: 10680

SEQ ID NO: 10694 - DNA, 2029 bp, Glycine max; identical to SEQ ID NO: 10679

SEQ ID NO: 10695 - DNA, 1398 bp, Medicago truncatula
atggaagggctggccatgctgaagcagctcatcggtcagcttcagcaacttctcgactctcatcatcattcttcttcttcttcttcatcttcttccgttcttcaacaacaatcttctcatcaaactatcttccttcaacatcaccctcccagatggacctcctttgacctcgaagatagctctgtagatgactgttgtggccttgtaatggcagctggaaagtctcatagttttaggatgtcagagcctctgaagcctccacccgctaagaagcctcgaagagatcgaagcaggggcaaatcatcaggaagatccagtacaagtgaagttatggaacaagaaatatggaaagattttcctgaagatttatttgaggctgtaattgcacgacttcccattgccgcgtttttccgcttccgctctgtatgccgtcaatggaattccttgctggcttctcaaagcttttctaagcaatgtgcggaagtcccgcaagaaaatccatggttttacaccataacccatgaaaatgtgaattcaggagccatgtatgacccttctttgaaaaagtggcatcatccgtctatatcaccactgcccacaaagttgattgttttgccggtggcttctgctgggggtttagtttgctttcttgacattggccatcgtaatttctatgtatgtaacccactgactcaatccttcaaggagttgccagctcggtcagttaaggtctggtctcgcgttgctgtagggatgacagtgaatagaaattcaatcggttcaggctacaagatcctatgggtgggttgtgatggagaatatgaagtttatgactcggtgaaaaactcttggagtcgtccaggaaacatgcctggaagtatgaacctgccattgtcccttaacttcaggtcgcaaactgtctctattgacagtaccctatacttcatgcgttcagatccagaaggggttgtttcctatgatatggcaacgggggtttggaaacagtacataatcccagcgccactacatctgactgaccacactctagctgagtatgacggtcagatcatgcttgtgggcttgctcacaaagaatgcagccacgtgtgtatgcatatgggagctgcagagaatgacactcttgtggaaggaggtagacagaatgccaaatatatggtgcttggacttttatggtaagcacgtcagaatgacttgcctagggaacaaaggcttgctcatgttgtccctgagatcgaaacaaatgaatcggttggttacttacaacatagcaaagaaagaatggctgaaggttcctggttgtgtggtgccgaatgggaagaaacggcagtggatagcatgtggtactgcatttcatccatgcttgaccgccgtggcttga

SEQ ID NO: 10696 - DNA, 1983 bp, Glycine max
gtagaagcataataagcatgttagttgcgtgggtggcaacgtggaaaaacaagagtgggtaagaatagggaattagggagagaaggataagagagagaaaacaggaggagcaggaatcaggcatggaagggctggccatgctgaagcagctcattgctcagcttcaacacctctttgacacttaccactctcaatcttctctcatctttcaacaacaacaccccagatggacgacctcccttgacattgaagataactctgtagatgacttctgtggccttgtaatgacagctggaaagtctggcagtttcaggatgtcggagcctggaaagcctccacctactaagaagtctcgaagagatagaagcaggggcaaatcatctggaagatcttgtacaactgaagttatggaacaagaaatttggaaagattttcctgaagatttatttgaggctgtgattgcacgtcttcccatttccacatttttccgcttccgttctgtctgccggcagtggaattccatgctgaattctcaaagtttttctcagcattgtactcaagtcacacaagaaaatccatggttttacaccattacccatgaaaatgtgaattcgggagccatgtacgacccttctttgaaaaaatggcatcatccaactatatcaacaccgcccacaaaattgattgttttacctgtggcttcttctggcggcttagtttgctttcttgacattggtcatcgaaacttctttgtttgtaacccactgactcaatccttcaaggagttgccagctcgatcagtcaaggtctggtctcgtgttgctgtagggatgatggcaaatggaaactttgctggttcaggctacaagatcgtatgggtaggttgtgatggagaatatgaagtatacgactcagtcagaaattcttggagtcgtccaggaaacatgcctgtgggcatgaagctgccattgtcgctcaactttaggtctcaagctgtctctattggcagcacactttatttcatgcgttcagacccagacgggattgtttcctatgatatggcaactggggtttggaaacaatatataatcccagcgccactgcatctgactgatcacactctggctgagtgtgatggccaggtcatgcttgtgggtttgctcacgaagaatgcagccacttgtgtatgcatatgggagttgcagaaaatgactctcttgtggaaggaggttgacagaatgccaaacatatggtgcttggacttttatgggaagcacgttagaatgacttgcctggggaacaaaggcttgctcatgttgtccttgagatcaaaacaaatgaaccgattggttacttacaacatagcaaagaaagaatggctgaaggttcctgggtgtgtcgtgccacgtgggagaaaacgacagtggatagcatgtggtactgcatttcatccatgcctgactgcggtggtgtgatttctcatctatctctaacagcaatggcctagcaacggcctgccatttcccccctccagtcttgtagttcttttgcaatttgcaggcctttggtgttgctgtaggtaatcctaatgttcattgctggtgtaacaaagtagatgaaaaataatatgggtttgtagtgattcacgttttttcatgctctcagacatgtaaacattactttggttttgttatgaatgcctcatcctgggaacaccttggtaaaaggtgatataaaactgccgttcttttctgtattcagagtgtgagtggtttttttcttatatttgtttgtgctatggggagaagctgatagaggatccttgatgaggtattctagatggaagtaaatatagttttcatatttattgtttccattaccaacaatttgattgctaaattaacaacactgctaggctgtgaaatcagtgaaaacaaatttacaactgccctagtatgatggtagttatatgctacaagcttc

SEQ ID NO: 10697 - DNA, 1759 bp, Glycine max
gagaaggataagagagagaaagcagggtgcgtgtttttagagagagagagaggaggaatcaggcgaattgtgtgtggtttggtttggggcatggaagggctgggcatgctgaagcagctcattggtcagcttcagcagctcttggacacttaccagtctcaatctcattcttcttctactctcattcttcaacctcctcacactctcctctttcaacaacaacaccccagatggacgacctcccttgacattgaggatagctctgtagatgacttatgtggccttgtaatgacagctagaaagtctggcagtttcaggatgtcagatcctgtaaagcctccaccttctaagaagtctcgaagagacagaagcaggggcaaatcatctggaagatcttgcacaactgaagttatggaacaagaaatttggaaagattttcctgaagatttatttgaggctgtgattgcacgacttcccattgccacatttttccgcttccgctctgtctgccggcagtggaattccatgctgacttctcaaagtttttctctgcattgtactcaagtcacacaagaaagcccatggttttacaccattacccatgaaaatgtgaattcgggagccatgtatgacccttcattgaaaaaatggcatcacccaactatatcaacaccgcccacaaaattgattgttttacccgtggcttctgctggcggtttagtttgcttccttgacattggtcatcgaaacttctttgtttgtaacccactgactcaatccttcaaggagttgccagttcgatcagttaaggtctggtctcgtgttgctgtagggatgactacaaatggaaactctgttggttcaggctacaagatcttatgggtgggttgtgatggagaatatgaagtatacgactcagtcagaaattcttggagtcgtccgggaaacatgcctgcgggtatgaagctgccattgtcaatcaactttaggtctcaagctgtctctattggcagcacactttacttcatgcgttcagacccagaagggattgtttcctatgatatggcaactggggtttggaaacaatatataatcccagcgccattgcatctgactgatcacactctggctgagtgtgatggccagatcatgctcgtgggtttgctcacgaagaatgcagccacttgtgtatgcatatgggagttgcagaaaatgactctcttgtggaaggaggttgacagaatgccaaacatatggtgcttggacttttatgggaagcacgttagaatgacttgcctggggaacaaaggcttgctcatgttgtccttgagatcaaaacaaatgaaccgattggttacttacaacatagcaaagaaagaatggctgaaggttcctgggtgtgtggtgccacgtgggagaaaacgacagtggatagcatgtggtactgcatttcatccatgcctgactgcggtggcatgatttcacatctatctctaacagcaatggcctagcaacggcctgccattccccccccccagtctcggttcttttgcaatttgcaggcctttggtgttgttgtacgtaatcctaatgttcattgctggtttaacaaagtagatgaaaaataatattggtttgtagtaattcacgttttttcatgctctcagacatgtaaacattactttggttgtgttattaatgcctcatcctggggaacaccttggtaaaaggtgatataaaactgcagtttctttctgta

SEQ ID NO: 10698 - DNA, 1785 bp, Glycine max
tttttttttttttttttttttacagaaagaaactgcagttttatatcaccttttaccaaggtgttccccaggatgaggcattaataacacaaccaaagtaatgtttacatgtctgaaagcatgaaaaaacgtgaattactacaaaccaatattatttttcatctactttgttaaaccagcaatgaacattaggattacgtacaacaacaccaaaggcctgcaaattgcaaaagaaccgagactggggggggaatggcaggccgttgctaggccattgctgttagagatagatgtgaaatcatgccaccgcagtcaggcatggatgaaatgcagtaccacatgctatccactgtcgttttctcccacgtggcaccacacacccaggaaccttcagccattctttctttgctatgttgtaagtaaccaatcggttcatttgttttgatctcaaggacaacatgagcaagcctttgttccccaggcaagtcattctaacgtgcttcccataaaagtccaagcaccatatgtttggcattctgtcaacctccttccacaagagagtcattttctgcaacgcccatatgcatacacaagtggctgcattcttcgtgagcaaacccacgagcatgatctggccatcacactcagccagagtgtgatcagtcagatgcaatggcgctgggattatatattgtttccaaaccccagttgccatatcataggaaacaatcccttctgggtctgaacgcatgaagtaaagtgtgctgccaatagagacagcttgaggcctaaagttgattgacaatggcagcttcatacccgcaggcatgtttcccggacgactccaagaatttctgactgagtcgtatacttcatattctccatcacaacccacccataagatcttgtagcctgaaccaacagagtttccatttgtagtcatccctacagcaacacgagaccagaccttaactgatcgaactggcaactccttgaaggattgagtcagtgggttacaaacaaagaagtttcgatgaccaatgtcaaggaagcaaactaaaccgccagcagaagccacgggtaaaacaatcaattttgtgggcggtgttgatatagttgggtgatgccattttttcaatgaagggtcatacatggctcccgaattcacattttcatgggtaatggtgtaaaaccatgggctttcttgtgtgacttgagtacaatgcagagaaaaactttgagaagtcagcatggaattccactgccggcagacagagcggaagcggaaaaatgtggcaatgggaagtcgtgcaatcacagcctcaaataaatcttcaggaaaatctttccaaatttcttgttccataacttcagttgtgcaagatcttccagatgatttgcccctgcttctgtctcttcgagacttcttagaaggtggaggctttacaggatctgacatcctgaaactgccagactttctagctgtcattacaaggccacataagtcatctacagagctatcctcaatgtcaagggaggtcgtccatctggggtgttgttgttgaaagaggagagtgtgaggaggttgaagaatgagagtagaagaagaatgagattgagactggtaagtgtccaagagctgctgaagctgaccaatgagctgcttcagcatgcccagcccttccatgccccaaaccaaaccacacacaattcgcctgattcctcctctctctctctctaaaaacacgcaccctgctttctctctcttatccttctctcccctcc

SEQ ID NO: 10699 - DNA, 1695 bp, Citrus trifoliata
ccgggctgcagattcggccgagggtgggtttttggctttccgtccgtcagagtccggggcatgggagagctggccatgcttaggcagctcatcggtcagcttcagcagttcctccaactctacggttcttttcctcctcataataccgattcctgtttcctctattttcactctcatcaacatcaacaactgcccgaagaacaaacgcaccagcttcacagatggtgcttgcccgaagtcgatgacagtgctgcggatgattattacggttttgtgatggcagctggaaaatctggaagctgtaagatgttggagcctgtcaaacctcctccttccaagagatctcgaaaggagcggaaccgaggaaaattggctggatccaccagtacagctgaggctatggaacaagaaatttggaaagagttcccagaagacctttatgaagctgtcattgcacgacttcctattgccaccttctttcgcttccgttcagtttgccagaaatggaattccttactggaatcacatagtttctctcagcattgtgcccaagtcccgcaaggcaatccctggttttataccattactcatgaaaatgtgaattctggagccatgtatgatccttccctaaagaaatggcaccatcctactatatcttctctgcctacaaagatgatcatcttgccagttgcttcggctaggggtctagtttgctttcttgacattggtcatcggaacttctatgtatgcaaccctttaactcaatcattcaaagaattgccagctaggtcagttaaggtctggtcccgtgttgctgtggggatgactttgaatggaaattcaactagtagtggttacaagattttatgggtcggatgtgatggcgagtatgaaatctatgactcgctaaggaactcttggacacgacctggaagcatgccctcaaacataaagctgccactatcattgaacttccgttcacaagcagtctcagttgacggcatactttatttcatgcgttcagaccctgaagggattgtgtcctacaatatggttactggggtttggaagcagttcataatcccagctccactgcatttgaacgaccacacactcgctgagtgtggggggcggatcatgctcgtgggcttgctgacaaagaatgctgccacatgcgtgtgcatatgggagctgcagaagatgactcttttgtggaaggaggttgacagaatgccaaatatatggtgcttggacttttatgggaagcacgttagaatgacttgcttgggcaacaaaggtttgctcatgttgtcatcgagatcaagacagatgaaccgactggtaacttacaatgtgatgagcagggaatggctaaaggttccagggtgtgtggtgccccgtgggagaaagcggcagtggatcgcctgcggcactgcctttcacccatgcctcacggcaacagcttaactcggcttttacgttcgagacagtggttttctccatctgataattatttatgcttggttgtccgcaagtttttgctgctggtttgtctgttgcgcaaattagcctgttataatgaaacaattgatacagtgggatgtatggttttgtccttttcctttccatgtacaaacttcttgatgaatagctttgatctaagaagacattcacgcttaaaaaaaaaaaaaaaaa

SEQ ID NO: 10700 - DNA, 1892 bp, Malus x domestica
gaaaggggcagctctggtttttctggggttctcctcttatttaattaattctccacaaataagtcaaataaaataaaaataataagaagaagaataaaagctctggtttttgtgtgttttgttgggattgtgggtcgtcaatcgcagagaggagagagaaagagagagagagagagagagagagagagagcctgtgaggggcatggaagggctggccatgctgagacagctcatcggtcagcttcaggagctcgtcggctctcacccgcctcctcctcattaccatcaccatcttcaacttcagtttcaacctcctcctctactccgccatcatcactctcagcaaccaccgcaggaccaccaccaccacctcaggtggtgcccaattaacgttgatgaaggttctgcagatgattactacagtattatgatggcagctggaaaatctagaagttttaagatgttggaaccgtgcaagcctcctcctaccaagagatctcgtaaggagcaaacccggggtaaatcatctggaactaccaacaccactgagcctatggaacagcatatttggaaagatttcccagaagacctttatgaagccgtcattgctaggcttcccgttgctacattttttcgatttcgtactgtatgcaggaaatggaattccttgctggattctgaaagtttttctcaacattgtgcggaggtcccacaagctactccatggttttacaccatcactcatgaaaacgtgaattctggagccatgtatgacccttccttgaagaagtggcaccatcccaccattttttctctgccaacaaagttaattgttttaccggtggcttcagcagggggactggtgtgttttcttgatatcggtaataggaacttctatgtttgcaaccccctgaatcaatcttttaaagagttgccagccaggtcagttaaggtctggtctcgcattgctgtggggatgactctgaataggagttcagccagtggcggctacaagatcctttgggtggtttgtgatggtgagtatgaagtttatgattcagtgacgaattcctggacccgtccaggaatcatgccatcaggtgttaagctgccactatcactgaatttccggtcgcaggcagtttcaatcgatggcacactctacttcatgcgttcagaccctgaagggattgtgtcatatgatatggccactgggatttggaagcagtttataattcccaccccgctgcatctgactgaccacacacttgctgaatgtggaggccggatcatgctcgtgggattgttatcaaagaatgctgtcacatgcgtttgcatttgggagcttcagaaaatgacacttctatggaaggaggttgacagaatgccaaatatatggtgcttggagttttacggaaagcacgtgaggatgacttgcctgggtaacaaaggcttgctcatgctgtccttgaggtcgagacaaatgacccgattggttacatataacgtgtcgagcagggaatggctgaaggtccccggttgcgtggtgccacgtgggaagaagcggcaatggattgcatgtggcactgcattttatccaagcctgactgctgttgcttgaatcaggtttctgtttctggtgggcttcagcatggccagaaggggagtgttccttaaccatcggttcgtcatggtcggttgcaagctttcccggccaatttgttttcgacaattttcgttacttgtttcatgaagtggacaattccatgggttgtatgacggccggagttttactcttttgtgtactctcatatccgtcttgtactcaaataaaccgtctgtctaccatcaggtggtatttcatgagaattttttctgcgaaaaaaaaaaaa

SEQ ID NO: 10701 - DNA, 1853 bp, Vitis vinifera
atgatcagatcacaagtgtcaaagcggcgaatccggcaacaaagcaacaaagggagagtgggtgagctgagagggaagaatataagaggagagagagggaggcggaggcggaggagggaggaggagaggaggacggcggaagcggtggcggaggtggtggaggagcgccgagacggccggcggggcatggaaggcctggccatgctgaggcagctgatcggagaggttcaagagctttgcgaactctacggttcctccaattacattcctcatcaacctcacactcaacttctctaccatcatcatcaacacagccacagatggtgcttctccaattttgatgatgactctgctgaagatgattactgcgatcctataatgaggtctggaaaatctggaactttgaagacgatggaaacttatgagcctccacccaccaagaaatcccgtaaagagcggaaccggggaaagttacctgggacgactaattcagcagaggtaatggaacaagaaatctggaaagaattccctgaagacctttttgaagctgtgattgctagacttcccattgccacattctttcgcttccgtttagtttgtcggaaatggaattcattgctcaactccaatagtttctctcaacattgtgcccaagtcccacaaggccatccttggttttacaccatcactcatgaaaatgttgatcctggagccatgtacgatccttccttaaagaaatggcaccaccccacaatcccttctctgcgtgcaaagactgtcttgccagtggcttctgcaggaggcctagtctgtttccttgatatcaaccataggaacttctttgtatgcaaccctctgactcagtctttcaaagagttgccagcaagatcggttagggtctggtcccgagtagctgtgggaatgacactgaacgggaattcaaccactgcagggtataagatcctgtgggtgggctgtgatggtgagtatgaagtttatgactcagtgaagaactcatgggcccgtccaggaagcatgcccttacatgtcaagctaccgctgtcgctaaacttcctgtcacaggccgtgtccattgatggcacaatttacttaatgcgttcagacccagatggaatcgtgtcatatgatatggttactggggcctggaagcagttcataatccctgccccactgcatctgactgaccacacacttgccgagtgtggaggccgtatcatgctcgtggggttgctgacaaagaatgccgccacatgcgtatgcatatgggagctacagaagatgatgctcttgtggaaggaggttgacagaatgccaaacatatggtgcttggagttttacggaaagcacgttcggatgacttgcttgggcaacaaaggattgctcatgctgtctctaagatcacgacaaatgaaccggttggttacttacaatgtgttgagcagggaatggctgaaggttcctggatgtgtggtgccccgtggtggaaagaagcggcagtggatcgcctgcggcacggcatttcacccatgcctaactgcttcagcctaaattctagctgccctttgtgtttccggcagcatcagcccagcaaaggacagggtctttttttttttttttttttcccatttggtactctggtttttatcctttgtgggctgcaatcttttcaccactaatctctattgagtcaattttctatggtgaaaatgataaaggaattagatggctctgtggaaattattattattattgtcttctttgcctttaatgtacaaacatatgtacttccatcttttgatttcagaagtcagttttagatctgtttccttttc

SEQ ID NO: 10702 - DNA, 1488 bp, Glycine max
tgtggaaaatgaagagagaggagaattgagttgggttgggggcatggaagaagaagaagaagggcttgccatgctcatcactcaccttcaccatttctctcactctctttctcctctcttttttacccttcaccctcctctactctctcatcaactccccagattgtccttctttgacattgatgattactccttagatgacttctgtggccttgtaatggcagctggaaagtctggaagttccaggatgttggagcctctaaagcatccatctaagaagtctcgaagagataggagccttggaaaatcatctggaaggtcctccagggatgaagctatggaacaacaaatttggaaaaaattgcctgaggatctatttgagcctgtgattgcacgacttcccattgccacatttttctgcttccgctctgtatgccagcgatggaattccttgctgacttctcaaagtttttctcagcattgtgctcaagtcccacaagcaaacccatggttttacaccgtaactcatgaacatgcaaattccggagccatgtatgacccttctatgaagaagtggtatcatcccactatatcaacactgcccgcagagttgatagttttgccagtggcttctgcagggggtctagtttgctttcttgacatttatcgtcaaaatttctatgtttgtaacccattgactcaatccttaaaggagttaccagctcgttcagttagggttgggtctcgtgcgtctgtagggatgacagtaaatggaaactcaactagtgctggctacaagatcctattagttggttgtgatggagaatatgaaatttatgactcagtgacaaagtcttggagccatccagaaaacatgcctgcagatattaagctcccgctgtcactcaattttaggtcacaggccgtttctattgacagcaccctgtacttcatgcattcagatcccgaagggattgttttgtatgatatggcaactggggtttggacgcagtacataatcccagcaccattgcatctgactgaccacatgctggctgagtgcgatggccggatattgcttgtggggttgctcacgaagaatgcagccacatgtatatgcatatgggagctgcagaagatgactttcttgtggaaggaggttgacagaatgccaaacgtctggtgcttggacttttatgggaagcacgttagaatgacttgcttgggaaacaaaggcttgctgatgttatccttgagatcaagacaaatgaatcgattggttacttacaacatagcaagtagggaatgggtgaaggttcctgcgtgtctggtgccacatggaagaaaacgacaatgggtagcacatggtactgcattttatccatgcctcactgcaatggcttgatttagcttttataatacagatggaaaacgatacgagtttgtagtacttcatgtattcttcatgctctcaagcatgcacctcag

SEQ ID NO: 10703 - DNA, 1759 bp, Glycine max; identical to SEQ ID NO: 10697

SEQ ID NO: 10704 - DNA, 2649 bp, Medicago truncatula
ctttctctctctaaaaaactcttctttctttctctgcattttcacctcaaactacccatacccatctcatctttttgcttccattccaacccaacaacactaccaacaaataaagaacaaattttgaacctacccatcattcaattttcatcaaattatcaacttcactaaccatttttcatttggtcaacgtggtcaaagtattgtgtagtttgatgatttgtattgtttagatcaataaagggtttgtttttgttattaaccaatcaaatcaattgtatatgaatgattatgaagttgtgttgttctagttgaagaaaaatggaacaagtgacttcatcatcttcttctaaaactttgtttcttttttgggctattttggtgtttgatttggtgcttaaagcttcttctaatgttgaaggtgatgcactgaatgcattgaagagcaacttgaatgatcctaacaatgttcttcaaagttgggatgctacccttgtcaatccttgcacgtggtttcatgttacatgcaatggtgataacagtgtaacccgtgttgatcttggaaatgcggaactttctggtacactggtttcacaactgggtgatctctcaaatttacagtacttggaactttatagtaataatataacaggaaaaatcccagaagagctaggaaatttgacaaacttggtgagcttggatctttacttgaaccatttaagtggtaccataccgactacattgggcaagcttctaaaactacggttcctgcgtctcaataataacaccttgactggccacattcccatgtctttgacaaatgtttcttcgctgcaagttctcgatctttcaaacaacgatctagaaggaactgtcccagtgaatggttcattttcattatttactcctatcagttatcaaaataatcgtcgcttgatacaaccaaaaaacgctcccgcaccactttctccaccagcaccaacttcttcaggtggtagtaatactggagctattgctggaggagttgctgctggtgctgctctgttgtttgccgctcctgcaattgcacttgcttattggcgaaaaagaaaaccacaggatcatttctttgacgttcctgctgaggaggatcccgaagttcaccttggtcaacttaaaaggttttctctacgtgagctgctagtagcaacagataacttcagtaacaaaaatattctaggtagaggtggattcggaaaggtttataaaggacgcttggctgatagcacacttgtagctgtaaagagacttaaagaggaacgtacacaaggtggggagctgcaatttcaaacagaagtggaaatgatcagtatggctgtgcatcgtaatttgcttcggcttcgtggattttgcatgacatctactgaacgtttgcttgtgtatccttacatggccaatggaagtgtagcatcatgtttacgagaacgtaacgaggttgatccgccgcttgagtggccaatgcggaagaatattgcactgggatctgccagagggcttgcttacttgcatgatcactgtgaccctaagattattcatcgtgatgtgaaagctgcaaatatattgttggatgaggaatttgaagcagttgtgggagatttcggtttagcaaagcttatggattacaaagatacccatgttactactgctgtccgtggtacgattggacatatagcacctgagtacctgtcaactggaaagtcttcagaaaagactgatgtttttggatatggtgtgatgcttcttgaactaataactggacaaagggcttttgatctagcacgtcttgccaatgatgatgatgttatgttgcttgattgggttaaaggacttctcaaagacaagaagttggaaacacttgttgatgcagagctaaagggaaattatgaggatgatgaggtagagcagttaatccaagttgctttactatgcacacaagggtcccctatggaaagacctaagatgtctgaggtggttagaatgctagaaggtgatggtttggccgaaaaatgggagcaatggcagaaagaagagacgtaccgacaagattttaacaacaaccacatgcatcaccataatgcaaattggatagtagtagattcaacttcacatatccagccagatgaactctcaggtcctagatgatccgtttgaagattctatcatatccactagtgaatacacaatcctttttcctctgcctgaaagagataaactttcatgatttgtgcatatgcttttcaccatctcttctacttaatcttttctttcgatcttcttgaaattatcttgtatcttcacgttacatggtcattgatcaggttatgattatttaagaaaaaagtttgtaattgttactgggttgtcaagttgcaggataaagcttaggacacaagcaaccaacacttttgtcattgtatgtatgagaaactagtatagagcttttatgaaaatatgtgcaattttatttttatcgttattgtattttagaatttgttttcttttgacttggaaataaaaataagtagtacagtacttcagtggttgctatgtatttgacttttaataatggttggcattacactttcttagcaaatagtatgtttggaagat

SEQ ID NO: 10705 - DNA, 2422 bp, Glycine max
gcattttcagctaaacctgagcacacccaactgagattttagcttcagattccgaggtaagagcagaaagaagagaacttggagctacccagagttcgattttgggttgttcaacaaggtcaagatgtttctgagcttgatggatattatgtagatcaagaggggtgtgtggattggggaagcaattgtttatgaggttgaagaagcatggagagagtgacttcatcttttatgggttccttttttttttgggcaattttggtgcttgatttggtacttaaggcttctggcaatcaggaaggtgatgccctgaatgcattgaagagcaacttgcaagatcctaacaacgttcttcaaagctgggatgctacccttgtcaatccctgcacgtggtttcatgttacatgcaacagtgataacagtgtgacccgtgttgatcttggaaatgcagatctttctggtcaactggtttcacaacttggtcaacttacaaatttgcagtacttggaactttatagtaataagataactggaaaaattccagatgagcttgggaacttaacaaatttggtgagcttggatctttacttgaacactttaaatggtcccataccgactactttgggcaaacttgcaaaactacgtttcctgcgtctcaataataatagcttgacaggaggcatacccatatctttgacaaatgtttcttcactgcaagttcttgatctctcaaataaccatctaaaaggggaaatcccagtgaatggttcattttcattatttacccccatcagttatcaaaacaatcttggcttgatacaaccaaaatacactccatctccagtttctccaacaccaccaccagcttcttcaggtaacagtaatactggagctattgctggaggagttgctgctggtgctgctctgttgtttgcagcccctgcaattgcacttgcttattggcgaagaaggaaacctcaggatcatttctttgatgttcctgctgaggaggatcctgaagttcaccttggtcagcttaaaaggttttctctgcgtgagttgcaagttgcaacagataactttagtaacaaacacattctgggtagaggtggatttggaaaggtttataaaggacgcttagctgacggatctcttgtagcagtaaaaagacttaaagaggaacgcacgcagggtggagagctgcaatttcaaactgaagtggaaatgatcagcatggctgtgcatcgtaatttgcttcggcttcgtggtttttgtatgacacctactgagcggttgcttgtgtatccttacatggctaacggaagtgtagcatcatgtttacgagaacgtcaagaatcccaaccgccacttggctggccagaacggaagcgtattgcactgggatctgcaagggggcttgcttatttgcatgatcattgtgaccctaagattattcaccgtgatgtcaaagcagcaaatatattgttggacgaggaatttgaagcagttgttggagattttggtttagctaaacttatggattataaagatactcatgtcactactgctgtacgtggaacaattggacatatagcaccagagtacctctcaactggaaagtcttcagagaagactgatgtttttggatatggtgtgatgcttcttgaactaataactggacaaagggcttttgatctagctcgacttgccaatgatgatgatgtcatgttgctcgattgggttaaaggacttctcaaagacaggaaattggaaacactggtagatgcagatttacagggcagctataatgatgaggaggtagagcagttaatccaagtggccttactatgcacacaaggctctcctatggaaagacctaagatgtctgaggtggtcagaatgctagaaggtgatggtttggctgagaaatgggagcaatggcagaaagacgaaacattccggcaagacttcaataacaacatacatcaccctaatgcaaattggatagtagattcaacttcccatatccaggcagatgaactatcaggtcctagatgatccctttaacattctatggacaagagtgaatacacgatcttgcctgacaaggctttctgttggaaagagatatacttctgattttgattttgtgcatataattttcgtcccctctaccttttctcttgttttcatccttttgaaattatcttctgtgctcagattacgtgcccattggtcaggttgtgattattaaagaaagaagattgtaatttctattgggctgtcaagttacaggatgaagtgtatgttacaagcaacttttgtcatagtacgtatgaggaattagtatagagcttttatggaaataaatgcaattctattggcgattacagtttattattatatctttagtatttatgtc

SEQ ID NO: 10706 - DNA, 2227 bp, Glycine max
atgaatttacacatggagagagtgacttcatcttttatgggttccttttttttttgggcaattttggtgcttgatttggtacttaaggcttctggcaatcaggaaggtgatgccctgaatgcattgaagagcaacttgcaagatcctaacaacgttcttcaaagctgggatgctacccttgtcaatccctgcacgtggtttcatgttacatgcaacagtgataacagtgtgacccgtgttgatcttggaaatgcagatctttctggtcaactggtttcacaacttggtcaacttacaaatttgcagtacttggaactttatagtaataagataactggaaaaattccagatgagcttgggaacttaacaaatttggtgagcttggatctttacttgaacactttaaatggtcccataccgactactttgggcaaacttgcaaaactacgtttcctgcgtctcaataataatagcttgacaggaggcatacccatatctttgacaaatgtttcttcactgcaagttcttgatctctcaaataaccatctaaaaggggaaatcccagtgaatggttcattttcattatttacccccatcagttatcaaaacaatcttggcttgatacaaccaaaatacactccatctccagtttctccaacaccaccaccagcttcttcaggtaacagtaatactggagctattgctggaggagttgctgctggtgctgctctgttgtttgcagcccctgcaattgcacttgcttattggcgaagaaggaaacctcaggatcatttctttgatgttcctgctgaggaggatcctgaagttcaccttggtcagcttaaaaggttttctctgcgtgagttgcaagttgcaacagataactttagtaacaaacacattctgggtagaggtggatttggaaaggtttataaaggacgcttagctgacggatctcttgtagcagtaaaaagacttaaagaggaacgcacgcagggtggagagctgcaatttcaaactgaagtggaaatgatcagcatggctgtgcatcgtaatttgcttcggcttcgtggtttttgtatgacacctactgagcggttgcttgtgtatccttacatggctaacggaagtgtagcatcatgtttacgagaacgtcaagaatcccaaccgccacttggctggccagaacggaagcgtattgcactgggatctgcaagggggcttgcttatttgcatgatcattgtgaccctaagattattcaccgtgatgtcaaagcagcaaatatattgttggacgaggaatttgaagcagttgttggagattttggtttagctaaacttatggattataaagatactcatgtcactactgctgtacgtggaacaattggacatatagcaccagagtacctctcaactggaaagtcttcagagaagactgatgtttttggatatggtgtgatgcttcttgaactaataactggacaaagggcttttgatctagctcgacttgccaatgatgatgatgtcatgttgctcgattgggttaaaggacttctcaaagacaggaaattggaaacactggtagatgcagatttacagggcagctataatgatgaggaggtagagcagttaatccaagtggccttactatgcacacaaggctctcctatggaaagacctaagatgtctgaggtggtcagaatgctagaaggtgatggtttggctgagaaatgggagcaatggcagaaagacgaaacattccggcaagacttcaataacaacatacatcaccctaatgcaaattggatagtagattcaacttcccatatccaggcagatgaactatcaggtcctagatgatccctttaacattctatggacaagagtgaatacacgatcttgcctgacaaggctttctgttggaaagagatatacttctgattttgattttgtgcatataattttcgtcccctctaccttttctcttgttttcatccttttgaaattatcttctgtgctcagattacgtgcccattggtcaggttgtgattattaaagaaagaagattgtaatttctattgggctgtcaagttacaggatgaagtgtatgttacaagcaacttttgtcatagtacgtatgaggaattagtatagagcttttatggaaataaatgcaattctattggcgattacagtttattattatatctttagtatttatgtc

SEQ ID NO: 10707 - DNA, 2219 bp, Medicago truncatula
tgatgatgggtttcttgtagatcaagagagagagggtttgtgttttgttttatgaatataaacatggagcaagtagcttcatcttctacagtttcctttcttttttgggctattttggtgcttcatttgttgcttaaagcttcttccaatgatgaaagtgatgccctttttgcattcaggaacaacttaaatgatcctaacaatgctcttcaaagttgggatgctacccttgtcaatccctgcacgtggtttcatattacatgcagtggtggtagagtaatccgggttgatcttgcaaatgaaaacctttctggtaatctggtttcaaatcttggtgttctctcaaatttggagtacttggaactttataataataagataacaggaactatcccggaagagctaggaaatttgacaaacttggagagcttggatctttacttgaacaatataagtggtaccataccgaatacattgggcaaccttcaaaaactccgcttcctgcgtctcaataataacagcttgactggagtcattcccatttctttgacaaatgttactacgctgcaagttcttgatgtctctaacaataatctagaaggggatttcccagtgaatggttcattttcattatttacccctatcagttatcataataatcctcgcatcaaacaaccaaaaaacattccagtgcctctttctccaccatcaccagcttcttcaggtagctcgaatactggagctattgctggaggagttgctgctgctgctgctctgttgtttgcagcccctgcaattgcacttgcttactggaaaaaaagaaaaccgcaggatcatttctttgacgttcctgctgaggaggatcctgaagttcaccttggtcagcttaaaaggttttcgctacatgagctgctagtagcaacagatcacttcagcaatgaaaacattataggtaaaggaggattcgcaaaggtgtataaaggacgcttagctgatggaactcttgtagcagtaaaaagacttaaagaggaacgttcaaagggcggggagctgcaatttcagacagaagtagaaatgatcggcatggctgtgcatcgtaatttgcttcgtcttcgtggtttttgcgtaacatctactgaacgtttgcttgtgtatcctttaatggctaatggaagtgtagcatcgtgtttacgagaacgtaatgactctcaaccgccgcttgactggccaatgcggaagaatattgcgctaggagctgccagggggcttgcttacttgcatgatcattgtgaccctaagattattcatcgtgatgtgaaagctgcaaatatattgttggatgatgaatttgtagcagttgttggagatttcggtttagcaaggcttatggcttacaaagatacccatgtcactactgctgttcaaggtacacttgggcatataccacctgagtacctgtcaaccggaaagtcttcagaaaagactgatgtttttggatatggtacgatgcttcttgaactgacaactggacagagggcttttgacctagcacgtcttgccggtgatgatgatgtgatgttgcttgattgggttaaaggacttctccaagacaagaaattggaaacacttgttgatgcagagctaaagggaaattatgatcatgaagagatagaaaagctaatccaagttgctttactatgcacacaagggtcccctatggaaaggcctaagatgtctgaggttgttagaatgctagaaggtgatggtttgtccgaaaaatgggagcaatggcagaaagaggagacgaaccgacgggattttaacaacaaccacatgcatcactttaatacaaattggatagtagtagactcaacttcacatattcaggcagatgaactctcgggtcctagatgatccctttgaagattctatcatattcactagtcaatacacaatccgtcctctgcgtgaaaaatgggagcaatggcagaaagaagagatgcatcgacaagattttaacaacaaccgcatgcatcaccctaatgcaaattggatatagactgtatgtatgagagaaactagactagtatagaacttttatggaaatatatgcaattttatttatcgttttcagatggtaagtaattattgttggaaataatggttggcattgcactttctctgcaaatatatatatgtttggaagataatagaatctg

SEQ ID NO: 10708 - DNA, 2583 bp, Arabidopsis thaliana
aataattaaaattcgtcttccttccttgctctcggcgataacttggtttctctcctctctctcatctctctttgtttcgacccttttttagtatatttccaggaaatatcttcttcctcctttcgttttctctatctcagttttctctcttctcagcattaagtagtcaacggtcagcgatctcggcgttccttctaatcggaaaagtctagcttcagtttcttttttttttgcttttttggtttccgcgattaatcgatttgggtattttgattttctcttcaaattaagtcaacgggtggatacgcgttgagagggcttttctcgtattctgcttctaatttcatcatcttggtattaccttgtgtgggtggtagcttaatcgaaggattcgagatcccttttatcaggggttttaacaatgatggattttctctgatgagggatagttctagggtttgtttttaatctcttgaggataaaatggaacgaagattaatgatcccttgcttcttttggttgattctcgttttggatttggttctcagagtctcgggcaacgccgaaggtgatgctctaagtgcactgaaaaacagtttagccgaccctaataaggtgcttcaaagttgggatgctactcttgttactccatgtacatggtttcatgttacttgcaatagcgacaatagtgttacacgtgttgaccttgggaatgcaaatctatctggacagctcgtaatgcaacttggtcagcttccaaacttgcagtacttggagctttatagcaataacattactgggacaatcccagaacagcttggaaatctgacggaattggtgagcttggatctttacttgaacaatttaagcgggcctattccatcaactctcggccgacttaagaaactccgtttcttgcgtcttaataacaatagcttatctggagaaattccaaggtctttgactgctgtcctgacgctacaagttctggatctctcaaacaatcctctcaccggagatattcctgttaatggttccttttcacttttcactccaatcagttttgccaacaccaagttgactccccttcctgcatctccaccgcctcctatctctcctacaccgccatcacctgcagggagtaatagaattactggagcgattgcgggaggagttgctgcaggtgctgcacttctatttgctgttccggccattgcactagcttggtggcgaaggaaaaagccgcaggaccacttctttgatgtaccagctgaagaggacccagaagttcatttaggacaactgaagaggttttcattgcgtgaactacaagttgcttcggataattttagcaacaagaacatattgggtagaggtggttttggtaaagtttataaaggacggttagctgatggtactttagtggccgttaaaaggctaaaagaggagcgcacccaaggtggcgaactgcagttccagacagaggttgagatgattagtatggcggttcacagaaacttgcttcggcttcgtggattttgcatgactccaaccgaaagattgcttgtttatccctacatggctaatggaagtgttgcctcctgtttaagagaacgtcccgagtcccagccaccacttgattggccaaagagacagcgtattgcgttgggatctgcaagagggcttgcgtatttacatgatcattgcgacccaaagattattcatcgagatgtgaaagctgcaaatattttgttggatgaagagtttgaagccgtggttggggattttggacttgcaaaactcatggactacaaagacacacatgtgacaaccgcagtgcgtgggacaattggtcatatagcccctgagtacctttccactggaaaatcatcagagaaaaccgatgtctttgggtatggagtcatgcttcttgagcttatcactggacaaagggcttttgatcttgctcgcctcgcgaatgatgatgatgtcatgttactagactgggtgaaagggttgttaaaagagaagaaattggaagcactagtagatgttgatcttcagggtaattacaaagacgaagaagtggagcagctaatccaagtggctttactctgcactcagagttcaccaatggaaagacccaaaatgtctgaagttgtaagaatgcttgaaggagatggtttagctgagagatgggaagagtggcaaaaggaggaaatgttcagacaagatttcaactacccaacccaccatccagccgtgtctggctggatcattggcgattccacttcccagatcgaaaacgaatacccctcgggtccaagataagattcgaaacacgaatgttttttctgtattttgtttttctctgtatttattgagggttttagcttctgctgctccatattattggttcttaagtgaatacatgaggatcagattgggtttgtaagtgttatatgatgaaaaaggatttgaatgttgttgaaagctaaaacccaaacatgtcttaagctcaccacttgaggattgttgcgcacttgattcacaaatatgtatcccatcaattattctttttca

SEQ ID NO: 10709 - DNA, 2261 bp, Gossypium hirsutum
attgatgatgaatttggggatttagctctttgaaaacaaaagtaggcaaaaatgaaggaaaatatgacgcagcgattgatttccttttgtttatggttgattttcgtgtttgatttggctttcagagttgcaggaaatgccgaaggtgatgctttgaatgcattgaagaccaatatggttgaccctaataatgtgttacaaagttgggacccaacccttgttaatccttgcacatggtttcatgttacatgtaatagtgaaaatagtgtaacaagagttgatcttgggaatgcaaatctcactggtcaactggttccacagctcgggtcacttccaaatttgcagtatttggagctttatagtaataacatatctgggacgatcccagacgagctggggaatttgacggaattggtgagcttggatctttacttgaataaattaactggagacatcccgactactctgggccagcttaaaaaactccgtttcttgcgtctcaacaacaactcattggcaggaacaattcctaggtccttaactactattgacacactgcaagtgctggatctttcaaacaatggcctagtaggagatgttccagttaatggttccttttcactattcactcctatcagttttgccaataataaactcaataatcctccacctgctccaccacctcctatcccacctacacctccagctcaatcaggtattagttccactggtgctattgctggaggggttgctgctggtgctgccctgctgtttgctgcccctgcaattgtgcttgctttgtggcgaaaaaggaaggcaccggatcatttctttgatgtacctgctgaggaggacccagaagttcatttggggcaacttaaaaggttttccttgcgtgaactgcaagtggcaacggataattttagcaacaaaaacatcctgggtagaggaggttttggtaaagtttataaaggtcgcttagctgatggttctctagtggcagtaaaaagactgaaagaggagcgtactcaaggtggagagctgcagttccaaacagaagtagaaatgataagcatggctgtccataggaatctactacgtcttcgtggattttgcatgacccctacagaacggctgctagtctacccctttatggttaatggtagtgttgcatcttgtttaagagagcgttcggagtctcaaccagcacttgattgggctataaggaaacggattgcactcggagctgcaagggggctcgcatatttgcatgatcattgtgaccctaagattatccaccgtgatgtgaaggctgcaaacatattgttggatgaagaatttgaagcagttgtcggtgactttgggcttgctaaactgatggactacaaagatactcatgtcacaactgctgttcgtggcacaattggtcatatagctcccgagtacctatcaactggaaaatcatcagagaaaactgatgttttcggttatggtgttatgcttctcgaactcattacaggacagagggcttttgatcttgctcggcttgcaaatgatgatgatgtcatgttgcttgattgggtaaaaggacttctaaaagaaaggaagttggaaacgctggtggattcagatctgaatggtaattacatagacgaagaagtggagcagctaatccaggtggctctgttgtgcactcaaggtaccccaatggaacgaccgaagatgtctgaagtggttaggatgctggaaggtgacgggttggctgagagatgggaagagtggcagaaagaggaaatggttcgtcaagagttcaaccaagcccaccactacagccaccaccaacccaatgctaattggattattgccgactcaacatcacacatccctccagatgaattatctggtcctagatgacccactcgctgcaaaaatgcaattacaaagggtcttctccaacactttgttctgttgttttggactcctcattgttcacatttgtgcatatagttccttttttcgccccctccccccattgatcctgttgtaatctatatttacttgtacggagtttactcttggctttgtaacttttatagggttgccttgccaactgaagagtcaagaaaacattattaggtgtgctagcaaaaaaacaaagtacaaacccccccatgtttttgtgtactgaaaacgttagtaaagactgtttacatgaataaaaacagtaaaaatccattcaccacaaaaaaaaaaaaaaaaaa

SEQ ID NO: 10710 - DNA, 2507 bp, Arabidopsis thaliana
aataattaaaattcgtcttccttccttgctctcggcgataacttggtttctctcctctctctcatctctctttgtttcgacccttttttagtatatttccaggaaatatcttcttcctcctttcgttttctctatctcagttttctctcttctcagcattaagtagtcaacggtcagcgatctcggcgttccttctaatcggaaaagtctagcttcagtttctttttttttgcttttttggtttccgcgattaatcgatttgggtattttgattttctcttcaaattaagtcaacgggtggatacgcgttgagagggcttttctcgtattctgcttctaatttcatcatcttggtattaccttgtgtgggtggtagcttaatcgaaggattcgagatcccttttatcaggggttttaacaatgatggattttctctgatgagggatagttctagggtttgtttttaatctcttgaggataaaatggaacgaagattaatgatcccttgcttctttgggttgattctcgttttggatttggttctcagagtctcgggcaacgccgaaggtgatgctctaagtgcactgaaaaacagtttagccgaccctaataaggtgcttcaaagttgggatgctactcttgttactccatgtacatggtttcatgttacttgcaatagcgacaatagtgttacacgtgttgaccttgggaatgcaaatctatctggacagctcgtaatgcaacttggtcagcttccaaacttgcagtacttggagctttatagcaataacattactgggacaatcccagaacagcttggaaatctgacggaattggtgagcttggatctttacttgaacaatttaagcgggcctattccatcaactctcggccgacttaagaaactccgtttcttgcgtcttaataacaatagcttatctggagaaattccaaggtctttgactgctgtcctgacgctacaagttctggatctctcaaacaatcctctcaccggagatattcctgttaatggttccttttcacttttcactccaatcagttttgccaacaccaagttgactccccttcctgcatctccaccgcctcctatctctcctacaccgccatcacctgcagggagtaatagaattactggagcgattgcgggaggagttgctgcaggtgctgcacttctatttgctgttccggccattgcactagcttggtggcgaaggaaaaagccgcaggaccacttctttgatgtaccagctgaagaggacccagaagttcatttaggacaactgaagaggttttcattgcgtgaactacaagttgcttcggataattttagcaacaagaacatattgggtagaggtggttttggtaaagtttataaaggacggttagctgatggtactttagtggccgttaaaaggctaaaagaggagcgcacccaaggtggcgaactgcagttccagacagaggttgagatgattagtatggcggttcacagaaacttgcttcggcttcgtggattttgcatgactccaaccgaaagattgcttgtttatccctacatggctaatggaagtgttgcctcctgtttaagagaacgtcccgagtcccagccaccacttgattggccaaagagacagcgtattgcgttgggatctgcaagagggcttgcgtatttacatgatcattgcgacccaaagattattcatcgagatgtgaaagctgcaaatattttgttggatgaagagtttgaagccgtggttggggattttggacttgcaaaactcatggactacaaagacacacatgtgacaaccgcagtgcgtgggacaattggtcatatagcccctgagtacctttccactggaaaatcatcagagaaaaccgatgtctttgggtatggagtcatgcttcttgagcttatcactggacaaagggcttttgatcttgctcgcctcgcgaatgatgatgatgtcatgttactagactgggtgaaagggttgttaaaagagaagaaattggaagcactagtagatgttgatcttcagggtaattacaaagacgaagaagtggagcagctaatccaagtggctttactctgcactcagagttcaccaatggaaagacccaaaatgtctgaagttgtaagaatgcttgaaggagatggtttagctgagagatgggaagagtggcaaaaggaggaaatgttcagacaagatttcaactacccaacccaccatccagccgtgtctggctggatcattggcgattccacttcccagatcgaaaacgaatacccctcgggtccaagataagattcgaaacacgaatgttttttctgtattttgtttttctctgtatttattgagggttttagcttctgctgctccatattattggttcttaagtgaatacatgaggatcagattgggtttgtaagtgttatatgatgaaaaaggatttgaatgttgttgaaagctaaaaaaaaaaaa

SEQ ID NO: 10711 - DNA, 2306 bp, Ageratina adenophora
ggggggggctcaaatatttgctttagatttcatcaaattccaagtgtttcttgaactgggttttctttattttgttgcagattcgatttctggatgatatagatacgttttatctgtatctacacctagggtttggtgtttagggttctgggtatttcgaatttcttgatctgactgattgattgatgagaaatctgggtttttagtttgaccgacccgtacccggttttgagatatggatcggatagtctctgtgatttcagcttctgttcttgtgtggttgatattggtgtttaataacttgtcaattgtttatgggaatgctgaaggtgatgcgttgaatgctttaaagactcaattaggtgacccgaataatgttcttcaaagttgggatgcgactctggtgaatccatgtacttggtttcatgttacatgcaacaatgaaaacagtgttacacgagttgatcttggaaacgcaaacttgtcgggtcaactggttccacagcttggtcaactcactaatttacagtatttggaactttacagtaataatattactggaaaaattccgaatgagcttgggaacttaacaaacttagtgagtttggatctttatctcaatcgattagacggtgtgattccagaaacattgggcaagcttcagaagcttcgtttccttcgtctcaacaacaacacattgacgggaactattccgatgtcattaactactataacgtcattgcaagttcttgatctttcaaacaacaatttgagtggagatgtcccggttaatggttccttctctcttttcacacctatcagttttgctggtaaccctaacttgatagctcctccggttcctcctcaagctccaactccaccgagttcccagtctccttctgtcggtaatagtgccaccggggccattgccggaggagtggctgctggtgcggcactcctgtttgcaggtcccgcaattgcacttgcttggtggcgacgccgaaaaccacaggatcatttctttgatgtaccagccgaggaagatccggaagttcatttagggcaattgaagaggttttctcttcgtgaactacaagttgcaactgataatttcagtaaccgacacattctcgggcgaggtggatttggcaaagtttataaagggcgtttggcagatggaactttagtagctgtaaaacggttaaaagaggaaagaactcaaggtggagaattacagttccaaacagaagttgaaatgattagcatggccgtgcaccggaatctacttcgtttgaaaggcttttgcatgacacccaccgagcggttgcttgtttatccgtatatggccaatggtagtgttgcatcatgcttaagagagagacccgacactcaggagccactcgatcggccaatacggaagcgaattgcactcgggtctgctagaggtcttgcatatttacatgatcattgtgacccaaaaatcattcaccgtgatgtgaaagctgcaaatatattattagacgaagaattcgaagcagttgttggagattttgggttggctaaacttatggattacaaagatactcatgttacaacggctgttcgtggtacaatcggacacatagcacccgagtatttatcaaccgggaaatcttcggagaagacagatgttttcgggtatggtgttatgcttcatgagctcataactggacaacgtgcttttgatcttgctcgccttgctaatgatgatgatgtcatgttactcgattgggtgaaagggcttttgagggaaaagaagctggagacactagtggatgctgatctgaaaggtaattatatagatgctgaggtggaacaattgatccaggtggcacttttgtgcacacaaggaactccattagagcgacctaaaatgtcggaagttgtgagaatgcttgaaggtgacgggttggccgaaagatgggaagaatggcagaaagaggagatgtttaggcatgagttcaatactactcataatccaaataccgattggattattgcggattcgacatataatcttcgtcctgatgaattgtcgggccccagatgatggtctttgaaacgggctgtcgtttttaaatctttttcgtgtatttttatgaaaacctatcattgtgcatatgaaaatactcaagtcttttttttttctgatgttttcgcctgagactggtgggtgaattgtgtagagttttggtctttgttgtttaatttgtgcttatagattggcaggtgagtcggggtcagaaagcaacctttaaatgttgtcc

SEQ ID NO: 10712 - DNA, 2054 bp, Gossypium hirsutum
tatttgctcgttgattcggtcaacggccgatatgtgtgtgatttgtgatgttcgttttagactgaattgatggttccgtgattcgtcaagtggatgattgatgatgaatttggggatttagctctttgaaatcaaaagtaggcaaaaatgaaggaaaatatgacgcggcgattgatttccttttgtttatggttgattttcgtgttggatttggctttcagagttgctggaaatgccgaaggtgatgctttgaatgcattgaagaccaatatggctgaccctaataatgtgttacaaagttgggacccaacccttgttaatccttgcacatggtttcatgttacatgtaatagtgaaaatagtgtaacaagagttgatcttgggaatgcaaatctcactggtcaactggttccacagctcgggtcacttccaaatttgcagtatttggagctttatagtaataacatatctgggatgatcccagacgagctggggaatttgacggaattggtgagcttggatctttacttgaataaattaactggagacatcccgactactctgggccagcttaaaaaactccgtttcttgcgtctcaacaacaactcattggtaggaacaattcctttgtccttaactactattgacacactgcaagtgctggatctttcaaacaatggcctaataggagatgttccagttaatggttccttttcactattcactcctatcagttttgccaataataaactcaataatcctccacctgctccaccacctcctatcccacctacacctccagctcaatcaggtattagttccactggtgccattgctggaggggttgctgctggtgctgccctgctgtttgctgctcctgcaattgtgcttgctttgtggcgaaaaaggaaggcaccggatcatttctttgatgtacctgctgaggaggacccagaagttcatttggggcaacttaaaaggttttccttgcgtgaactgcaagtggcaacggataattttagcaacaaaaacatcctgggtagaggaggttttggtaaagtttataaaggtcgtttagctgatggttctctagtcgcagtaaaaagactgaaagaggagcgtactcaaggtggagagctgcagttccaaacagaagtagaaatgataagcatggctgtccataggaatctactacgtcttcgtggattttgcatgacccctacagaacggctgctagtctacccctttatggttaatggtagtgttgcatcttgtttaagagagcgttcggagtttcaaccagcacttgattgggctataaggaaacggattgcactcggagctgcaagggggcttgcatatttgcatgatcattgtgaccctaagattatccaccgtgatgtgaaggctgcaaacatattgttggatgaagaatttgaagcagttgtcggtgactttgggcttgccaaactgatggactacaaagatactcatgtcacaactgctgttcgtggcacaattggtcatatagctcccgagtacctatcaactggaaaatcatcagagaaaactgatgtttccggttatggtgttatgcttctcgaactcattacaggacagagggcttttgatcttgctcggcttgcaaatgatgatgatgtcatgttgcttgattgggtaaaaggacttctaaaagaaaggaagttggaaacgctggtggattcagatctgaatggtaattacatagacgaagaagtggagcagctaatccaggtggctctgttgtgcactcaaggtaccccaatggaacgaccaaagatgtctgaagtggttaggatgctggaaggtgacgggttggctgaaagatgggaagagtggcagaaagaggaaatggttcgtcaagagttcaaccaagcccaccactataaccaccaccaacccaatgctaattggattattgccgactcgacatcacacatccctcccgatgaattatctggtcctagatgacccgctcgctgcaaaaatgcaattacaaagggtcttctccaaca

SEQ ID NO: 10713 - DNA, 1584 bp, Glycine max
tggatcaatcccctcagagtgcacactagactacatacactatgttacttcactgactcccaatggtcaaccccccaaaccccacttctgaatcttaaaaccagcaattctattctagctccccatttccaaatgggtttcaccttcagcaccatgaccctcaacctggtcctcctaatggccatggttgccaccaacatcctctccctctaccacctctcctccaccctccaatcccccaaatcccccaaaccacccccaccagtccccgaccaactcctccaccagctccacaccatacgcgccaccatcagtcacctcactcgcctccagaacacccacaacccagcacaaaaatccaccatcccctcagatctactcttatactcccacctctccccaatagcctcttcttgccacaaccaccccgaactcctccacaagtacatgacttacattcccttctctctctgcccctccgattctgacctcgccgaatccctaatcctacgcggttgtcaccccctcccccgccgccgctgcttctccaaaaccccgcaaaaaccccccgtttcccttcctgaaaaccccttcccctcctccctccctgacaacgccgtaatttgggaccattactcttgcaaatccttcgattgcttgaacaaacaaaaccccaacctcggttttgaaccttctcgggatatttcgaggttcaattcgtataagaccgatttggatctcccgatccagcagttgttacagatcgcggcggccgcgaagtcggcgctgcgcctcggcctcgacgtcggcggcggcaccggctcctttgccgcctcgatgaggctccgcaacgtgaccgtggtgaccacgaccatgaacgtggcggtgccgaacagcgaggccgtcgcactgcgggggctcgtgccgctgcacgtgcccctgcagcagcggctgccgctgttcgacggcgtcgtggatctggtgcggtgcgggcgcgccgtgaaccggtggattcctttgacggtgatggagtttctgctgctggatgtggacagggtgctgaggggcggagggtacctttgggtggaccattttttcagcaaagtggtggaccttgagaaggtgtatgcgccgttgattgggaaattagggtacaagaaggtgaagtgggcgacggggaataagaccgatgccagtggcgtcaagaatggagaagtttacttgactgcgttgctgcagaagcctgtgtccagatgaaggtgcttacacgcaaaaaagtttgatatatgctataaggacaataagcaggtcggtgtatcctgatttccttgctcataggtgtttatggggtgcgtaatgaagcaattttcatgcccactttgatggatcatagaatcaactcgttgaaacaaagataggaggaagtcaatgtcaggtgtatatccatggggacttggggaaactggtggaggaaaatagtttttggtgatcgttttttgtatcctatttgattaaattatgttattccagttaattgttttgaaataaatttaagaaacgccattgcctggttggttttcatat

SEQ ID NO: 10714 - DNA, 1248 bp, Glycine max
atggccatatttacttctgcaagaaacgtggcacgttataccaagatcaatgctctcactacttcctcctcctgccacaaccaccccgaactccttcacaagtacatgacttacacacctttctctctctgcccctccgattccgacctcgccgaatccctaatcctccgcggctgccaccccctcccccgccgccgctgcttctccaaaacaccacagaaacaaattcccccaaattccctccctaaaaaccccttcccttcctccctccctgacaacgctgtaatttgggatcattaccaatgcaaatcgttcgattgcttgaataaacaaaaccctaacctcggcttccaaccttctcgtgatatttcgaggttcaattcgtataagactgatttggatctcccgatccagcagctgtttcagatcgcggcggccgcgaagtcggtgctgcgcctcggcctcgacgtcggcggcggcaccggctccttcgccgcagcgatgaggctccgcaacgtgaccgtggtaaccacgaccatgaacgtggtggcgccgaacagcgaggccgtcgcgctgcgggggctcgtgccgctgcacatgccactgcagcagcggcttccgctgttcgacggcgtcctggatctagtgcggtgcgggcgcgccgtgaaccggtggattccgttgacggtgatggagtttctgctgctggatgttgatagggtgctgaggggaggagggtacctttgggtggatcattttttcagcaaaggggtggaccttgagaaggtgtatgcgcctttgatcgggaaattggggtacaagaaggtgaagtgggcgacggggaataagaccgatgccggtggggtaaaaaatggggaagtttacttgactgcgttgctgcagaagcctgtgtccagatgagggtggtttcacgcaaaaaagtttgatatatgctataagaacgataagcaggtcggtttatcctgatttccttgctcaaaaaggtgtttatggggcgcgtaatgaagcaattttcatgcccactttgatggatcatagaatcaattcgttgaaacaaagatagaagaaggaagtcaatgacaggtgtatatccatggggaaactgatcgaggaaaatagtttttggtgatcgttttttgttaatcctatttgatcaaattatgttattccaattaattgttttgaaataaatttaagaaacgccattgcctggttggctttcatata

SEQ ID NO: 10715 - DNA, 1039 bp, Vitis vinifera
cctctccctttaccacctgtcttctactattcaatccaagcctacgccgcctcccgcacctgttcccgaccacctccgccaccagctcaacaccatacgcgccaccctcacccaccttactcgcctccgctccacctcctcctcctccgcctcctccgccactccctctgatctcctcctctacacccacctctcccccatggcctcctcctgccgcgaccatcccgacctcctgcacacctacatgacctacactcccttttctctttgccctgaygattcccaactcgccgaatctctcatcctccgcggctgccaccccctcccccgccgccgttgctttgcccgaactccctccaagctcccctcctctcttcccgccgatccgttctctcccctccctgactccgccgtgctgtggaccaagtactcctgcaagagcttctcctgcttcgacggaggcctaggattcaacatgaagctcgaagcttcgagattcacgagctcasggtcgaatctggatctcacgattccgcaattgctgcagattgcgaaggatgcttcctcagtgattcgcattgggctggacatcggcggcggaactgggacattcgccgccaaaatgaagccctacaatgtgaccgttgtgtcgacgacgatgagccagggagcgccgtacaatgaggcgacggcgttgagggggctggtaccactgcacgctccgctgcagcagcggttgccggtgttcgacggagtagtggatctagtgcggtgcgggcgcgccgtgaaccgctggataccgactgtggcgatggagttctttttctatgatgtggatcgggtgttgaggggcggcggatacttgtggttggaccattttttcagcaaaggagcggatcttcaaaaactttatgcgcccgtgattgggaaattggggtacaagaaggtgaagtggacaatggcgaataagactgattccagcggggtgaagaatggggaggtttatttgactgctctattgcagaagcctgtatctaga

SEQ ID NO: 10716 - DNA, 1519 bp, Vitis vinifera
ggcagagggaaggagagaaatgggtttgaccatgggactgaacctgctgcttctagtggccatggtggccacaaacatcctctccctttaccacctgtcttctactattcaatccaagcctacgccgcctcccgcacctgttcccgaccacctccgccaccagctcaacaccatacgcgccaccctcacccaccttactcgcctccgctccacctcctcctcctccgcctcctccgccactccctctgatctcctcctctacacccacctctcccccatggcctcctcctgccgcgaccatcccgacctcctgcacacctacatgacctacactcccttttctctttgccctgatgattcccaactcgccgaatctctcatcctccgcggctgccaccccctcccccgccgccgttgctttgcccgaactccctccaagctcccctcctctcttcccgccgatccgttctctcccctccctgactccgccgtgctgtggaccaagtactcctgcaagagcttctcctgcttcgacggaggcctaggattcaacatgaagctcgaagcttcgagattcacgagctcagggtcgaatctggatctcacgattccgcaattgctgcagattgcgaaggatgcttcctcagtgattcgcattgggctggacatcggcggcggaactgggacattcgccgccaaaatgaagccctacaatgtgaccgttgtgtcgacgacgatgagccagggagcgccgtacaatgaggcgacggcgttgagggggctggtaccactgcacgctccgctgcagcagcggttgccggtgttcgacggagtagtggatctagtgcggtgcgggcgcgccgtgaaccgctggataccgactgtggcgatggagttctttttctatgatgtggatcgggtgttgaggggcggcggatacttgtggttggaccattttttcagcaaaggagcggatcttcaaaaactttatgcgcccgtgattgggaaattggggtacaagaaggtgaagtggacaatggcgaataagactgattccagcggggtgaagaatggggaggtttatttgactgctctattgcagaagcctgtatctagatgaggttcgactttgaggttgttttacaggcactgctgtccgatgtgaagggtttggctggtgggaaactccaaaactagtttccatgcacttgtaggagatgacatccccctcctgttcagtagagaagcaaaatatgtatgtctctgctaaaaaggattgtgacaatgtaaaggattgtagaatgaagaaatgataagggaatgaagagtagagtgtggaaccgtattgggaaaaagcatgttcaagttaggtggtctttattggcctattagcttagatttactctattcaagtttattaattgttttgaaataatgtatgaattattgcttctttatatggtgggacgggattataaaagggaaaaataatgatagtggattactggattcagtggaa

SEQ ID NO: 10717 - DNA, 1233 bp, Glycine max
taagttttgtcttttatttgcagaaacggaccaacgcttagggtttggtgttttccgaattagggtttgtgattggatcttcatcttcaccaatcaatcaccataaccataacttgttcttctctctcgccatgacggacggctcctggaatcggcagcagcagccgtttctcccttcttccgccatgcttaaacgacctcgtactgaatacgatatttcaccttctggtctgacttcagggggcaatgagatgcataattatattggtcgaaatgatgaccatactggtcaccgaattctaaaggacactaaaacacttggatctgcttttgaccgctaccttcaaagcgctgggcttacttcgtttaactcgggggaagccagcgcaattggcagtgttggtttggaaaggggtgttggtggattgccacgccattcactaactgatcctgctgtcatggggcatcctggtggtggtcatgatcttgcacgaggtggacggaatgtcaattatggtgaccagttaccagtagatgcagcttccatgcctggacctgagactgtacctctacccccagatgcttcaagtactttatatgttgaaggtcttccatctgacagtacgagacgggaagtggctcatatttttcgcccttttgttggatatagagaagtaagacttgtgagcaaagaatccaaacatcgtggtggagatcctctaatcctttgttttgtggattttgcaaatccggcctgtgcagcaactgctctgagtgcattgcaaggttataaagttgatgaactcaatcctgagtctagtcacttgcggcttcagttttctcggtttcctggtcccagatctggacctggacctcgtggcaagaggtgaagtcgttcacccaagacatttaggttttatgcttgtcacaatgacttgaattcctttatccataccattctgggatgagaatattcacgaatcaatgttctccacaagcaaatataagtctccctcctggcttcgatcctaattacagagctcgtgaggtgcacatattattttaactggctgagatcaaactacatttgcatatgagcacaaatctaacatggagatttttgggatgggccaagtcaatttattgtgttgtataaatattgatatttttttaatgatcctagttagcatttgttttttgttggccaaataaaggtataattattatatttta

SEQ ID NO: 10718 - DNA, 1078 bp, Glycine max
atgacggacggctcctggaatcggcagcagcagccgtttctcccttcttccgccatgcttaaacgacctcgtactgaatacgggggcaatgagatgcataattatattggtcgaaatgatgaccatactggtcaccgaattctaaaggacactaaaacacttggatctgcttttgaccgctaccttcaaagcgctgggcagcttacttcgtttaactcgggggaagccagcgcaattggcagtgttggtttggaaaggggtgttggtggattgccacgccattcactaactgatcctgctgtcatggggcatcctggtggtggtcatgatcttgcacgaggtggacggaatgtcaattatggtgaccagttaccagtagatgcagcttccatgcctggacctgagactgtacctctacccccagatgcttcaagtactttatatgttgaaggtcttccatctgacagtacgagacgggaagtggctcatatttttcgcccttttgttggatatagagaagtaagacttgtgagcaaagaatccaaacatcgtggtggagatcctctaatcctttgttttgtggattttgcaaatccggcctgtgcagcaactgctctgagtgcattgcaaggttataaagttgatgaactcaatcctgagtctagtcacttgcggcttcagttttctcggtttcctggtcccagatctggacctggacctcgtggcaagaggtgaagtcgttcacccaagacatttaggttttatgcttgtcacaatgacttgaattcctttatccataccattctgggatgagaatattcacgaatcaatgttctccacaagcaaatataagtctccctcctggcttcgatcctaattacagagctcgtgaggtgcacatattattttaactggctgagatcaaactacatttgcatatgagcacaaatctaacatggagatttttgggatgggccaagtcaatttattgtgttgtataaatattgatatttttttaatgatcctagttagcatttgttttttgttggccaaataaaggtataattattatatttta

SEQ ID NO: 10719 - DNA, 889 bp, Glycine max
caatcaccataaccataacttgatcttctgtctcgccatgacggacggttcctggaatcgacagcagtcgtttctccctccttccgccatgctcaagcgacctcgtactgaatacgatatgtcaccttctggtctgacttcagggggcaatgagatgcataattatattgctcgaaatgatgaccatactggtcaccgaattctaaaggacactaaaacacttggatctgcttatgaccgctaccttcaaagcgctgggcttacttcgtttaattctggggaagccagtgcaattagcagtgttggattgggaaggggtgttggtggattgccacatcattcactaactgatcctgctgtcacggggcatcctggtggtggtcatgatctttcacgaaatggacgtaatgtcaattatgccagtcagttaccagtagatgcagcttccatgcctggacctgagactctacctctacccccagatgcttcaagtactttatacgttgaaggtctcccatctggcagcacgagacgggaagtagctcatatttttcgccctttcgttggatatagagaagtaagacttgtgagcaaagaatccaaacatcgtggcggagatcctctaatcctttgttttgtggattttgcaaatccggcctgtgccgctactgctctgagtgcattgcaaggttataaagttgatgaactgaatcccgagtctagtcacttgcggcttcagttttctcggtttcctggtcccagatctggacctggacttcgtggcaagaggtgaggtcgttcacccaaagcatttaggttttatgcttgttacaatgacttgtattcctttatccatacgattctggggtgagaatattcacaaatcaat

SEQ ID NO: 10720 - DNA, 1152 bp, Glycine max
gggtttggtcttttggtgtttttgcgaattagggtttgtgattggatcgccatcttcaccaattaccattaccataaaacttaatcttctctctcgccatgacggacggcttctggaatcggcagcagccgcttcacccttcttccaccatgctcaaacgacctcgtactgaatatgatatgtcaccttctggtctgacttcagggggtaatgaaatgcataattatattgctcgaaatgatgaccacaccggtcatcgaatgctaaaggacactaaaacaattggatctgcttatgatcggtaccttcaaagtgcagggcttacttcttttaattctggggaagccagtgcggttggcggtgttggattgggaaggggtgctggtggattgccacaccattcactaactgatcctgctgtcatggggcatcctggtggtggtcatgatcatgcacgaaatggacggaatgtcaattatggtggtcagttaccattagatgcagcttccatgcctggacctgagactgtacctctacccccagatgcttcaagtactttatatgttgaaggtctcccatctgacagcacaagaagggaagtggctcatatttttcggccttttgttggatatagagaagtgagacttgtgagcaaagaatccaaacatcgtggtggagatcctctaatcctttgttttgtggattttgctaatccggcctgtgcagcaactgctctgagtgcattgcaaggttataaagttgatgaactcaatccagagtctagccacttgcggcttcagttctctcggtttcctggtcccagatctggacctggacctcgtggcaagaggtgagccagttcacggaaggcatttaggttttatgcttgtcataatgtcctcctttatctgtatcgttctggggtgagaattcacatgcaaatttagtcttttcctcctagtcctggctacaatcctagttatagagcttgcgaggtgcacatagtttttacaggctgaaatcaaactacaattgcattttgagcaaaatccaacatggagatttttgggatgggcctagtcaatttactgtgttgtataaatattgataattttagtatgaacctaattaaggtataatttattttattta

SEQ ID NO: 10721 - DNA, 1121 bp, Glycine max
tttttttttttttttttttaaataaaataaattataccttaattaggttcatactaaaattatcaatatttatacaacacagtaaattgactaggcccatcccaaaaatctccatgttggattttgctcaaaatacaattgtagtttgatttcagcctgtaaaaactatgtgcacctcgcaagctctataactaggattgtagccaggactaggaggaaaagactaaatttgcatgtgaattctcaccccagaacgatacagataaaggaggacattatgacaagcataaaacctaaatgccttccgtgaactggctcacctcttgccacgaggtccaggtccagatctgggaccaggaaaccgagagaactgaagccgcaagtggctagactctggattgagttcatcaactttataaccttgcaatgcactcagagcagttgctgcacaggccggattagcaaaatccacaaaacaaaggattagaggatctccaccacgatgtttggattctttgctcacaagtctcacttctctatatccaacaaaaggccgaaaaatatgagccacttcccttcttgtgctgtcagatgggagaccttcaacatataaagtacttgaagcatctgggggtagaggtacagtctcaggtccaggcatggaagctgcatctaatggtaactgaccaccataattgacattccgtccatttcgtgcatgatcatgaccaccaccaggatgccccatgacagcaggatcagttagtgaatggtgtggcaatccaccagcaccccttcccaatccaacaccgccaaccgcactggcttccccagaattaaaagaagtaagccttgcactttgaaggtaccgatcataagcagatccaattgttttagtgtcctttagcattcgatgaccggtgtggtcatcatttcgagcaatataattatgcatttcattaccccctgaagtcagaccagaaggtgacatatcatattcagtacgaggtcgtttgagcatggtggaagaagggtgaagcggctgctgccgattccagaagccgtccgtcatggcgagagagaagattaagttttatggtaatggtaattggtgaagatcc

SEQ ID NO: 10722 - DNA, 866 bp, Glycine max
gccaaggcttagggtttggtcttttggtgtttttgcgaattagggtttgtgatttgatctccatcttcaccaatcaccattaccataacttgatcttctctctcgccatgacggacggcttctggaatcggcagcagcagcagccgcttcaaccttcttccgccatgctcaaacgacctcgtactgaatatgatatgtcaccttctggtctgacagggggtaatgagatgcataattatattgctcgaaatgatgaccataccggtcatcgaatgctaaaggacactaaaacacttggatctgcttatgaccgctaccttcaaagtgcagggcttacttcgtttaattctggggaagccagtgcaattggtggtgttggattgggaaggggtgttggtggattaccacgccattcactaactgatcctgctgtcatggggcatcctggtggtggtcatgatcttgcacgaaatggacggaatgtcaattatggcggtcagttaacagtagatgcagcttccatgcctggacctgagactgtacctcttcccccagatgcttcaagtactttatatgttgaaggtctcccatctgacagcacaagaagggaagtggctcatatttttcgcccttttgttggatatagagaagtaaggcttgtgagcaaagaatccaaacatcgtggtggagatcctctaatcctttgttttgtggattttgcaaatccggcctgtgcagcaactgctctgagtgcattgcaaggttataaagttgatgaactcaatcctgagtctagtcacttgcggcttcagttctctcggtttcctggtcccagatctggacctggacctcgtggcaagaggtga

SEQ ID NO: 10723 - DNA, 828 bp, Glycine max
atgacggacggttcctggaatcgacagcagtcgtttctccctccttccgccatgctcaagcgacctcgtactgaatacgggggcaatgagatgcataattatattgctcgaaatgatgaccatactggtcaccgaattctaaaggacactaaaacacttggatctgcttatgaccgctaccttcaaagcgctgggcagcttacttcgtttaattctggggaagccagtgcaattagcagtgttggattgggaaggggtgttggtggattgccacatcattcactaactgatcctgctgtcacggggcatcctggtggtggtcatgatctttcacgaaatggacgtaatgtcaattatgccagtcagttaccagtagatgcagcttccatgcctggacctgagactctacctctacccccagatgcttcaagtactttatacgttgaaggtctcccatctggcagcacgagacgggaagtagctcatatttttcgccctttcgttggatatagagaagtaagacttgtgagcaaagaatccaaacatcgtggcggagatcctctaatcctttgttttgtggattttgcaaatccggcctgtgccgctactgctctgagtgcattgcaaggttataaagttgatgaactgaatcccgagtctagtcacttgcggcttcagttttctcggtttcctggtcccagatctggacctggacttcgtggcaagaggtgaggtcgttcacccaaagcatttaggttttatgcttgttacaatgacttgtattcctttatccatacgattctggggtgagaatattcacaaatcaat

SEQ ID NO: 10724 - DNA, 738 bp, Glycine max
atgacggacggcttctggaatcggcagcagcagcagccgcttcaaccttcttccgccatgctcaaacgacctcgtactgaatatgggggtaatgagatgcataattatattgctcgaaatgatgaccataccggtcatcgaatgctaaaggacactaaaacacttggatctgcttatgaccgctaccttcaaagtgcagggcagcttacttcgtttaattctggggaagccagtgcaattggtggtgttggattgggaaggggtgttggtggattaccacgccattcactaactgatcctgctgtcatggggcatcctggtggtggtcatgatcttgcacgaaatggacggaatgtcaattatggcggtcagttaacagtagatgcagcttccatgcctggacctgagactgtacctcttcccccagatgcttcaagtactttatatgttgaaggtctcccatctgacagcacaagaagggaagtggctcatatttttcgcccttttgttggatatagagaagtaaggcttgtgagcaaagaatccaaacatcgtggtggagatcctctaatcctttgttttgtggattttgcaaatccggcctgtgcagcaactgctctgagtgcattgcaaggttataaagttgatgaactcaatcctgagtctagtcacttgcggcttcagttctctcggtttcctggtcccagatctggacctggacctcgtggcaagaggtga

SEQ ID NO: 10725 - DNA, 759 bp, Medicago truncatula
atggcagatggcttctggaatcgacagcagcagcatctccctcctcccggcggcatgctcaaaagaccccgtactgaatatgatacggcaccttctggtgtaacctcaggcaatgaggtgcataattatattgctcaaaacaatggtcaccaaatgctaaacgacactaaaatactcgggtctgcttatgaccgcttccttcagagtgcagggcttacttcatttaattctggggaggctagtgtaattggtggtgttggatttgcaaggggtgttggtgaattgccaggccattctctgggtgatccttctgccatggggcatcttagtggtgttggtggtggccctgatctttcacgaaatgggcgtgatgtcaattttggtggtcagctacctatagatgcagtttccaggcccgggcctgagacaataccactaccccgagatgcttcaagtactttatatgttgaagggctcccatctgacagcacaaaaagagaagtggctcatatttttcgcccttttgtcggatatagagaagtaagacttgtggccaaagaatccaaacatcgaggtggagatcctttaatcctttgttttgtagattttgcaaatccggcttgtgcagcaactgccttgagcgccttgcaaggctataaagttgatgaaatcaatcctgagtcaagctacttgcgccttcagttttctcggtctcctggccgaagaagtggcgggcctggacctcgcggcaagaggtga

SEQ ID NO: 10726 - DNA, 1263 bp, Glycine max
ttttttttttttttttttctcaatatccattatagctatttaagctattggaataatatccactatattacagtaaccccatataccacatacccaagtttggtatgataatattgaataaaaaaaatagtaatagaataataatagttgtttgggaagctcaaaggaaacgctaccataaatcaaacaccaggataatgtaatttagcaaataatgatacatcagagtaactgaatacatgttctaaaaatcctcatctgttagttttatgctaattgaaattgtactttgatctcggcctgttccaagggctctaataaggattgtgtccagtgagggtaaataaaattgcatgtggtgtatcacccccaaaacgatggtgtaaagaaccactgacattctgatgagcataaaacctagatggcttttgtgaaccagatcatcttttaccacgaaaagcaggtccacttcttggaccaggataccgagaaaactgaagccgcaagtgactagattcaggattgagttcatcaactttataaccttgcaaggcactcatagcagttgctgcacaagctggatttgcaaagtccacaaaacaaaggtaatgaggatctccaccacgatgtttggattctttgctcacaagtctaacttctctatacccaacaaaagggcgaaaaatatgagctacttcccttctggtgctatcagaagggagaccttcaacatatagagtacttgaagcatctggaggtagagatactgtctcaggtccaggtctggaaactgcatctacaggtagctgaccaccatagttaacaccccgtccatttggtgctagatctggaccaccacccccatgacgccccatgacagaaggatcagctagtgaatggtctgataatccaccaccacccctagccaacccaagacccccaactgtactggcttccccagaagtaaatgaagaaagttgcccactctgaaggtagcggtcataagcagatccaattgtttttgtgtcctttagcattcggtgaccggtacggtcatcatcacgagcaaaattattatgcatctcattaccgtagtcggaacgcggtcgtttgagcatgccggattgagacagaagcgtctgttgtcggttccagtagccgtccgtcatggcgcgaagaaaccctgattttgggaagatggagattggggaattgcagaaaccctaaccctgggttggtgctgtgttggtgttggaaacttcc

SEQ ID NO: 10727 - DNA, 1488 bp, Glycine max; identical to SEQ ID NO: 10702

SEQ ID NO: 10728 - DNA, 2243 bp, Glycine max
tgaagagcgggtaacaaggagagagagagagaggtttttacacaaaggagaattgagttgggttgggggcatggaagaagaagaagggcttgccatgctcatcactcaccttcaccttcaccttcaccatttctctcactctctttctcctccttttacccttcaccctccagtctctcatcaactccccagattctccttctttgacattgatgattactccgtagatgacttctgtggccttgtaatggcagctggaaagtctggaagttccaggatgatggaacctctaaagcatccatctaagaagtctcgaagagataggagctgtggaaaatcatctggaaggtcctccagggatgaagctatggaacaacaaatttggaaaaatttgcctgaggatctatttgagcctgtgattgcacgacttcccattgccacatttttccgcttccgctctgtatgccagcgatggaattccttgctgtcttctcaaagtttttctctgcattgtgctcaagtcaaacaagcaaacccatggttttacactgtaactcatgaacatgcaaattctggagccatgtatgacccttctatgaagaagtggtaccatcccactatatcaacactgcccgcagagttgatagttttaccagtggcttctgcagggggtctagtttgctttcttgacatttatcatcaaaatttctatgtttgtaacccattgattcaatccttaaaggagttaccagctcggtcagttagggtttgggctcgtgatgctgtaggaatgacagtaaatgggaactcaactggtgctggctacaagatcctattggtgggttgtgatggagaatatgaaatttatgactccctaacaaagtcttggagccatccagaaaaaatgccttcagatattaagctgccgctgtcactcaattttaggtcacacgctgtttctattaacagcaccctgtacttcatgcattcagatcccaaagggattgtttcgtatgatatggcaactggggtttggacacagtacataatcccagcgccattgcatctgactgaccacatgctggccgagtgcgatggccggctattgcttgttgggctgctcacgaagaatgcagccacatgcatatgcatatgggagctgcagaagatgactttcttgtggaaggaggttgacagaatgccaaacgtctggtgcttggacttttatgggaagcacgttagaatgacttgcttgggaaacaaagacttgctcatgttatccttgagatcaagacaaatgaatcgattggttacttacaacatagcaagtagggaatgggtgaaagttccttggtgtctggtgccacatggaagaaaacggcaatggatagcacatggtactgcattttatccatgcctctctgcaatggcctgatttagcttgtataatacagcaatggcctgagaatatttccctcaaaacatgaggttctttgcaatttgctggtaattgaggctgatgtaggaaaaataatgttcattgctggttaacaaagcagatggaaaacgatatgggtttgtagtacttcatgtatttttcatgctctcaaacatgcacctcgatcacttgctttcaagacttttccctgtatatgaatgttgtgaaggtttaattccagctagtatcattcatgttttcaagctggaaggtccaaactggggttggctctaccaactagaattgaagccttgtgaatcaggggagaggcatatgaagaacctaaaacgttctcaacctggccttgcagtctggtgtcacttggctgcctcatgctgaatccttgttgctcttgcagtcctgcattacatatatataacatcatgtttctactgaaatttgtgacttcaaaaggtgtgttcttccacatttgtgttgttatgactgctgtctgctaagtgcgaactgtggcttttctcaggttgcttacagcgtcacacgggaaagaagctgggatttcaattttgatggctccccccaactactcaatgtagtacacccttcaagtgaaggtctttattattttacggcttatgattgttgtctctattttcggacagtgggaacgaagaaccaaccactatacagataatttattttgcgtttgatcgctgaatagagatttcgatacagtaactttgtttcgctagtcaaaacataaaagatgaagaagagtgatttcttt

SEQ ID NO: 10729 - DNA, 2239 bp, Glycine max
ggggaaaatgaagagcgggtaacaaggagagagagagagaggtttttacacaaaggagaattgagttgggttgggggcatggaagaagaagaagggcttgccatgctcatcgctcaccttcaccttcaccttcaccatttctctcactctctttctcctccttttacccttcaccctccagtctctcatcaactccccagattctccttctttgacattgatgattactccgtagatgacttctgtggccttgtaatggcagctggaaagtctggaagttccaggatgatggaacctctaaagcatccatctaagaagtctcgaagagataggagctgtggaaaatcatctggaaggtcctccagggatgaagctatggaacaacaaatttggaaaaatttgcctgaggatctatttgagcctgtgattgcacgacttcccattgccacatttttccgcttccgctctgtatgccagcgatggaattccttgctgtcttctcaaagtttttctctgcattgcgctcaagtcaaacaagcaaacccatggttttacactgtaactcatgaacatgcaaattctggagccatgtatgacccttctatgaagaagtggtaccatcccactatatcaacactgcccgcagagttgatagttttaccagtggcttctgcagggggtctagtttgctttcttgacatttatcatcaaaatttctatgtttgtaacccattgattcaatccttaaaggagttaccagctcggtcagttagggtttgggctcgtgatgctgtaggaatgacagtaaatgggaactcaactggtgctggctacaagatcctattggtgggttgtgatggagaatatgaaatttatgactccctaacaaagtcttggagccatccagaaaaaatgccttcagatattaagctgccgctgtcactcaattttaggtcacacgctgtttctattaacagcaccctgtacttcatgcattcagatcccaaagggattgtttcgtatgatatggcaactggggtttggacacagtacataatcccagcgccattgcatctgactgaccacatgctggccgagtgcgatggccggctattgcttgttaggctgctcacgaagaatgcagccacatgcatatgcatatgggagctgcagaagatgactttcttgtggaaggaggttgacagaatgccaaacgtctggtgctcggacttttatgggaagcacgttagaatgacttgcttgggaaacaaagacttgctcatgttatccttgagatcaagacaaatgaatcgattggttacttacaacatagcaagtagggaatgggtgaaagttccttggtgtctggtgccacatggaagaaaacggcaatggatagcacatggtactgcattttatccatgcctctctgcaatggcctgatttagcttgtataatacagcaatggcctgagaatatttccctcaaaacatgaggttctttgcaatttgctggtaattgaggctgatgtaggaaaaataatgttcattgctggttaacaaagcagatggaaaacgatatgggtttgtagtacttcatgtatttttcatgctctcaaacatgcacctcgatcacttgctttcaagacttttccctgtatatgaatgttgtgaaggtttaattccagctagtatcattcatgttttcaagctggaaggtccaaactggggttggctctaccaactagaattgaagccttgtgaatcaggggagaggcatatgaagaacctaaaacgttctcaacctggccttgcagtctggtgtcacttggctgcctcatgctgaatccttgttgctcttgcagtcctgcattacatatatataacatcatgtttctactgaaatttgtgacttcaaaaggtgtgttcttccacatttgtgttgttatgactgctgtctgctaagtgcgaactgtggcttttctcaggttgcttacagcgtcacacgggaaagaagctgggatttcaattttgatggctccccccaactactcaatgtagtacacccttcaagtgaaggtctttattattttacggcttatgattgttgtctctattttcggacagtgggaacgaagaaccaaccactatacagataatttattttgcgtttgatcgctgaatagagatttcgatacagtaactttgtttcgctagtcaaaacaaaaaaaaaaaaaaaa

SEQ ID NO: 10730 - DNA, 1983 bp, Glycine max; identical to SEQ ID NO: 10696

SEQ ID NO: 10731 - DNA, 384 bp, Glycine max
atggatgtgttaacaacattgactgcagataagccagtggtgatcttcagcaagagcacatgttgcatgagccacaccgtgaaggctctcatatgcagctttggtgccagccctacaattattgaggttgacaaaatgccaagtggtcagcaagtagagagagcactcattcaactaggttgcaaaccaagtgtgcctgcagtgttcataggacagcaattcataggtggtgctgatgaagtcatcaaactcaacgttcaaaacaagcttgcccaattgcttctcggtgctaaagctatctttatctggagtagaacagcactgtttgttttgtatattgcaaactatgctttaaccatatatgatgatggccatgtcatgtaa

SEQ ID NO: 10732 - DNA, 454 bp, Glycine max
atggatgtggtaacatcattgactgctgataagccagtggtgatcttcagcaagagcacatgtttcatgagccacaccgtgaaggctctcatatgcagctttggtgccagcccttcggttattgagcttgacaaaatgcaaagtggtcaccaagtagagagagcacttattcaactaggttgcaaaccaagtgtgcctgcagtgttcataggacaacaattcataggtggtgctgatgaagtcatcaaactcaacgttcaaaacaagcttgcccaattgcttcttggtgctaaagctatatttatctggagtaggtagctatgccaagttccaaactcatcatcctcatgtgatcaaataagaggttcttattttctcaaagctgtgtgaggcggtttagtatagagcttcttctagttctagtcatgttccttgttgtattctccatttttct

SEQ ID NO: 10733 - DNA, 559 bp, Oryza sativa Japonica Group
gcttcccttcatcacttccaaaaaagaaaaaaaaaactcgttttcttttcttctcttctcttctcttgttgcggcgaagggggagaggaaggtcgaggtcgacgagatgggcggcggcaatgggcagaagtcgaagatggcgagggagaggaacatggagaagaacaagggcgccaaggggagccagcttgaggccaacaagaaggccatgaacatccagtgcaagatatgcatgcagactttcatctgcaccacctctgagaccaagtgcaaagagcatgctgaggcgaagcatccgaagagcgacctcaccgcgtgcttccctcacctcaagaaataatggcggtggcatctctctgctcaatcagaagagaaaaagagaagctgccataatccactagtatcatcttgtatgcaatgactggttgccctatgtatgggtctaaactttggtcagctgctgctgcttctttggttgtgtgcctcatctaaatatgtaatgctctatcaacctcttgtgcaacgatattaatcttgtgtggatttgctgcctgtgttc

SEQ ID NO: 10734 - DNA, 520 bp, Zea mays
gcccgcactaccacgcgaccacgcccccgctcctctcgtctctttcttcgcctcttccatcgcaggattcggcggccatgggcggcggcaacggccagaagtccaagatggcgcgcgagaggaacgccgagaagaacaagggcggcaaaggcagccagctggaggccaacaagaaggccatgaacatccagtgcaagatctgcatgcagaccttcatctgcaccacctccgaggccaagtgcaaagaacatgcggaggcgaggcatcccaagaacgacctctaccagtgcttcccccacctcaagaattagtaagcagcagaagcatatgatctgctcagctaaaagacaagtactacatatatatatatacgctgtgtgtcaattaatgggttgtaggctgctgttgatgcggctgcttcgttcgtgttgccccgtctgattatgtactgtaacccttggctgtcaacgtactgtgctaaaaaccactggttctgtgtggataaaaaaaaaaaaaaaaa

SEQ ID NO: 10735 - DNA, 516 bp, Hordeum vulgare subsp. vulgare
gaccaaatttccgccgaaccagaaaagtatcgtctcgtctcgccgaggaatcaacagccatgggcggcggcaacgctcagaagtccaagatggcgagggagaggaacctcgagaagctgaagggcggcaaggggagccagctcgaggccaacaagaaggccatgaacatccagtgcaagatatgcatgcagactttcatctgcaccacctctgaagcaaagtgcaaggagcacgccgaggcgaagcatccgaagagcgaccttgtccagtgcttcccccacctcaagcagtgatatctgccaaatcagacggagagggagagataaaagagagagaagctgtcttaatccacctagtattatcatgttccgcaatgactggttgttgacctaagcttgggtctgaactctggtgtgctgctgtcccagctgctttggttgtgtgcccattactatgtaatcgtccactatcagcctgttgtgctacaatatcttaatcctctgtggatttggtttc

SEQ ID NO: 10736 - DNA, 726 bp, Brachypodium distachyon
tctattataaacgccgccgccgccgcgtcttctcctctttctttccctaccaccgaaaaatttctccagccgaaaaacttcctccgaggaagagcatcctctcgtctcgtctcgttctcgccgaggagaaagaagccatgggcggcggcaacgcgcagaagtccaagatggccagggagaggaacctcgagaagctcaagggcggcaaggggagccagctcgaggccaacaagaaggccatgaacatccagtgcaagatatgcatgcagactttcatctgcaccacctctgaagcaaagtgcaaggagcacgccgaggcgaagcatccgaagagcgagctcacccagtgcttcccccacctcaagcagtgaaatctgcctaatcacagtgagagagagataaagagagagagaagctgtcgtaatccacctagtattatcatgttccgcaatgactggttgttgcccaaagtttgggtctgaacttcggtatgctgctgtcccagctgctttggttgtgtgcccatatactatgtaatcgtcctgtatcagcctgttgtgctacaatattttaattctgtgtggatttgctgcttgtgttaagtctatttgtcgaagaagttgatcctggttatttctcatgtaattcagcatgatcttggttttctctctttgctgctgtgccattaaaacatgagatagcagaggttgaacatgaaaatgtttg

SEQ ID NO: 10737 - DNA, 513 bp, Zea mays
gggtccgccgcccgcactaccacgcccccgctcctctcgtctctatcttcgcctcttccatcgcaggattcagcggccatgggcggcggcaacgcccagaagtccaagatggcgcgcgagaggaacgccgagaagaacaagggcggcaaaggcagccagctggaggccaacaagaaggccatgaacatccagtgcaagatctgcatgcagaccttcatctgcaccacctccgaggccaagtgcaaagaacatgcggaggcgaggcatcccaagaacgacctctaccagtgcttcccccacctcaagaattagtaagcagcagaatcatatgctctgctcagctaaaacacaagtactacatatatatatacgctgtgtgtcaattaatgggttctaggctgctgttgatgcggctttcctgttgccccgtctgattatgtactgtaaccttggctgtcagcctgctgtgctaaaaaccactggttctgtggattcatgcaaaaaaaaaaaaaa

SEQ ID NO: 10738 - DNA, 593 bp, Zea mays
acggatccaccggagagatctggtctgccattccctcgctccttcccgtgaaccacaaacctaacgcggagcggcgcgggccggccgccgggcgaggtgcgcgtagctgccgtcgattgtcgccggatccatccaccatgggcggtggcaacggccagaagtccaagatggcccgcgagcgcaacttggagaagaacaagggggccaaggggagccagctcgagaccaacaagaaggccatgagcatccagtgcaaagtgtgcatgcaaacattcatgtgtaccacgactgaagtgaagtgccgggagcacgccgaggccaagcatcccaagacagacgtgtaccagtgcttcccccatctgaagaagtgaaaggcctgaacttagcaaccagtgctggtttggtcactacgatcgggccagggggcgttccttgtgttgagggtgttcattccgtgttatcttcccgtcagtcatgcgtcctgtcctatgttaacctacataagaaagcgatgtggtgtccacttctagtgaaactactgtctgctgttaaaacctggttggtttcagaacgataaaaaaaaaaaaaaaaaa

SEQ ID NO: 10739 - DNA, 489 bp, Glycine max
gaagaaagctgcacagttaagctagcttccattcggtttgatcgttctctctgaacaaccccagccatgggaggaggaaatggacagaaggccaagatggctcgtgagagaaacatggagaaaaataaacctgccaaaggtagccagttagaggccaacaagaaggccatgaacatccagtgcaaggtgtgcatgcagacattcatatgtaccacatcggaagttaagtgtcgagaacatgctgaagccaagcatcccaaggctcatctctacacttgctttccgcatcttaaaaactgactacttattatattacattgcaaaaccataacttgtacttgtagatgcacatttcattgtaaaaccactctatttaatactgatatatgaaactatctatcaaaaagtcctcaaatgttaccttcggaagttgatttgggattatgattatgattatgattatgaatgagtttgattcccttacccccc

SEQ ID NO: 10740 - DNA, 579 bp, Vitis vinifera
ccatcacctgaaacaaaattagggtttgagtgggtgaaagtagggttgtcagaaatgggaggaggcaatggccagaagtcgaagacggcgcgtgagcggaacatggagaagacgaaagccgccaaaggaagccagcttgagtcaaacaagaaagcaatgacaatccagtgtaaggtgtgtatgcagacattcatctgcacgacatctgaggcaaagtgcaaggaacatgctgaagcaaagcatcccaaatctgagctttctacctgtttcccccatctgaaaaaataagtggattgagtgaaacaattgggttgagaggagttgggaagatatactttgtttaaatggatgaacccgatctagtatgatcatgcagaagttatgccaagcccgtatttgttaatggtagttgcttgatggacgttctggagaaagattgatcatgtatgtcatttaaactggttcttcttatgtctcttaaaaagagtgtgttcacgtgtagtctttgttaaaaagtgaacatcttaattgatctgggaccatatcacatgtttattggtggttctggtgtagtgcccg

SEQ ID NO: 10741 - DNA, 2243 bp, Glycine max; identical to SEQ ID NO: 10728

SEQ ID NO: 10742 - DNA, 1398 bp, Medicago truncatula; identical to SEQ ID NO: 10695

SEQ ID NO: 10743 - DNA, 1641 bp, Vitis vinifera
atggtggtctcctcgccgattacgcctgggcaggtgtcttttttgctgggaatcatccctgtttttgttgcatggatatattccgagtttttagaatataagaagtcttcatctccctctaaagttcattcagacaataatctggttgaattgggaagtgagacaatcaaggaagatgatcgggctattttactggaaggaggtcttacaaaatcagcatctgcaaagttcaatagttcatccatcaaagtgaacttaattaggtttttaacaatggatgactccttcttgctggaaaaccgattaactttgagagcaatgtctgagtttggggcaattctgacatacttctacgtatgtgaccgcacagagttactgggtgactctactaagaactacaatcgcgacctcttcatctttctctacttgcttcttgtcatagtttgttttatgacttctcttaagaaacatcatgacaagtcagcattctctggaaaggccttactttatcttaaccggcatcaaactgaggagtggaaaggatggatgcaggttctatttctaatgtaccactactttgctgctgcggagatatacaatgcaattcgtgtctttattgctgcatatgtctggatgactggatttggaaacttctcctattattacatcaggaaggattttagccttgcacgctttacacagatgatgtggcggctaaatttctttgtggcattttgctgcattgttcttaacaatgactacatgctatactatatctgccccatgcacacgcttttcactcttatggtatatggagcccttgggatttttaacaagtataatgagataaggtctgtgatggctgtgaagatccttgcatgctttcttgtggttatcttgatctgggaaattcctggagtttttgacattttctggagtccttcagcattcttattaggttacagtgatccagatccttctaaacaaggtctccctcgactgcatgaatggcattttagatctgggcttgatcgctatatttggatcatcggaatgatatatgcctattatcaccctaatgttgagaagtggatggagaaattggaggaaactgaaactaagcggagactcacgatcaaaacaagcattgttacagttaccgtatttgttggttatttgtggtatgaatacatttacaagctggacaaagttacatataataagttccatccctacacatcatggattccaataactgtttatattagcttgcggaatttcactcagcagcttagaagttactctttaactctctttgcttggcttggcaagatcactttggagacttatatttctcaattccacatctggttgagatcaaacaagcctaatggacagcctaagtggcttctttcttttattccagattatccgttgctcaacttcatgctcacgactgccatctatatcttaatatccctccgcctttttgaactaaccaatacacttaagacagtttttattcctacaaaggacaatcgccggctgctgcataattttcttgctggaattggcatttctgtgtgtttatattgcattgggttcattcttcataagattcctcacgcacaaaatccataa

SEQ ID NO: 10744 - DNA, 2330 bp, Glycine max
gacattttctctattcttcaagcaaactcttcgtctcagatctctctttctctctctctagggtttccgtttctctctctgctatttatgatcactctctgacgcgcttctgtcaccaaatcaagtgcttccgtctcttccccttcttctctgattggaaggattcgtgtggtcggagatggtggtttcggggccaatcacgccggggcaggtgtctttcttgctgggggttattccagtttttgtttcatggatatattcagagtacttagagtacaagaaactctcatctcctcccaaagttcattcagatgctagtcttgaagagttggggaaggatgcaattaaggaagatgatcgggccattttgctggaatcagggcttacaagatcagcatcagcaaaattccatccaccatctgtcaaattgaatttgattcggtttttgaccatggatgattctttcttgttagaaaatcgagcaactttgagagcaatggccgaatttggcctgattctgttttatttctacatatgtgatcgaaccaacatacttggagattccaccaagagttatagtcgggatcttttcatcttcctctaccttcttctgattatagtttcagctttgagttctttgaagaaacataatgactcatcaacattttctggaaaaaacatactttaccttaatcggcatcaaacagaagagtggaaaggatggatgcaggtcctctttttaatgtatcattattttgctgcaacggagatatacaatgcaatacgtgttttcattgctgcatatgtttggatgactggatttggaaacttctcctattattatgttagaaaagattttagccttccacgttttgctcagatgatgtggcggcttaatttttttgtggccttctgttgtattgtgcttaacaatgactatatgctctactatatatgcccaatgcacacgcttttcactttgatggtgtatggagcattgggtatatataacaagtataatgaaattccctctgtaatggctgcaaagattttggcatgctttcttgtggtgatcttggtttgggaaatccctggattctttgacatattttggagcccatttgctttatttttgggttatactgatcctgcaaagcctgatctccctcgaatgcatgagtggcatttcagatctgggcttgatcgctacatctggataattggaatgatttatgcctattttcatccaaatgttgagaaatggatggaaaaattggaagagagtgataccaagaggagagttaccatcaaaactggcatcgtttctgttgcattatttgttgggtacttgtggtatgaatacatatacaagctggacaaggtctcatacaacaagctccacccctacacctcttggattccaattactgtatacatttgcttgagaaatttcagtcagcggcttcggaatttctctttaaccctctttgcgtggcttggcaagattactttggagacatacatttcccagtttcatatttggttaaggtctaacatgccaaacggacagcccaagtggcttctttctcttatcccggagtatcctatgctcaacttcatgctaacaactgctatatacgtctttgtatctcatcgactttttgaattaacaaatacacttaagacagtgttcatacctacaaaagacaatcggaggctgctgcataattttattactggtgttaccctttgcatttctctgtattgcattgcacttattctgcttctgattcctcattcaacggtttgaaattcaagataccaaagagagattacagagacagtaccctttgaatttgctgtgctgaaaggagactaggagatttggattaaaataagggtacatggaaatgtgggatctcttttggagcagtgtttctatagttgtgggaaatagtatcctcgatggcggcatcaaatataaacgttgagtgttggtttgcatcggaggttggcagatgaaaagggggattaaccccgaaggaatttgaaccaattttctataaattcattttgctcacacttaaaaggaggaaaaggtaggatcgtcatacaaatccgtcgtcttggcttcgaagaaattcaagattcatttcattacctctgttcttgttcaattttcgttgtattttttgactttttcttctgtgaaggataaggaaatatatgtatattcatttttacaatcttaccagaaacgccttgtcatacccttgtaacactagttttgtttaatggctataagtgcaagtagtgttactttttccttt

SEQ ID NO: 10745 - DNA, 2022 bp, Arabidopsis thaliana
gaacggaccagaaaagagaacattcgccaaaccaaccaacaaccgtttgggtgagcttgacgagaacgacgtcgcacccgccattttctccatccttgaagcaacaccttcttcacttcagatctcttcttcttcttcttcttcttcttcttcttcttctttgctcgcaccttccgtgctattgtatttctagggtttcggatcctgtgccttaccttagatccgacggtggagtagaaatcactctccctgtctcttcccttcttttttgtttccagtttttgattgaagatcccttcgtggatccactataatggcggattctcagccaatcacgcctggtcaggtttcgtttctactcggagtcattcctgtcttcatagcatggatttactcagagtttctagagtataagaggtcttcattgcactctaaagttcattcagataataatttggttgaacttggtgaggtaaaaaacaaggaagatgaaggagtagttttacttgaaggaggtcttccaagatcagtctctacaaagttttataactcacctatcaaaacaaacttgattagatttctgacgctggaagactctttcttgattgaaaatcgagcaaccttgagagcgatggctgagtttggggctattcttttttacttttatattagtgatcgaacaagcttgcttggagagtctaaaaagaattacaacagagatcttttcctctttctctactgtcttctcatcatagtttcagccatgacatccttgaagaaacacaatgacaaatcacctataacaggaaaatccattctctatcttaatcgtcaccagactgaagagtggaagggatggatgcaggttctatttcttatgtatcattactttgctgcggctgagatatataatgcaatcagggttttcattgctgcctacgtctggatgactgggtttgggaacttctcttattactatatcagaaaggatttctccctagcacgatttactcagatgatgtggcgtcttaacttatttgtggcgtttagctgcattattctcaataatgattatatgctgtactacatctgtccaatgcacactctgttcactcttatggtgtatggagcccttggtatcttcagtcgatataacgaaataccatcagtaatggctttgaagattgcttcatgctttctcgtggttatcgtgatgtgggagattcctggcgtttttgagattttctggagtcctttaacattcttactgggatacactgatccagctaaaccagaactaccacttttacatgaatggcacttcagatcaggacttgaccgctacatatggatcattggaatgatatatgcctatttccatcccactgtagagagatggatggagaaattggaggagtgtgatgccaagagaaagatgtcaataaagacaagcataattgcaatttcctcatttgttggttacctatggtatgaatacatatacaagcttgacaaggttacatacaacaaatatcatccctacacatcgtggattccaataaccgtctacatctgtctgcgaaattctacacaacagctgcgtaatttctccatgacactatttgcgtggctcggcaagattactctggaaacctatatttctcagtttcacatctggttaagatcgaatgtgccaaatggacagcctaagtggctattatgcattattccagaatacccaatgctcaacttcatgctcgtcacggccatctatgtcttggtgtcccaccgacttttcgagcttacaaacacgttaaagtctgttttcataccaacaaaagacgacaagaggctgctccacaatgttctcgctggagctgccatctcgttctgtttatatttaacatctctcattcttctccagatcccacactaaccatgtaaggccttttactttgcatggtccattgcagccattgttgatcttggtgtgtactcgcttaggaagagatacaattctcg

SEQ ID NO: 10746 - DNA, 1869 bp, Glycine max
aacttgttaagttccaaatcttcaaccactgagagagagacatcccctccgacattttctctattcttcaagcaaactcttccttcgtctcagatctctctctctctctctctagggtttccgtttctcttctgctatttatgatcactctctgacgcgcttctcctaccaaatcaagtgcttccgtctcttctccttcttctctgatttgaaggatttgtgtggctggagatggtggtttcggggccgatcacgccggggcaggtgtctttcttgctgggggttattccagtttttgtttcatggatatattcagagtacttggagtacaagaaaccctcatctcctcccaaagttcattcagatgtttgtcttgaagagttggggaaggatgcaattaaggaagatgatcgggccattttgctggaatcagggcttacaagatcagcatcagcaaaattccatccatcatctgtcaaattgaatttgattcggtttttgaccatggatgattctttcttgttagaaaatcgagcaactttgagggcaatggctgaatttgggctgattctgttttatttctacatatgtgatcgaaccaacatacttggagattccaccaagagttatagtcgggatcttttcatcttcctctaccttcttctgattatagtttcagctttgagttctttgaagaaacataatgactcatcaacattttctggaaaaaatatactttaccttaaccgacatcaaacagaggagtggaaaggatggatgcaggtcctctttttaatgtatcattattttgctgcaacggagatatacaatgcaatacgtgttttcattgctgcatatgtttggatgactggatttggaaacttctcctattattatatcagaaaagattttagccttccacgttttgctcagatgatgtggcggcttaatttttttgtggccttctgttgtattgtgcttaacaatgactatatgctctactatatatgcccaatgcacacgcttttcactttgatggtgtatggagcattgggtatatataacaagtataatgaagttccctctgtgatggctgcaaagattttggcatgctttcttgtggtgatcttggtttgggaaatccctggattctttgacatattttggagcccatttgctttatttttgggttatactgatcctgcaaagcctgatctccctcgaatgcatgagtggcatttcagatctgggcttgatcgctacatctggataattggaatgatttatgcctactttcatccaaatgttgagaaatggatggaaaaattggaagagagtgagatcaagaggagagctaccatcaaaaccagcattgtttctgttgcattatttgttgggtacttgtggtatgaatacatatacaagctggataaggtctcatacaacaagctccacccctacacctcatggattccaattactgtatacatttgcttgaggaatttcagtcagcggcttcggaatttctctttaaccctctttgcgtggcttggcaagattactttggagacatacatttcccagtttcatatttggttaaggtctaacatgccaaacggacagcccaagtggcttctttctcttatcccggagtatcctatgctcaacttcatgctaacaactgctatatacgtctttgtatctcatcgactttttgaattaacaaatacactcaagacagtgttcatacctacgaaagacaatcgaaggctgctgcataattttattactggggttgtactttgcctttctctgtattgcattgcacttattcttcttctgattcctcattcaacggaactgaattaa

SEQ ID NO: 10747 - DNA, 2238 bp, Arabidopsis thaliana
gagtggagacggaaatattgtcgagtcagtgtctctaaccagagactcggaaaaaaatcagtcgccggcgatcgaaaacgacaactcgccgaacgtctttctctcttcttcaagcaaacactttcacatctctctctctctctcatatttatgatgatcgtctgctactagagatcactataaccagatcatcttctttattcgtcggttaacgtctcaatctctctctgttcggaagttttgaatagagatcgttaaaaatggtggatcctggaccaattactccgggccaggtatcttttcttcttggagtaatcccaatatttgttggttggatatactcggagttacttgagtacagaaaatcttgggttcccttgaaacctcactcggataataatctagttgaattgggagacgtagcagagaaggacgacgacaaagctgatctgttggagggaggtcttgcccgatcaccatctgtaaagtttcataattcatctatcagaacaaacataatcaggtttttgagtatggaagattcatttttgctggaacatcgagcaaccttgagagcaatgtcggaatttggggcaatcttaatatatttctatatctgtgaccgcacagaattgcttggagattctaccaagaattacaaccgcgaccttttcctttttctctacgttcttctcatcatagtatcagccatgacatctctcagaaaacacaatgacaagtcacccatatctgggaagtccattctttaccttaatcgccaccaaactgaagaatggaaaggatggatgcaggttttgttcttaatgtatcactactttgctgcggccgagatatacaacgcaatccgtatctttattgctgcttatgtttggatgactggttttggaaacttctcttactactatgtcagaaaggatttctctgttgcacgttttgcgcagatgatgtggaggctgaacttctttgtagcgttttgctgtattgttctcaacaacgactatatgttatactacatctgcccaatgcacactcttttcaccctaatggtatatggagctctgggtatcttcagcaagtacaatgagataggatcggtgatggctctgaagatattttcatgcttcctcgttgtctttttgttgtgggaaattcctggagcttttgaaatattttggggtcccttaacatttttgctaggttacaatgaccctgccaagcccgatcttcatcggctgcatgaatggcactttagatcaggccttgatcgctacatatggatcatcggaatgatttatgcctattatcacccaactgtagagagatggatggagaagttagaggactgtgaaacgaagaaaagactatccataaaggccgctattgttactattactgtgcttgttggctatgtgtggtatgaatgtatctacaagctggacaggaccagttacaacatgtatcatccgtacacatcatggatccccatcactgtttacatatgccttcggaatttcacccaccagcttcgaagtgtctcattgactctctttgcgtggcttggcaagatcactttagagacttacatttcccagtttcatatatggctaagatcaaacatgcctgacgggcaaccaaaatggcttctctctattattccgggataccctatgctcaatttcatgctgacaactgctatatacgtccttgtatctcaccgtctctttgaactaaccaacacactcaagacggttttcgtacccacaaaagacaacaagcgactcttctctaacttcatagctgggattgccatcgctcttccactctattgcttctcattcgttcttcttcagattcatcgttagaaaccgcaaaaacaagtgtttgttctttgtgtttcttcattgtggtcgcatcaaagcaaaggaaaataagtaaaaagacaagttagttttgttgatcattttcttgtgcacattcagcttcaaaggacgttcaccaaaggcagaaccaagaaccgcatagaccaacatcgctcaactacttttctctattgccatacaaaagcgaagtaattgtctccgatttaaagttttcaattttttgtgctatattctttagattttgttttgtaaggattaagcaaacaatatgtagttcgtccaaaaatgtatagtgatgttaaagaattatatgaaattgcaaagttttaaagaagaa

SEQ ID NO: 10748 - DNA, 2229 bp, Arabidopsis thaliana
gagtggagacggaaatattgtcgagtcagtgtctctaaccagagactcggaaaaaaatcagtcgccggcgatcgaaaacgacaactcgccgaacgtctttctctcttcttcaagcaaacactttcacatctctctctctctctcatatttatgatgatcgtctgctactagagatcactataaccagatcatcttctttattcgtcggttaacgtctcaatctctctctgttcggaagttttgaatagagatcgttaaaaatggtggatcctggaccaattactccgggccaggtatcttttcttcttggagtaatcccaatatttgttggttggatatactcggagttacttgagtacagaaaatcttgggttcccttgaaacctcactcggataataatctagttgaattgggagacgtagcagagaaggacgacgacaaagctgatctgttggagggaggtcttgcccgatcaccatctgtaaagtttcataattcatctatcagaacaaacataatcaggtttttgagtatggaagattcatttttgctggaacatcgagcaaccttgagagcaatgtcggaatttggggcaatcttaatatatttctatatctgtgaccgcacagaattgcttggagattctaccaagaattacaaccgcgaccttttcctttttctctacgttcttctcatcatagtatcagccatgacatctctcagaaaacacaatgacaagtcacccatatctgggaagtccattctttaccttaatcgccaccaaactgaagaatggaaaggatggatgcaggttttgttcttaatgtatcactactttgctgcggccgagatatacaacgcaatccgtatctttattgctgcttatgtttggatgactggttttggaaacttctcttactactatgtcagaaaggatttctctgttgcacgttttgcgcagatgatgtggaggctgaacttctttgtagcgttttgctgtattgttctcaacaacgactatatgttatactacatctgcccaatgcacactcttttcaccctaatggtatatggagctctgggtatcttcagcaagtacaatgagataggatcggtgatggctctgaagatattttcatgcttcctcgttgtctttttgttgtgggaaattcctggagcttttgaaatattttggggtcccttaacatttttgctaggttacaatgaccctgccaagcccgatcttcatcggctgcatgaatggcactttagatcaggccttgatcgctacatatggatcatcggaatgatttatgcctattatcacccaactgtagagagatggatggagaagttagaggactgtgaaacgaagaaaagactatccataaaggccgctattgttactattactgtgcttgttggctatgtgtggtatgaatgtatctacaagctggacaggaccagttacaacatgtatcatccgtacacatcatggatccccatcactgtttacatatgccttcggaatttcacccaccagcttcgaagtgtctcattgactctctttgcgtggcttggcaagatcactttagagacttacatttcccagtttcatatatggctaagatcaaacatgcctgacgggcaaccaaaatggcttctctctattattccgggataccgtatgctcaatttcatgctgacaactgctatatacgtccttgtatctcaccgtctctttgaactaaccaacacactcaagacggttttcgtacccacaaaagacaacaagcgactcttctctaacttcatagctgggattgccatcgctcttccactctattgcttctcattcgttcttcttcagattcatcgttagaaaccgcaaaaacaagtgtttgttctttgtgtttcttcattgtggtcgcatcaaagcaaaggaaaataagtaaaaagacaagttagttttgttgatcattttcttgtgcacattcagcttcaaaggacgttcaccaaaggcagaaccaagaaccgcatagaccaacatcgctcaactacttttctctattgccatacaaaagcgaagtaattgtctccgatttaaagttttcaattttttgtgctatattctttagattttgttttgtaaggattaagcaaacaatatgtagttcgtccaaaaatgtatagtgatgttaaagaattatatgaaattgcaaagtttt

SEQ ID NO: 10749 - DNA, 1230 bp, Glycine max
gcatatataattattgaaggagatggtggtgaaaccaatagaagatatagtggtgacaaatacatgtccaaaggctgtggaaagtaagccaaggccacagaaggaacaagcaattaactgtccaaggtgtcattcaattaacaccaagttctgctactacaacaactacagcctcacacagcctaggtatttctgcaagacttgtagaaggtattggactgaaggtggaactctcagaaacatccctgtaggaggtggctctaggaagaacaagagatcttcagcttcttgttccacacctaataatagtcacaataacaataattcaaccaataagaagcttctttctgatctggtcatcacacctccaactctgtcacacactcaaaaccctaatagcaataatgctattcatcaaggccaagatctcaatttggcttttccatcctccaccccagatttcagaaaaatctctgaattggtccaacaaaacaacaacaacaacaatagtagcaacaacagcatgtcagcttcagcttcttcttcttcaaccacaactacaacttccacttctcacctttctgcattggagcttcttactgggatcacttcaagttccagtgctggtttgacttctttcatgcctgtgccggttccatctgatccaaattctatctacacatgtgggtttcctctgcaagatttcaagccaaccttgaatttctctttggatgggatcggaaacgggtacacaagccttcagaatgttcaaagtgggaggctcttgtttccatctgatgacttaagacaggtttctagctccaccatcaccacaatggatcagaaacaacaaggagattcaactgggtattggactggaatgttaggcggaggatcatggtaattaatcatcaagagagtcataaagatatatatttatttacttaatttcttctcttgctttctactaagttaattttccttttgaacttttttcttttgggttttaatgagtttccgtcagatcatgtggggacttcacttgtttggatttcttcataactggctaacagctgataggatcgattcatacatgagtttcttttcctcttctgtcaattccttatatgtatatctggctccgcttatatctcttcatgaccaagtttattttgggatcttgaaatgaagcttattttaggcaggcttcagtagtacttggaaaattaa

SEQ ID NO: 10750 - DNA, 1386 bp, Glycine max
atacaccgtcccacactcacgcacaggtctctaacattccctttttctgcttctgcgtttcaactaaattacaaagcctaccatcatttctctttctctttctttcatcaacttcatcctttgaaaatcctttcttcatcttcatccatccatggacacagctcaatggccacaggagatggtggtgaaaccaatagaagatatagtggtgacaaatacatgtccaaaggctgtggaaagtaagccaaggccacagaaggaacaagcaattaactgtccaaggtgtcattcaattaacaccaagttctgctactacaacaactacagcctcacacagcctaggtatttctgcaagacttgtagaaggtattggactgaaggtggaactctcagaaacatccctgtaggaggtggctctaggaagaacaagagatcttcagcttcttgttccacacctaataatagtcacaataacaataattcaaccaataagaagcttctttctgatctggtcatcacacctccaactctgtcacacactcaaaaccctaatagcaataatgctattcatcaaggccaagatctcaatttggcttttccatcctccaccccagatttcagaaaaatctctgaattggtccaacaaaacaacaacaacaacaatagtagcaacaacagcatgtcagcttcagcttcttcttcttcaaccacaactacaacttccacttctcacctttctgcattggagcttcttactgggatcacttcaagttccagtgctggtttgacttctttcatgcctgtgccggttccatctgatccaaattctatctacacatgtgggtttcctctgcaagatttcaagccaaccttgaatttctctttggatgggatcggaaacgggtacacaagccttcagaatgttcaaagtgggaggctcttgtttccatctgatgacttaagacaggtttctagctccaccatcaccacaatggatcagaaacaacaaggagattcaactgggtattggactggaatgttaggcggaggatcatggtaattaatcatcaagagagtcataaagatatatatttatttacttaatttcttctcttgctttctactaagttaattttccttttgaacttttttcttttgggttttaatgagtttccgtcagatcatgtggggacttcacttgtttggatttcttcataactggctaacagctgataggatcgattcatacatgagtttcttttcctcttctgtcaattccttatatgtatatctggctccgcttatatctcttcatgaccaagtttattttgggatcttgaaatgaagcttattttaggcaggcttcagtagtacttggaaaattaa

SEQ ID NO: 10751 - DNA, 1432 bp, Glycine max
acccacccatattctcttctctctgaagtcttgatattaaaattgataaagtagaaaaaaggtactccattattcattcagtcatacaccgttccacactcacgcacaggtctctaacattccctttattctgcttttgcaacaaaaacgggtccgtttcaactaaattacaaaacctatcatcatttctctttctctttctttaatttcatcaacttcatccttctttcttcatcttcatccatccatggacacagctcaatggccacaggagatggtggtgaaaccaatagaagatatagtggtgacaaatactacatgtacaaaggctgcagtaggttctgtagaaaggaagccaaggccacagaaagaacaagctattaattgtccaaggtgtcattcaattaacaccaagttctgctactacaacaactacagcctcacacagcctaggtatttctgcaagacttgtagaaggtattggactgaaggtgggaccctcaggaacatccctgtaggaggtggctctaggaagaacaagagatcttcagcttcttgtagtaacaatagtcatcacaatgacaataattcaaccaataagaagctttctgcagatctggtcatcacacctccaactttgtcacacactactcaaaaccctaagagcaatgataatagtattattcatcaaggccaagatctcaatttggctttcccatccaccaccaacctttctgcattagagcttcttactgggatcacttctagttccagtactggtttgagtacttctttcatgcctattccagttccatctaatccaaattctatctacacttgtggatttcctctgcaagatttcaagccaggaaccttgaatttctctttagatgggattggaaaggggtacacaagccttcagaatgttcatggtgggaggctcttgtttccatttgaggacctaaaacaggtttctagcaccaccacaatgaatcagacgcaacaaggggattcaactgggtattggactggaatgttaggcggaggatcatggtaattaatcattaagagagtcatataaatatatatttatatttgtttacttaatttcttctcttgctttctactaagtcaatttttttcttttgtacttttttttcgggggggggatgtgttttccttcagatcatgtggggacttcacttgtttggatttcttcataactggctaacagctgataggatcgattcatacgtgggcttcttttccacttccgtcaatttcttatgtgtatctggctcctcttatatctcttcatgatgaccaagttttgggatcttgagaagaagcttaattattttaggcaggcttcagtagtacttggaaaattaaaacaagagttatattacatttggttatatgtaatggtaga

SEQ ID NO: 10752 - DNA, 1746 bp, Glycine max
tttgactcaagaagatgcttgtggcattgctcttgctggtggcattgagcaatgccgttagagttaatggagatggagggcaatgtggttccaacccaacactagaccctagaccacacagtgtctccattttggagtttggtgcagttggagatggtaaaacactcaacaccattgctttccagaatgccatcttctatctcaagtcatttgctgataagggtggggctcagctctatgttcctccgggaaaatggctcactggaagcttcaatctcaccagccatctcaccctctttttggaaaaaggtgctgtccttattggaactcaggatccatctcattgggatgttgttgaacccttgccttcttatggccgagggcttgaagttcctgggggaagatatcagagtttgataaatggatacatgttacatgatgtggtcgtaacaggtaataatggaaccattgatggcatgggaatggtttggtgggattggtatagcacccattccttgaaccacagtcgtcctcatttggttgaatttgtggcatctgattatgtggtagtttcaaatcttacattcttgaatgctccagcttatagcatacacccagtttattgcagccatgtacatattcaaaatgtttcaatctctactcctcctgaatccccttatactgttggcatagtgccagattcttctgataatgtgtgtatagaagattgtattgttgccatgggatttgatgcaatttctctcaaaagtggctgggatgagtatggcattgcttatggaaggcctactgagaatgtacacatcagaagggtgcaacttcatgcattttctggctctgctcttgcatttggcagtgacatgtctggtggcatttcaaatgttctagtggagcatgctcatcttttcaactcaaatagtggcattgagttcagaaccaccaagggaagaggtggttatatgaaagaaattgttatgtcagacatacaaatggagaatgtccacacagcaattgctgccacaggtaattgtggctctcatcctgatgacaagtttgatccaaatgcactcccacatttggatcacattaccttgaaggatgtcataggtacaaacattaccattgctggaaacttagctggaatagatgaatctcctttcacaaacatttgcctctccaacataaccttgtccacaaattctgtttctcctattacttgggcatgctcaaatgtgtctggtttttctgactcagttcttccagaaccttgtcctgaacttggcaacacctcatatgattcttcctcatcatgtttctatctgctgagtgtcagtggcaaaactgcactgcagtgataacaatcctttctcaacagaagattcttattcttgagtaccttgctgcttgaagttgatgaaaaagtgaatggcgatttgccatccaaagatttaagccacattcttttccaataagagacggttgtgaggattattcattttttcatccctttatagatttccattcttgcatgttcctaccagcacattatttgtacagcttcttcatttcttcattcatgtgtaaggaaattttggtagtgccgccacaggaggactcaaaagaagtttgatagttttttgcattagttccattgtgatttcactgtaaagcatgtagtggatttggtgatacttcaattaaagaaagttcaactttttgttatcgtta

SEQ ID NO: 10753 - DNA, 2108 bp, Glycine max
atgattgatgtgggtcccaccattccccaattctgctctgtcaatccacatgcgccctctaatctctgtgccccatgcactccccaaactctctcattccctcacccacccctccctcctatcactctccacgtgtcacccaggggagcctcctcttcctctccacaccctcctgtttctcgcctcgtggcactcccgcaacaacacctgtgccggttcttgtctcccttggactctgaccctgttgccagctttgactcaagaagatgcttattggaattctctttcaagttcttagtcatccgatgtgtattatctgaagtaaattatctgggatatcttctgagaatcaatgggttgcattttgctttttctaccctctttcaggtggcattgctcttgctggtggcattgagcaatgccgtgagagttaatggaaatggtgggcagtgtggttccaacccaagactagaccctagacctcacagtgtctccattttggagtttggtgcagttggagatggtaaaacactcaacactattgcattccagaatgccatcttctatctcaagtcatttgctgataagggtggggctcagctctatgttcctccgggaaaatggctcactggaagcttcaatctcacaagccatctcaccctctttttggaaaaaggtgctgtcattattggaactcaggatccatcgcattgggatgttgttgaacccttgccttcttatggccgagggcttgaagttcccgggggaagatatcagagtttgataaatggatacatgttacatgatgtggtcgtaacaggtaataatggaaccattgatggcatgggaatggtatggtgggattggtatagcactcattccttgaaccacagtcgtcctcatttggttgaaattgtggcatctgattatgtggtagtttcaaatcttacattcttgaatgctccagcttatagcatacacccagtttattgcagccatgtacatattcaaaatgtttcaatctctactcctccagaatccccttatactgttggtatagtgccagattcttctgataatgtgtgtatagaagattgtattgttgccatgggatttgatgcaatttctcttaaaagtggctgggatgagtatggcattgcttatggcaggcctactgagaatgtacacatcagaagggtgcatctacatgcattttctggctctgctcttgcatttggcagtgacatgtctggtggcatttcaaatgttctagtggagcatgctcatcttttcaactcaaaaagtggcattgagttcagaaccaccaagggaagaggtggttatatgaaagaaattgttatgtcagacatacaaatggagaatgtccacacagcaattgctgccacaggtaattgtgggtctcatcctgatgacaagtttgatccaaatgcactcccacatttggatcacattaccttgaaggatgtcacaggtacaaacatttccattgctggaaacatagctggaatagaagaatcccctttcacaaacatatgcctctccaacataaccttgtccacaaattctgtttctccaattacttgggaatgctcaaatgtgtctggtttttcagactcagtgctcccagaaccttgtcccgaacttggcaacccctcatatgattcttcctcatcatgtttctacctgctgagtgtcagtggcaaaactgtagtgcagtgataataataatcctttctcaacagaagaagattcttattcttgagtaccctgctgcttgaagttgatgaaaaagtgaatggccatttcccatccaaagatttaagctacattcttttccaataagacagttgtgaggattattcattttttcatccttttagatttgcattcttgcatgttcctaccatcacattatttgtacagcttcttcatttcttcattcatgtgtaaggaaattttggtagtgccgccacaaatggactcaaaaagaagtttgatagtttttgcattagttccattgtgatttcactgtaaagcatgtagtggatttggtgatacttcaattaaagaaagttccaactttttgt

SEQ ID NO: 10754 - DNA, 1540 bp, Glycine max
atgaatgttttgatttcccttcctaaaatacttgttcaggtggcattgctcttgctgctggcgttgagcaatgaagttcgagttaatggtgatagcgatggtagacaatgtgaggttaatccagcactaaagccaagaccacacactgtctccatcttggagtttggtgcggttggggatggtaaaacattgaacactattgcattccagaatgccattttctatctcaagtcatttgctgacaagggtggtgctcagttatatgtgccacccggaacatggttgactcaaagtttcaatcttactagccatctcacacttttcttggaaaaaggtgctgtaattcttggatctcaggatccatttcactgggaagttgttgatccattaccttcttatggcagaggagttgaagttcccgggggaagatatcagagtttagttaatggatacatgttacatgatgtggtgataacaggtaataatggaatcattgatggcatgggattgggttggtgggaattgtttagttcccattccctgaactacagccgtccacatctgattgaattagtggcatctaatcgcgtggtagtttcaaatcttacattcttgaacgctcctgcatatagtattcacccagtttattgcagcaatgtacatattcacaatgtttcaatttctgctcctcaagaatctccttataccattggcatagtaccagattcttctgatcatgtttgtatagaggattgtgtcattgcaacgggatatgatgcaatttcactcaaaagtggctgggacgaatatggcattgcctatggcaggccaactgagaatgtacacatcagaagggtacatctgcaggcttattctggctctactattgcatttggcagtgacatgtctggtggcatttcaaatattcttgtggagaatgttcatctttacaactcaaagagtggcattgagttcagaaccatgaggggcagaggtggttatatgaaggaaatcatcatatcagacatagaaatggagaatatatacaccgctatggccgccacaggttattgtgggtctcatcctgatgataaatttgaccctaatgctctaccacttttggaccacattattttgcaagatatgattggcacaaacatcactattgctggaagctttgctggtcttcaagaatctcccttcactaacatatgcctttccaacgtaactttgtctataaattctgtttcttccattccttgggaatgctcaaatgtctccggattttcagattctgttcttcccaaaccatgtcctgaccttgagaccctttcagattgtctctccctgctcagtatcaagggaaaaaccgctgtcatgtgattagccatgaaaaggttcatattcttcaattccctgcttgaaagcccatgcaaagtgattagccatttctatctttaaagcccacattctttccaataagacagtgatttggagcattcatttttccatccttagatttgcattcttgcatgctgca

SEQ ID NO: 10755 - DNA, 1483 bp, Glycine max
atgctagtggcatttctcttgctgttggcgttgagcaatgaagtcagagttaatggtgatggcagtggtagacaatgtgagattaatccagcactaaagccaagaccacacactgtctccatcttggagtttggtgcggttggggatggtaaaacattgaacactatggcattccagaatgccattttctatctcaagtcgtttgctgacaagggtggtgctcagttatatgtgccaccgggaacatggttgactcaaagtttcaatcttactagccatctcacacttttcttggaaaaaggtgctgtaattcttggatctcaggatccatttcactgggaagttgttgatccattaccttcttatggccgaggagttgaagttcctgggggaagatatcagagtttgattaacggaaacatgttacatgatgtggtgataacaggtaataatggaaacattgatggcatgggatttgcttggtgggaattgtttagctctcattccctgaactacagccgtccacatctgattgaattagtggcatctgatcacgtggtagtttcaaatcttacattcttgaacgctcctgcatatagcattcacccagtttattgcagcaatgtacatattcacaatgtttcaatttctgctcctccagaatcccctaataccgttggcatagtaccagattcttctgaccatgtttgtatagaggattgtgtcattgcaacggggtatgatgcaatttccctcaaaagtgggtgggacgaatatggcattgcctatggcaggccaaccgagaatgtacacatcagaagggtacatcttcaggcttcttctggctctacaattgcatttggcagtgacatgtctggtggcatttcaaatattcttgtggagaatgttcatctttacaattcaaagagtggcattgaattcagaaccatgaggggcagaggtggttatatgaaggaaataatcatatcagacatagaaatggagaatatatacactgcaatagctgccacaggttattgtgggtctcatcctgatgacaaatttgatcctaatgctctcccacttttggaccacattattttgcaagatatgattggcacaaacatcactattgctggaagctttgctggactacaggaatctcccttcactaacatatgcctttccaacataactttgtctacaaattcagtttcttccattccttgggaatgctcaaatgtctccggattttcagattatgttcttcccaaaccatgtcctgaccttgaaactctttcgaattgtctctccctgctgattatcaagggaaaaactgcagtcatgtgataataatcctctatcaacaaaaggttcatattcttcgattccctgcttgaaaggccatgaaaagtgactggccattgctacctcagattaaaacccacattctttccaataagactgttattcggattattca

SEQ ID NO: 10756 - DNA, 1669 bp, Medicago truncatula
gtttttttccttttagttctttggtcactacttttatctcttctctccctcttgtcagagagactttgacccaagaacatgctagtggcattggtcttgctgctgctggcattgagcaatgaagtgagagtgaatggtgaaagaggtgataggcaatgtgggttcaatccatcacttaagccaagaccacatagtgtctccattttggagtttggtgcagttggtgatggtaaaacattgaacaccattgcatttcagaatgccatcttctatctcaagtcgtttgctgataaaggtggtgctcagctatatgtaccccctggaacatggcttactcaaagtttcaatctcactagccatcttaccctctttttggaaaaaggcgcagtcattatcggatctcaggatcattataactgggatgttcttgatcctttaccatcttatggccgaggacttgaagttcctggaggaagatatcagagcttgataaatggatacatgttacaggatgtggtcataacaggtaataatggaaccattgatggcatgggatcaacttggtgggaatcatttagctctcattccttgaactacagccgtcctcatctggttgaattagtggcatctactgatgtggtagtatcaaatctgacattcttgaatgcccctgcatataacattcacccagtttattgcagaaatgtacatattcataatatttcaatctttgctcctccagaatctccttatactgttggcatagtaccagattcttctgatcatgtttgcatagaggattgtacaattgccaccggctatgatgcaattgccctaaaaagcggttgggatgagtatggaattgcctacggtaggcctaccgagaatgtacacatcagaagggtgcatctacaagcatcttatggctctactcttgcatttggtagtgacatgtcaggtggaatttcaaatgtctttgtagaacatgttcatctctacaactcaaaaggtgggattgagttcagaactattagaggaagaggtggttatatgaaggacataattttatcagacatagaaatgaagaatatatatagagcaatatcagccacaggttactgtggttctcatcctgatgacaaatttgatcctaatgctttaccgcttttggatcactttatttttcaagatataattggaacaaatatcacaattgctggaagctttgctggactacaagaatctccattcaccaacatatgcttatccaatataaccctgtctgtaaattatgcttcctccactagctgggaatgttcaaatgtatctggattttcagattctgttctccctataccttgtcctgatcttgatagcccttcaaattattcctcatcttgtctctccaagttgagtatgaaagggaaaattgcggggtccggctcggtgtcgatgtaaaggtgaatagcttgtatctaaaaaatcagattaagtcattgaaaaaaaagtcaaattcattccaataagacattaatttggattattcattatttcagattttcattcttgcatgctgcaaatagcacattttttgtacaggtttatttcttcattcatgtgtaatgaaattttggttatgtccacagaaggactcaatttcatagtttct

SEQ ID NO: 10757 - DNA, 1553 bp, Vitis vinifera
agaaagctcccctgttttttcatgcttcttcttcgtctttctcttttctgctgcagttcttttttgggggtgctgctgctgctgccgctgttcttcttcttcttcttgtttgggcatcaggggatcattgctgcagaagctctgacgacccatgaagatgctattgccattgcttgtgattctggtattgagcaatgctgttgaaagtaatggacaagaaaggggtggacagtgcacaaatagtttgacattggatcccagaccacacagtgtatctatcttggagtttggcgcagtcggggatgggaaaacattgaacaccattgccttccagaatgccatattttatctcaaatcttttgctgataagggtggcgctcagctttatgtgccaccagggaagtggcttactggaagtttcaatctcacgagccacctcacactcttcttggaaagaggtgctgtcattcttgggtctcaggatccatcacattgggaagtcatagaaccccttccttcatatggtcgagggatcgaacttcctggaggaagatatagaagcttgataaacgggtatatgctgcgcgatgtggtgataacaggtgataatggaaccatcaatggccagggctcagtttggtgggattggttcacctctcattccttgaactacagtcgccctcatcttgtggagtttctggcatccactaatgttgtagtttctaatcttactttcctgaatgcccctgcatacaacatccatccggtctattgcagtaatgtaagagttcaaaacatatcggtttatgctccacctgaatctccttacactgttggtatagtcccagattcttcagatagcacctgcatagaggattgcagcattgccatgggccatgatgccattgcactcaagagtggctgggatgaatatggcattgcctatggtagacccaccacaaatgtacacatcagacgggtcaaccttcaatcatcatctggctcttccctggccttcggtagtgagatgtctggtggcatttctaacgtctgtgtggagcaggtccacctatacaactcattcagtggcatcgagttcagaactaccaagggaagaggtggttatatccaagaaatcatcatatcagatgtcgcaatggaaaacatccacacagccttcagtgcaacaggccaaatcggctcccacccagatgaccattttgaccccaatgcactccctgtcttggatcacatcaccttgcagaatgtgatcggcacaaacataaccattgctggaagcttcactggtattcaagaatccccgttcacttccatttgtctatccaacatctccctatcaactactcctcctgcctccatctcttgggtttgctcaaatgtctctgggttctcccaatgggtgttccctgaaccatgcccaagccttgagagctcattactgaactcatcttcaacctgtctctcccgcctgaattcttctcccactcagactgcagtcttatgatgccattcttccatttttcttcaagccc

SEQ ID NO: 10758 - DNA, 3373 bp, Glycine max
atgttcttcagcggcgatccttttacacggaagcgtgtcgatttgggaggtcgaagttcaaaggaaagggaccggaaaaacctgttagaacaaacacgagttgagcgcaaccggcgcttatggttgcgccagcagaactctgctgtactcaaaattcagaaatgcttcagagggagaaaagctgtcagaactgaacaatccaagttgcgagagcagttctataaaatctatgggaagtattgccagaatgtggacaggaattcttttggtccagattctaatttcctctgccagttcctctatttctttaaggcagaaaatattgaggacttcttagttcttgtgcaaatatgccggttgctttggtggtctgttcaggataatggggatgttgtcaaactttttgcgggggtggattattcatccacacgggctttggtgaactaccgagtgaagctatttgtacaagcttgtatttgtgctctgcatcagaatagaaatcagttaaaagatcagcttttattgactcctgaggaattgaatgtgtcagctattcctttattggaggttttagtattgttaattgatcccaaattgccatggagctgtaacctagtacaatatctcattcaaaacaatggagttggcctactcagagagatagttcttactggaaaggataatgcagaaaattgtttttccattggcaagggatcatcattggagcgtgtgcttattgctgtaatatctcatgttggtcagaagccatgtatctgttcacatattaatccaagatatagctctgcatcacagatcatcacaattcctttcttgtggcatctcttcccaaatttacaacagatttttgcagcaaacaacctgaatcaatgttacattcatcaaatggcaaagtttgggcaaaatctgatcaagttgctacctaaggatatatcaaatgaatttccgagccatgcgtgtatgcttggaaatgtattagaaactgctggaattgctttgtctcatcctaactgttcatttgatatggccgtagaccttgttgctgtcactacgtttttgctggaggcactcccatctctgaaaacttccaatagtagagaaagctctgtgattgctaaggatgatatgattgaagacgatgaagtcatggaaatagctttagatagtaaattggagcagcaaatttataatgccataaatcctcgcttccttctgcaactgacaaatatactatttaaagagatttcatctgtcaatggctcagattatggacccaatgatagagatgttacagctgttgatggggtttgtgggtttttgaatgttaccttcaacaagctgccacttgaacggattatgactgtgcttgcttacagaactgaacttgttccaacactttggaattttatgaagcagtgtcatgagaaccaaaaatggtcatcacacctctcaaatgatgcacctggttggctgttacctcttgctgtattctgtcctgtctacaagcacatgcttatgattgtcgataatgaagaattttatgagcaagagaaaccgctatcactgaaggacattagaagcctcatcattatattgagacaggttctgtggcagctactgtgggtgaatcatatcacatctgctaattcggtaaaatctgttccagttagttcagctagtaaggggcagtctgttcagaccattcaacagagggtttgcattgtagtctctgagcttctctcccagctgcaagattggaacaataggcggcagtttacatcccccagtaacttccatgctgatggggtgaatgacttatttagctctcaggctgtaatagaaaacacacgagcaaatgaaattttgaaacaggcccctttcttgataccatttacaagcagggttaaaatattctcttctcaactagctgctgttaggcaaaggcatggacctcaagctgtattttctagaaatcgattcaggatacaacgagatcatattttggaagatgcttacaatcaaatgagtcagttgacagaagatagtcttcgaggatcgattcgtgtgacttttgtcaatgaatttggagttgaagaggctggaattgatggtggtggaatattcaaagatttcatggagaacatcacacgtgctgcctttgatgtgcaatatggattatttaaggaaacagcggatcacctgctttatcctaatcctggatctggaatgatacatgaacaacatttccaatttttccacttccttggtactcttctcgcaaaggctatgtttgaagggattctggttgatataccatttgctacatttttcttgagcaaattgaaacaaaagcacaactatttgaatgacttgccttccttggacccagaattatatcgtcatctcatttttcttaagcattataagggtgacatttcggagttggaactatactttgttatagtaaataatgaatatggagaacaaacagaggaggaactgcttcccggaggaaggaacctacgtgtcactaatgagaatgtcattacttttatccaccttgtagccaatcaccgcttgaattttcagatacgccaacaaagttcacatttcttgaggggatttcagcaacttatgcagaaggattggattgacatgtttaatgaacatgaacttcagcttctgatatcaggttcacttgacagcttggatattgatgatctgcggctgcataccaactatgcaggaggctatcataatgagcattttgttatggagatgttttgggaagttctcaaaggcttttcattggaaaacaggaagaaatttttgaagtttgtgacaggttgctctcgtgggcctttgcttggtttccgatatcttgaacctatgttttgcatacaaagggcttccggtaatgccgttgaagaatcacttgaccgattaccaacatcggctacttgtatgaatctactaaagcttccgccttatacaagcaaggagcaattggaaaccaaattactgtatgccataaatgctgatgctggctttgatttaagttaaaaggaggcagtggaatttacgatatctgtagatttgaaggcggtagaaaatgactcacaaatgaccattgtcagtggaatgggaaacgacaaataatctgatggatagaattgaataaaaatatcctgtgtgcgagtgtatgtatatatattcttattcaatcttcattctcaatttgtctcttttctaaatgtacatatctaaattgtgaattattttgtaaagttcactctttggcagggtttttcctgattattttggatgattattataacaaaactcaacagggagg

SEQ ID NO: 10759 - DNA, 3331 bp, Glycine max
atgttcttcagcggcgatccttttacacggaagcgtgtcgatttgggaggtcgaagttcaaaggaaagggaccggaaaaacctgttagaacaaacacgagttgagcgcaaccggcgcttatggttgcgccagcagaactctgctgtactcaaaattcagaaatgcttcagagggagaaaagctgtcagaactgaacaatccaagttgcgagagcagttctataaaatctatgggaagtattgccagaatgtggacaggaattcttttggtccagattctaatttcctctgccagttcctctatttctttaaggcagaaaatattgaggacttcttagttcttgtgcaaatatgccggttgctttggtggtctgttcaggataatggggatgttgtcaaactttttgcgggggtggattattcatccacacgggctttggtgaactaccgagtgaagctatttgtacaagcttgtatttgtgctctgcatcagaatagaaatcagttaaaagatcagcttttattgactcctgaggaattgaatgtgtcagctattcctttattggaggttttagtattgttaattgatcccaaattgccatggagctgtaacctagtacaatatctcattcaaaacaatggagttggcctactcagagagatagttcttactggaaaggataatgcagaaaattgtttttccattggcaagggatcatcattggagcgtgtgcttattgctgtaatatctcatgttggtcagaagccatgtatctgttcacatattaatccaagatatagctctgcatcacagatcatcacaattcctttcttgtggcatctcttcccaaatttacaacagatttttgcagcaaacaacctgaatcaatgttacattcatcaaatggcaaagtttgggcaaaatctgatcaagttgctacctaaggatatatcaaatgaatttccgagccatgcgtgtatgcttggaaatgtattagaaactgctggaattgctttgtctcatcctaactgttcatttgatatggccgtagaccttgttgctgtcactacgtttttgctggaggcactcccatctctgaaaacttccaataacgatgaagtcatggaaatagctttagatagtaaattggagcagcaaatttataatgccataaatcctcgcttccttctgcaactgacaaatatactatttaaagagatttcatctgtcaatggctcagattatggacccaatgatagagatgttacagctgttgatggggtttgtgggtttttgaatgttaccttcaacaagctgccacttgaacggattatgactgtgcttgcttacagaactgaacttgttccaacactttggaattttatgaagcagtgtcatgagaaccaaaaatggtcatcacacctctcaaatgatgcacctggttggctgttacctcttgctgtattctgtcctgtctacaagcacatgcttatgattgtcgataatgaagaattttatgagcaagagaaaccgctatcactgaaggacattagaagcctcatcattatattgagacaggttctgtggcagctactgtgggtgaatcatatcacatctgctaattcggtaaaatctgttccagttagttcagctagtaaggggcagtctgttcagaccattcaacagagggtttgcattgtagtctctgagcttctctcccagctgcaagattggaacaataggcggcagtttacatcccccagtaacttccatgctgatggggtgaatgacttatttagctctcaggctgtaatagaaaacacacgagcaaatgaaattttgaaacaggcccctttcttgataccatttacaagcagggttaaaatattctcttctcaactagctgctgttaggcaaaggcatggacctcaagctgtattttctagaaatcgattcaggatacaacgagatcatattttggaagatgcttacaatcaaatgagtcagttgacagaagatagtcttcgaggatcgattcgtgtgacttttgtcaatgaatttggagttgaagaggctggaattgatggtggtggaatattcaaagatttcatggagaacatcacacgtgctgcctttgatgtgcaatatggattatttaaggaaacagcggatcacctgctttatcctaatcctggatctggaatgatacatgaacaacatttccaatttttccacttccttggtactcttctcgcaaaggctatgtttgaagggattctggttgatataccatttgctacatttttcttgagcaaattgaaacaaaagcacaactatttgaatgacttgccttccttggacccagaattatatcgtcatctcatttttcttaagcattataagggtgacatttcggagttggaactatactttgttatagtaaataatgaatatggagaacaaacagaggaggaactgcttcccggaggaaggaacctacgtgtcactaatgagaatgtcattacttttatccaccttgtagccaatcaccgcttgaattttcagatacgccaacaaagttcacatttcttgaggggatttcagcaacttatgcagaaggattggattgacatgtttaatgaacatgaacttcagcttctgatatcaggttcacttgacagcttggatattgatgatctgcggctgcataccaactatgcaggaggctatcataatgagcattttgttatggagatgttttgggaagttctcaaaggcttttcattggaaaacaggaagaaatttttgaagtttgtgacaggttgctctcgtgggcctttgcttggtttccgatatcttgaacctatgttttgcatacaaagggcttccggtaatgccgttgaagaatcacttgaccgattaccaacatcggctacttgtatgaatctactaaagcttccgccttatacaagcaaggagcaattggaaaccaaattactgtatgccataaatgctgatgctggctttgatttaagttaaaaggaggcagtggaatttacgatatctgtagatttgaaggcggtagaaaatgactcacaaatgaccattgtcagtggaatgggaaacgacaaataatctgatggatagaattgaataaaaatatcctgtgtgcgagtgtatgtatatatattcttattcaatcttcattctcaatttgtctcttttctaaatgtacatatctaaattgtgaattattttgtaaagttcactctttggcagggtttttcctgattattttggatgattattataacaaaactcaacagggagg

SEQ ID NO: 10760 - DNA, 3778 bp, Glycine max
gctttctttcttaaaaacttattcccaacacagcgctcccgggaaagtgagggaagcacgagaaagcttgcgaaaatttcacgttcttcttctatttgcaaacactgattttccattccattactgctattgttatcattcttattttgctgtgatcaaattggtttttcgtattaagaattctcattattattactgttgagactttcctatcgccttgcaccaaagaactcggttcccacttttctctaattctagggcaactttttcggccaaatccttttcttcccatcgaagcgagctctcattgcaaattaaacgcgctttgcgtggtgcgatcttcgttgtgatggaaactagggcatgaattggccgtacagaagaaaaaagcgataaaaaatgttcttcagcggcgatccttcgacgcggaagcgtgtcgatttgggaggtcgcagttcaaaggaaagggaccggaagaaccttctagaacagacgcgagttgaacgcaaccggcgcttatggttgcgccagcagaactctgctgtactcaaaattcagaaatgcttcagagggagaaaagctgtcagaactgaacaatctaaggtgcgagagcagttctataaaatctatgggaagcattgccagaacgtggacaggaattcttttggtccagattctaatttcctctaccagttcctctatttctttaaggcagaaaatattgatgatttcttagttcttgtgcaaatatgccggttgctttggtggtctgttcaggataatggggatgttgtgaaactttttgcaggggtggattattcatccacacgtgctttggtgaactttagagtgaagcgatttgtacaagcttgtgtttgtgctctgcatcagaatagaaatcagttaaaggatcagcttttattgactcctgaggaattgaatgtgtcagctattcctttattggaggttttagtattgttaattgatcccaaattgccatggagctgtaagatagttgaatatctcattcaaaacaatgcagttggcctactcagagagataattcttacaggaaaggataatgcagaaaattatttttccattggcaagggatcatcattggagcgtgtgcttattgctgtaatatgtcatgttggtcagaagccatgtatctgttcacaaattaatccaagatatagctttgcatcacagatcattactattcctttcttgtggcatcttttcccaaatttacaacagatttttgccgcagacgacctgaaccaatgctacattcatcaaatggcaatgtttgggcaaaatctgatcaatttgctacctaaggatatatcaactgaatttccgagccatgcgtgtatgcttggaaatgtattagaaactgctggaattgctttgtcccatcctaactgttcatttgacatggccatagaccttgcagctgtcactacatttttgctggaggcactcccatctgtgaaaacttccaatagtagagaaagtcctatgattgctgaggatgatatgactggagacaatgaagtcatggaaatagctttagataggaaattggagcagcaaatttataatgccataaatcctcgcttccttctgcaactgacaaatatactatttaaagagatttcatctgtcaatggttcagattatggacccaacgatagagatgttacagctgttgatggggtttgtgggtttttgaatgttaccttcaacaaactgccacttgaacggattatgacagtgctagcttacagaactgaacttgttccaacactttggaattttatgaagcggtgtcatgagaaccaaaaatggtcatcacacttctcaaatgatgcacctggttggctgttacctctggctgtattctgtcctgtctacaagcacatgcttatgattgtcgataatgaagaattttatgagcaggagaaaccgctatcactgaaggacattagaagcctcatcattatattgagacaggttctgtggcagctactgtgggggaatcatatcacatctgctaattcggtaaaatctgttccagttagttcagctagtaaggggcagtctgttcagaccattcaacagagggttagcattgtagtgtctgagcttctctcccagctgcaagattggaacaataggcagcagtttacatcccccagtaacttccaggctgatggggtgaatgacttatttagctctcaggctgtaatagaaaatacacgagcaaatgaaattttgaaacaggcccctttcttgataccatttacgagcagggttaaaatattctcttctcaactagctgctgttaggcaaaggcatggacctcaagctgtattttctagaaatcggttcagaataaaacgagatcgtattttggaagatgcttataatcaaatgagccagttgacagaagatagtcttcgaggatcgattcgtgtgacttttgtcaatgaatttggagttgaagaggctggaattgatggtggtggaatattcaaagatttcatggagaacatcacacgtgctgcctttgatgttcaatatggattatttaaggaaacagcggatcacctgctttatgctaatcctggatctggaatgatacatgaacaacatttccaatttttccacttccttggtactcttcttgcaaaggctatgtttgaagggattctggttgatataccatttgctacattcttcttgagcaaattgaaacaaaagcacaactatttgaatgacttgccttccttagacccagaattatatcgtcatctcatttttcttaagcattataagggtgacatttcggagttggaactatactttgttatagtaaataatgaatatggagaacaaacagaggaggaactgcttcctggaggaaggaacctgcgtgtcaccaatgaaaatgtcattacttttattcatcttgtagccaatcaccgcttgaattttcagatacgccaacaaagttcacatttcttgaggggatttcagcaacttattcagaaggattggattgacatgtttaatgaacatgaacttcagcttctgatatcaggttcacttgacagcttggatattgatgatctgcggctgcataccaactatgcaggaggctatcatggtgagcattatgttatggagatgttttgggaagttctcaaaggcttttcactggaaaacaggaagaaatttctgaagtttgtgacaggttgctctcgtgggccattgcttggtttccgatatcttgaacctatgttttgcatacaaagggcttccggtaatgccgctgaggaatcacttgaccgattaccaacatcggctacttgtatgaatctactaaagcttccgccttatacaagcaaggagcaattggaaaccaaattactgtatgccataaatgccgatgctggctttgatttaagttaaaaggaggcagcggagtttacgatatctttaggtttgaagccggtagaaaatgactcacagatgaccattaattggaaacgacaaataatatggtggatagaattgaataaatttatcctgtgtgagagtttatgtatatatattcttatttttattcaatcttcattgtcaattggtatctcttttctaaatgtacatatctaaattatgaattattttgtaaatttcactttggcagggattttcctgattatttctatgatcattataaaaaaacttcacagggaggttgtatttt

SEQ ID NO: 10761 - DNA, 3736 bp, Glycine max
gctttctttcttaaaaacttattcccaacacagcgctcccgggaaagtgagggaagcacgagaaagcttgcgaaaatttcacgttcttcttctatttgcaaacactgattttccattccattactgctattgttatcattcttattttgctgtgatcaaattggtttttcgtattaagaattctcattattattactgttgagactttcctatcgccttgcaccaaagaactcggttcccacttttctctaattctagggcaactttttcggccaaatccttttcttcccatcgaagcgagctctcattgcaaattaaacgcgctttgcgtggtgcgatcttcgttgtgatggaaactagggcatgaattggccgtacagaagaaaaaagcgataaaaaatgttcttcagcggcgatccttcgacgcggaagcgtgtcgatttgggaggtcgcagttcaaaggaaagggaccggaagaaccttctagaacagacgcgagttgaacgcaaccggcgcttatggttgcgccagcagaactctgctgtactcaaaattcagaaatgcttcagagggagaaaagctgtcagaactgaacaatctaaggtgcgagagcagttctataaaatctatgggaagcattgccagaacgtggacaggaattcttttggtccagattctaatttcctctaccagttcctctatttctttaaggcagaaaatattgatgatttcttagttcttgtgcaaatatgccggttgctttggtggtctgttcaggataatggggatgttgtgaaactttttgcaggggtggattattcatccacacgtgctttggtgaactttagagtgaagcgatttgtacaagcttgtgtttgtgctctgcatcagaatagaaatcagttaaaggatcagcttttattgactcctgaggaattgaatgtgtcagctattcctttattggaggttttagtattgttaattgatcccaaattgccatggagctgtaagatagttgaatatctcattcaaaacaatgcagttggcctactcagagagataattcttacaggaaaggataatgcagaaaattatttttccattggcaagggatcatcattggagcgtgtgcttattgctgtaatatgtcatgttggtcagaagccatgtatctgttcacaaattaatccaagatatagctttgcatcacagatcattactattcctttcttgtggcatcttttcccaaatttacaacagatttttgccgcagacgacctgaaccaatgctacattcatcaaatggcaatgtttgggcaaaatctgatcaatttgctacctaaggatatatcaactgaatttccgagccatgcgtgtatgcttggaaatgtattagaaactgctggaattgctttgtcccatcctaactgttcatttgacatggccatagaccttgcagctgtcactacatttttgctggaggcactcccatctgtgaaaacttccaataacaatgaagtcatggaaatagctttagataggaaattggagcagcaaatttataatgccataaatcctcgcttccttctgcaactgacaaatatactatttaaagagatttcatctgtcaatggttcagattatggacccaacgatagagatgttacagctgttgatggggtttgtgggtttttgaatgttaccttcaacaaactgccacttgaacggattatgacagtgctagcttacagaactgaacttgttccaacactttggaattttatgaagcggtgtcatgagaaccaaaaatggtcatcacacttctcaaatgatgcacctggttggctgttacctctggctgtattctgtcctgtctacaagcacatgcttatgattgtcgataatgaagaattttatgagcaggagaaaccgctatcactgaaggacattagaagcctcatcattatattgagacaggttctgtggcagctactgtgggggaatcatatcacatctgctaattcggtaaaatctgttccagttagttcagctagtaaggggcagtctgttcagaccattcaacagagggttagcattgtagtgtctgagcttctctcccagctgcaagattggaacaataggcagcagtttacatcccccagtaacttccaggctgatggggtgaatgacttatttagctctcaggctgtaatagaaaatacacgagcaaatgaaattttgaaacaggcccctttcttgataccatttacgagcagggttaaaatattctcttctcaactagctgctgttaggcaaaggcatggacctcaagctgtattttctagaaatcggttcagaataaaacgagatcgtattttggaagatgcttataatcaaatgagccagttgacagaagatagtcttcgaggatcgattcgtgtgacttttgtcaatgaatttggagttgaagaggctggaattgatggtggtggaatattcaaagatttcatggagaacatcacacgtgctgcctttgatgttcaatatggattatttaaggaaacagcggatcacctgctttatgctaatcctggatctggaatgatacatgaacaacatttccaatttttccacttccttggtactcttcttgcaaaggctatgtttgaagggattctggttgatataccatttgctacattcttcttgagcaaattgaaacaaaagcacaactatttgaatgacttgccttccttagacccagaattatatcgtcatctcatttttcttaagcattataagggtgacatttcggagttggaactatactttgttatagtaaataatgaatatggagaacaaacagaggaggaactgcttcctggaggaaggaacctgcgtgtcaccaatgaaaatgtcattacttttattcatcttgtagccaatcaccgcttgaattttcagatacgccaacaaagttcacatttcttgaggggatttcagcaacttattcagaaggattggattgacatgtttaatgaacatgaacttcagcttctgatatcaggttcacttgacagcttggatattgatgatctgcggctgcataccaactatgcaggaggctatcatggtgagcattatgttatggagatgttttgggaagttctcaaaggcttttcactggaaaacaggaagaaatttctgaagtttgtgacaggttgctctcgtgggccattgcttggtttccgatatcttgaacctatgttttgcatacaaagggcttccggtaatgccgctgaggaatcacttgaccgattaccaacatcggctacttgtatgaatctactaaagcttccgccttatacaagcaaggagcaattggaaaccaaattactgtatgccataaatgccgatgctggctttgatttaagttaaaaggaggcagcggagtttacgatatctttaggtttgaagccggtagaaaatgactcacagatgaccattaattggaaacgacaaataatatggtggatagaattgaataaatttatcctgtgtgagagtttatgtatatatattcttatttttattcaatcttcattgtcaattggtatctcttttctaaatgtacatatctaaattatgaattattttgtaaatttcactttggcagggattttcctgattatttctatgatcattataaaaaaacttcacagggaggttgtatttt

SEQ ID NO: 10762 - DNA, 3599 bp, Glycine max
cttttgctaccatactttcgcacttgcaccggttttctgctttttttcttcccatcagaaccttccccccaagttaacatacttcacccagaaagttaaggaagattcccgttttccttatttttcttttcattcgtggcattttctgcttacaaatacagaattgtttatatcacattatttccacttccccattattgaaatctgtaattcacatttctctttctacctactacctcctctgtcgtctcgatttctagggctatttcctcgtcaaaacccctctcattgcagattaaactccgcttcgcgtgctgcgatcgttctctctgtgtttttggtgcgcagaaatcgaataagcaaattgaacatgttcttcagcggcgattcctccactcgtaagcgcgttgatttaggtggccgcagctcgaaggaacgggacaggaataatctcctggagcagacgcggttggagcggaaccggcgcatgtggttgcgccagcagaactctgctgccctcaggattcagaaatgcttcagagggagaaaagttgtcagaacagaacaatctaaactacgagagaaattccttagtatctatggcaaaaactgccagaatttagacaggaatgcttatgctccaggttctgatttcctccgtcagttcctctatttctttaatgcagaaaatattgatgattttttaattcttgtgcaaatttgccgaatgcttcaacggtttgttcaagacagtggggatgttgtgagactttttgctggtgtggattactcatccacgtgtgctttggtgaactaccgagtgaagcaatttgtatatacttgtatttgtgctgtacatcagaataggaataagttgaaggatcagcttttattgactccaaaggattttaatgcatcagctattcctttattggaaatcttagtattgttgatagatcccaaactgccatggagctgtaagacagtagtatctctatctcaaaacaatgcatttggtctacttagagagattattcttacaggaaaggataatgctgaaaattgtatttacagtgaaaagggatcatcattggagtgtgtgcttactgttgtaatgtgtcacatcggtcagaagccatgtatctgttcacatactgatccactatatagcttctcatcacagattcttacaattcctttcttgtggcatgtttttccaaacttaaagcaggtatttgcaaaacagggcctgagccaacattacgttcatcagatggcaacatgggtgccaaatctgattagttctctacctaaggatatatcagatgaatttcctacctatgcctgtcttcttggaaatatattagaaactggtggatttgctttgtctcgacctgactgttcctttgatatggccatagaccttgctgctgttattacatttttgctggaatcacacccatctctaacaagatctgatggtagagagagttcttctattgctgaggatgaaatgactggcgaagatgaagtcatggaagtagctttggataggaaattgaatcaacaaatttgcaatgccatagatactcgcttccttttgcaactgacaaatatattatttggagatttttcatctgccaatagttcagatcatgagccagatgacaaggaggttgcagctgttggtgcagtttgtgggtttttatatgttatcttcaatactttgccactcgaaaagattatgactgtgcttgcctaccgaactgaacttgttcctatactttggaattttatgaaacggtgccatgagaatgaaaaatggtcatctttgtctgaacggttatcatacctctcaggtgatgcacctggttggctgttgcctcttgctgtattctgtcctgtctacaagcacatgctcatgatagttgataatgaagaatattatgagcaggagaaaccgctatcactgaaggatattagaagccttatcattctgttaaggcaggctctgtggcagctaatgtgggtgaatcataccacgtctgctaattcagtaaaatctgttccagttagcccagctattaaaaagcagtcggaagcgattcaacagagggttagcattgtagtgtcagagcttctgtcccagctgcaagattggaacaacagacgacaatttacatcccctactgacttccatgctgatggggtgaatgacttctttatctcacaggctgttatggaaaatacacaagcaaatgaaattttgaagcaggctgctttcttgataccatttactagcagggttaaaattttgacttctcaactagctgctgcaaggcaaagacatgggtctcaggctgtttatactagaaaccggttcagaatacggcggaatcatattttggaagatgcttataatcaaatgagtcagttgtcagaagatgaccttcgaggattgattcgtgtggcttttgtcaatgaattgggagttgaagaggctggaatagatggaggtggaatattcaaagatttcatggagaacatcacacgtgctgcctttgatgtgcagtatggattatttaaggaaacagcagattacctgctttatcccaatcctggatcaggaatgatacatgaacaacatctccaatttttccattttcttggtactcttcttgcaaaggctatgtttgaagggattctggttgatttaccttttgctacattctttttgagcaaattgaaacaaaagcacaactatttgaatgacttgccttccctggacccagaattatatcgtcatcttatctttctaaagcattatgagcgtgacatttcggagttggaactatattttgttatagtaaacaacgaatatggagagcaaacagaagaggagctgcttccagggggaaagaaccttcgtgtcaccaatgagaatgtcattacttttatccatcttgtagccaatcaccgcttgaattttcagatacgtcaacaaagttctcatttcctgagaggatttcagcaacttattcagaaggattggattgatatgtttaatgagcatgaacttcagcttctgatatcaggttcacttgacagcttggatgttgatgatttgcggcagcatacaaactatgcaggaggttatcatagtgaccatcatgttattgagatgttctgggaagttctcaaaggcttttcattagaaaacaagaagaaatttttgaagtttgtgacaggttgctcgcggggaccattgcttggattccaatatcttgaacctttgttttgcatccaaagggctggtagtaatgatccagacgaagctcttgatcgattacctacatcagctacttgcatgaacttactaaagcttccaccttataaaagtaaagagcagctggaaaccaaattactctatgccataaacgctgatgctggctttgatttgagttaaaaggaggtgcaatttaccgcatggttttgtttccatagcagtagaggattactcacttgtagacaagcgtcagagtcagcggcacaaagaacaaaaatatccaatgtaatgagaagtgggggtggggatgggg

SEQ ID NO: 10763 - DNA, 792 bp, Glycine max
atggaaagtgatgctggggaaaacttgtttggcacattctcctcctccacgacatccatcaccgcctcatcatcgtcatcaccaacatcttccaccacaacaagctcaaactcatgcaccaaacatgactccaaaataagtccacctcaaaatcaaaacaccccaaatagcaagaaaagacaaagaagtgatgacaatgagaacaaacaccaccctagttatagaggtgtgagaatgagagcatggggaaaatgggtgtctgagatccgtgagccaagaaagaagtcaaggatatggcttggaacataccctactgcagaaatggcagcaagagcacatgatgtggcagctttagccgtcaagggccattcagctttcctcaatttccccaatttagctcaagatcttccaaggcccaccaccacatctcccaaggacattcaagctgcagctgcaaaagcagcaaccaccactttctttgatgatgaaattgttaaccactgtcaagctgaaaaagctgaacaaaaccatggagaacaacaagcttctccttcaactctatgcatgatggacaatagtactgaagcagagcaaattcaagcagaacaagcttcttccactcaagagtcttctagttctcattctactgcagatgaagagacactgtttgacctaccagatcttttccctgatggaaactctggacttttctcctattcttcttgttggcatttatgtgcagttgatagtggattcaggctagaagagcagtttttgtgggagaatttctag

SEQ ID NO: 10764 - DNA, 3291 bp, Glycine max
atgtctggttttgatttctcaaaatacaaaacatgttcgaatcccacacaaaacaaacaaacgcgtcaacgaaggcggcttctctcgtctcgtctctgcttttctcctttcgctttcgcttttcgtgtcgccgccgggcgaaaaagtgtttccctgagaagagaattttgcaaatatggttccaccaaggggtttgatcaccatacgaatggttctttcggcgtggaagtgggtggttctcgcaaccatcacttcgcttgttcaggagagacgcggttccatgttgaaaaagaggaaggtgagatttgtgttgaacacgagcttgcccctgtggtgccaccgccagagaagagaagaaagttttctccaatcatatgggacctagcagagaaggaagaaagagtctcttcaaagagtgggatcttgcagattgctgctctgtctcctccttgtccatttctatctagcagtcctggagccaatggtgttgattgtggggatgttatggaggagcctttgacagattcgggaagctacccacacgatttggaggaagacaaagatgtgcaaggatggacaatcacaaagtcaagatgggcttgtgatgttcgtccctcaccaagaggtgctgatgatgaacagaagcacggcaaagtgagctccagtcctgaaattggtgaattccatggcggtggaacttcagagagcacaatcactagatcatcaggaagtagtggtagagatcattatttgggtgcttcttctgatgacactgattctgaaaaggacttccttatggactccatggtcaatgttgaggaacaaagtgatgatggtgattctccatcagattctgatgagtgtggtggattgatgcatgtgctgagaaacataaacatgcttcagagttgcagaagtgtgtgtgagtttgagatgattaagaaaataaacgaaggaacttatggtgttgtctacaaggctagggataagaagactggagaactagtagcattgaagaaggtgaagatgaacatagagagggatggatttccaatgtcatccttgagagaaataaacattctcttgtcttttaatcatccctccattgtgaatgttaaagaagtagttgttgatgattttgatggtacttttatggtaatggagcacatggagtatgacctgaaggggctgatggaggttaagaagcatccctttagcatgagtgaaattaaatccttggtacggcaacttcttgaaggtgtcaagtatctccatgataattgggttatccatagggacttgaaatcatcaaacatcctgctgaaccatgatggggagcttaaaatatgcgactttgggttgtcaaggcagtatggaagcccgctgaagccatatactcctgttgtggttacactatggtacagagcacctgaacttttgctgggtgctaaagaatactcaactgcaattgacatgtggtcagtgggttgcataatggctgaattaattgccaaggaacctctgttcaggggtaaaagtgaacttgaacaacttgataagatttttcgaaccctgggtacgcctgatgagaaaatttggccaggattatccaaattacctggggctaaagcaaattttgttaagcaactgtttaatacactaaggaagaagtttccagctgcgtcgtttattggtttgccagttttatctgagcttggatttgacttgttgcagcagctgctaacttatgaccctgaaaagaggataacagcagaagatgctctccttcatgattggttccatgaagcccctcttcccaaatctgatttcaagccaatttttccttcttggcagtgataggacaggtactcttgctggatgcatgaaataccaagaacaatgctatttttactgtcattatttccaactttgtcttccttgttgatgatcatatacaaagaatgatatatgattgcaaggaacagggtaatggacttcattaggctcttgtttgttataaattagattagaagcagcaaattgatgtatagatctgagaaggtatgacattacccgacttttttttcctttactaaaacaaatgtatcctctcttgtgctggtgaaaatcatgtacatacatttcaggactatttagtaatagatgatggatttttgctctggtatgttgttttccttcctgtaccatctatttccatttacaatggtttgttcctatccttttagctgccccattaaattgggggctatcaagacttgttcttttttctcctacatttaatctttacaacaggaaatgctcctgaaaattttggcttcattgatgcacaagcattggtagctgttggatgtgtagaaaaataaatcaattgcaaggaatattcattttgagcatggtcagcaggtaatgatgttaggtttctcaatttgaaagtggttccctgaaataaaatgatagtgttgttggcttttattaataatgtctcttttttcacacttccatattatgttgctcaacaaaataaaaggatctaaattcttttttactgtacaagttcaatttgaaacttttgatatacagtaactgtcagcaagataacgtgatgtaatcttcatggttatgctatcgagttttgttccttttttgcctacatttaatttttacaccaggaaatgctcttttaaaaattttgggtgcattgatgtgccaagcattgatagttgttggacttgtagaaaaataaatcaattgcaagcaatactcattttcaacatggtcaacaggtaaacaatcgtaggtttttcattttgaaagttggtccttgaaataaaatgatgtatgcccctttaccgaaatatgaatttttaaattaaccagaggtggaattatgagtttaggcagtggattgcatgttgaactatggtgaagcagggtttagaagcttgtggagctgctgagaaaagagacacaggctgttacatagatggcgaagtccaccaagggtgctgaagtgaaatttgcgctcaatttgtgccttcttaacactgcaattggtgtaataatttgatgaagttcaagggaagtagcctcttgtaatgaggagatttttgttttttgtattgaaaatcctgtggtgatgaataatttatatcccttaattacagtggggtcttgtggaggctggtgaagaaatattgaagctatggagtactattttgttcgtttgaacaagacgtatatgatttgatttgtgtataattctaataattc

SEQ ID NO: 10765 - DNA, 3736 bp, Glycine max; identical to SEQ ID NO: 10761

SEQ ID NO: 10766 - DNA, 3373 bp, Glycine max; identical to SEQ ID NO: 10758

SEQ ID NO: 10767 - DNA, 3675 bp, Arabidopsis thaliana
gctcctcagaaatttttgcttctgtttgattttgtttttgcccctttgcacacatatcatccaaattcgttatcatttttcacctttgaaagaatctatctccttgctctgttatctccagttctagggcatacgccgatcacatccctagctccttttggctctaataatacagtaatcttaggttttcggggagtgaatcgtgtattggtattctagttttagctcaagaacatgtttttctccggcgatccttcgactcggaagcgagttgatttaggtggccggagcaccaaggagagagatgctcggaagcttctcgagcagactagaatggagcgtaatcgtcggttactacagaagcagcagaactctgctgctctcaaaattcagaaattctttagaggtcgaagatcaatggccattgagcgctcgaaggtgcggcatgatttctgtgaaacctatgggaataattgccagaatgttgatagacattgctttgagccaggttcaagtttcctccggcagtttctgttttttttcaaggcacaaaactcgggagattttgtgatacttgtggagacttgtcgtctactgcagagtttcgttgacagcagtggtgacattgtcagccttttttctggcttggactattcttctgagcataatttggtggattttagagtaaagaaacttgcatttacctgtatcgaggcgatacaccagaataggaaccgtttaagggatcagctcttagttactcctgaagaagctagcatttcaacagctatcttgatggaggcagtttcgttgttgctagatcctaagctgccttgggtctgcaaaatagttagttatctacaaaaaagaaaagtattcaaactggtccgagaaatggtcactacggctaaggaaagcccaagaggtaagactatgaccggcaacatcctttcactagaaagagtattgatactgatagtaccacatattggccgtgagccatgttgctgcactgttgttgatccacgttggagtttctcatctatgattcttacaatacctttgatatggaagctcttcccaaacttgaaagtggtatttgccaacccgagtctaagtcaacactacattcaccagatggcttcctgtattcaaaaggatacctgtgttctcccaatggaaacaagcccagaattccctggttatgcttgcctacttggtaacacgttggacactgcaaacgtggtgttgtcacagcctgaatgttcattggacatggcaattgacattgcattagttgcaactttctttttggagacacttcctcctgtgaaatcatcagaaggagaaagtagacaaggattagtcttgaataaggctctggagcagcagataaccaatgctatagactcacgctttcttctgcagttaacaaatgttttgttccgtcaagtttcgcttggtatgcagtcatatgacgaagataaagaagcattagctattggcacagccagttcttttctgtatgcagcattcaacactctccctcttgagcggatcatgacaattttggcttatagaacagagcttgtagctgtgttgtggaattatatgaaacgatgccatgagaaccagaagtggtcatccatgcctaaactcctagcttaccttccaggggatgctcccggttggctgttacctctggttgttttttgtcctgtttataagcatatgcttatgatagtcgacaatgaggagttttatgaaagagagaagccattatcgctacaagatatcaggttgctcatcattatccttaagcaggctttatggcagttactgtgggtgaatccacttacgcaacctaacactgggaaatctgtctccaatgacctctcgaagaagaaccctattgaactgattcagaacaggatggggattgtagtctctgagttactttcacagttgcaagattggaacaaccggaaacaattcacttcctcaagtgacttccaagcagattcagtcaatgaatatttcatctctcaggccataatggaaggaacgagagccaactacatactgatgcaagctccgttcttgattccgtttacaagcagagtcaaaatattcacaacacaattagcaacggcaaggcagagtcatggatcgcaaggaatttttgctcgaaatcggttcagaatacgaagagatcatatcttggaagatgcttacaatcaaatgagtgcgttatcagaggatgatctacggagctcgattcgtgtgacatttgtgaatgaactcggagttgaggaagctggtattgatggtggtggcattttcaaagacttcatggagaaaattacccgagcagcctttgatgtgcaatacgggttgtttaaggagaccgctgatcacatgctttatcctaatcctggatcaggaatgatacatgaacagcatctccagttctttcattttctcggcagtctcctcgcaaaagctatgtttgaagggattcttgttgatataccatttgcaacgtttttcctcagcaaactgaaacaaaagtacaactatttgaacgatttgccttctctggatcctgagttgtataggcaccttatatttctgaagcgttataagggtgatatctcagacttggagctttactttgttattttgaataatgaatatggagagaggacagaggaagagctacttccagggggccaagacatgcgagttacaaatgagaatgttataactttcattcatctggtttccaatcatcggttaaattttcagatacgccagcagagttctcatttcttgagggggtttcagcaactcattccgaaagaatggatcgacatgttcaatgaacatgagcttcaggttctcatatctggttcagttgatagtttggatatagacgacttgcgaaacaacactaattatgctggaggctaccacgcgggacattatgtgatcgatatgttctgggaagttatgaaaagcttctcaactgaaaaccagaagaagttcttaaagtttgtgacaggctgctcacgaggaccactgctgggtttcaaatacttggaacctgcattctgcatacagagggctgccggtagtgcgagtaatgaatcagttgatagactaccgacatcagccacttgtatgaatcttcttaagcttccgccctatcaaagcaaagagctacttgagaccaaattgatgtacgccataagcgcagaagcgggttttgatctgagctgatggaatagcttcctgccttaaacacagacttcaatggccccaaattgacacccttttttctagcattcctcgttatggtataaaccgggtaacctgtagactgaggcaggcttgttggctctaagcatctaagagacggatctagaaggagaacatgtagtagagattacttgactaatgggtttcatttgcagctctcgggtattcgctttcaaaaagtgtgacaaaaaaaaaaaagtgattacagggaagtctttatttggaagctcctgagagttagtcttgggttaaaaattcaataaaagaaatggtaaataagactggtctcaagaggaacttaaatgctgtaaattattttgcttaattaatgcatgttacacagaacatagatga

SEQ ID NO: 10768 - DNA, 1772 bp, Glycine max
atggagccttcctcgatctctccaccgccagctccgcctgccaccgccgtccccttccccgccgaacccaacgaccaccttccaccacccattcccgaaccaccttctaaccacccaccctacgccgagatgatatacacggcaatcgaggcgctgaaggagaaagacggttctagcaagagggcaatagcgaagtatattgagcaagtgtatacgcagcttccaccgaatcactcagacttgttgactcagcacttgaatcacttgaagagtaggggattgctccaaatggtaaaaaaatcttacgcccttcctagatctgtgcccgtgtctgttcctggacctgcacccacacaagggacatcagcagtgccggctgctgttgttgccatcacgacgactccgaggcccagaggtcggcctcgcaaggcccaaaatccagttcagaactcgccgctgcctcaggacactgtcaggggggagggttcagcagaatgccgagccggtcggggctgcgcttggaggggccgtcctcccggctctggaaaaaagccgggccgtcctcccaaggcaaccacaacagatgtttctgcttctgctgggcccaagagacgtccaggccgcccgcccaagaatcagtcgcagcccactctcattccctttgctccggctgtatctgccgcttccgtggatacagagcacgtggcagcatcagctgaaactgcgccggttgatgctgacgcggctctcggaccaagagcccgtggacggccgaagaaatatgctgacgagatgattgctgcgggccgaggcaggggacggggccgtgggcgcggtggcggcggaagaggacgagggagagggcgtggtgaattgcctgcacagcccagaaaaccaggggcaaggcccgtgggtcgtccgaaaaagggttcaacttctgctagtacttctcaaaatgctgcaaatgaagatctcaggaggaagcttgaacactttcaatcaaaagtcaaggaatctcttgcagtgcttaagcctcattttaaccatgaaagtccagtcactgcaattgctgctattcaagagctagaagtactgggaactatggacctcaatgtaccactaagggatgaaacacttccacatcaagtggagctgccaccaccacagccaccagtgcagcagcagcagcagccaccacagcagcagctgcagcagccaccccagcagccaccacagcaacacctagcaccacaacaactgccgccacagccaccgatatttcagcaaacatatcctccatttcatctgccgcagttccaccatcaccagccttcgctgcagttccagcaacagcagcagcagccgccacagccaccgccacagctattccagcaccaggcacagcctccttcccaccaacagtttcatccttaggaatcaggcccaggctaggaagaattacatggtcctcaatttgataatatgatgctaggaagaattacatggtcttcgatttggttatgaacaatctgaaacaagtgttttaacaaggcacatgaggggtaacatatttgtaaagcgagtaggcagtagcagaactgatttttcgtcaagtgaatcgattgtccatttagtttgttgttgtgcactattctagattgatccctgaagtaatttttagattttagagtactgataattctgttattgaagtaatatttgtttgactttggcagctttagattattagtcatattgttcatgttggtcta

SEQ ID NO: 10769 - DNA, 1905 bp, Glycine max
agcagcaaggagagaagaatcttaatatcttatccacatccacaacgaagatcttagtctcaccttagagacacaacacagcacagcacaacacaatattcaaaagcagtaaccagagaaaatggctagtgtcttttctgcatgttcaggttctgctgttctttttcacagcagaaactccttctcctcaaaagggtctttccttcacctcaaaaggcctctctcagccaactgcgtagcttctttggggactgaggtatcagtgtcaccagcagttgacactttctggcagtggctcaaggaagagggtgttgtctctggcaagaccccagtgaagcctggtgtagtgccagaaggcctaggactggttgcactcaaggacatttctaggaatgaggttgtcttgcaggtccccaagaggctgtggattaaccctgatgctgtggcagcttcagaaattgggaaagtgtgcagtggattgaagccttggttagctgttgcactgtttctgataagagagaggtcaaggagtgattctctttggaagcactacttcagcattctgcctaaggaaactgactctactatatattggtcagaggaggagctctcagagctgcaagggactcaacttctgaacacaactaggagtgtgaaacaatatgtgcagaatgaatttaggagactggaagaagaaattataatccctaacaagaagcttttcccttcttctattacacttgatgacttcttctgggcatttggaattctaagatcaagggcattttctcgccttcgcaatgaaaacttagttgtgattccattagctgacttgataaaccatagtgccagagtaactacagatgatcatgcttatgaaattaaaggagcagcaggccttttctcctgggactacctattttctctgaggagccccctttctctcaaggctggggaccaggtatatatccaatatgatttgaataaaagcaatgccgagttggctctggactacggtttcatagaaccaaatacagatcggaatgcatataccttgacactgcagatatctgagtcagaccccttttttggtgacaaactagacattgctgagtccaatggttttggagagacagcatactttgacatcttctacaaccgcccccttccaccaggattgcttccatatctgagactggtagctctagggggcactgatgctttcctattggagtcaatatttagaaactccatctggggtcatcttgaattgcctgtgagccgcgacaatgaagagctcatatgcagagtagttagagagacctgcaaaaccgcccttgctggttatcatacaaccattgaagaggatcaaaagttgaaagaagcaaagctagattcaaggcatgctatagcagttggaattagagaaggggagaagaacctcctacagcaaattgacgagatcttcaaggaaaaagaattggaattggcccagttagaatattatcaagaaaggaggctcaaggaccttggactttgtggggaaaatggtgatatccttggggaccttggaaaattcttctaggaagcagaagcagttgcaaccataaaggacacgcttttgtgtacatttccaaaaggacgagaaaacataaacatcttggtaaatcacaaaaggaggcttccaagacaaatccatgccatttattcaattgatttttgaagatcataatcaagtttttgactcacccccgtttattacaacttattgcttgattattgtttgtaaagagaaagatgtaatgaactttggagtgcctggtctgaatttaaggctgagacatgaactattgtcatataactatactgacctcataaataaatcaattaagggtgaaattgacg

SEQ ID NO: 10770 - DNA, 1811 bp, Glycine max
gtaaccagagaaaatggctagtgtcttttctgcatgttcaggttctgctgttcttttctacagcagaaactcctttccctcaaaaggatctttcattcacctcaaaaggcctctctctgccaactgtgtagcttctttggggactgaggtatcagtgtctccagcagtagacactttctggcagtggcttaaagaagagggtgttgtctctgccaagaccccagtgaagcctagtgtggtgccagaaggcctaggattggttgcactcaaagacatttctaggaatgaggttgtcttgcaggttcctaagaggctgtggattaaccctgatgctgtggctgcttcagagattgggaaggtgtgcattggattgaagccttggttggctgttgcattgtttctgataagagagaggtcaaggagtaattctctttggaagcattacttcagcgttctgcctaaggaaactgactctactatatattggtcagaggaggagctctcagagctacaagggactcaacttctgaacacaactaggagtgtgaaacaatatgtggagaatgaatataggagattggaggaagaaattatactccctaacaagaagcttttcccttctcctcttacacttgatgacttcttctgggcatttggaattctaagatcaagggcattttcccgccttcgcaacgaaaatctagttgtgattccatttgctgacttcataaatcatagtgccagagtaacaacagaagatcatgcttatgaaattaaaggagcagcaggtcttttctcctgggactacctattttcccttaggagccctctttctctcaaggctggggatcaggtatatatccaatatgatttgaataaaagcaatgccgagttggctctggactacggtttcatcgaaccaaatgcagatcggaacgcatacaccttgacactgcagatatctgagtcagaccctttttttggtgacaaacttgatattgctgagtccaatggttttggtgagacagcatactttgacatcttctacagccgccctcttccaccagggttgcttccatatctgagactggtagctctagggggcactgatgcattcctgttggagtcaatatttagaaactccatctggggtcatcttgaattgcctgtgagccgcgacaatgaggagctaatatgcagagtggttagagagacctgcaaaactgcccttgctggttatcatacaaccattgaagaggatcaaaagttgaaagaagcaaagctagattcaaggcatgcaatagcagttggaattcgagaaggggagaagcagctcctgcagcaaattgatgagaccttcaaggagaaagaattggaattggaccagttagaatattatcaagaaaggaggctcaaggaccttggactttgtggggaaaatggtgatatccttggagaccttggaaaattcttctaggaagcaaaagcagaagcagtacacaggacacgctttttgtctacatttcaaaggacgagaaaacataaactcttggtaaataacaagaggaggcttccaagacaaatccatgccatgtattcaattgatctttgaagaggatcataatcaagtttctgactcaccccattttattacaacctattagtctgtaaagaggaagaagtagtgaacttttgaatgcctgatatgaatttatggctgtgacatgaactattgttatataattatacataacccaaacttggaaaattaaataaataaattaaggatgaaattgaagatacatctttgc

SEQ ID NO: 10771 - DNA, 1496 bp, Medicago truncatula
caaggatgcgtggaggaggagaagaaggagacagagatccgacgaagcagcaacagcactctggtttggttagattggtacaacaacttgttacattgttgcttgtttttgctgctggtgtcgtcattggtttaaccacaacttctcacattcactacttcaatactcacaacaataataataactatcttcatttcatttcccaacaaccttctgcttcttcttctgatgtcttcaatctcgatactatccacaccctccaacaacaacaacccaacaataacaacaacaactgtaactgtaattgtacaatcattgaacctccttctcctcctcctcctcctcctcctccaccaccaccaccaccctccgaagaggaggatttgttggagtcctttcttcatccttccaacatcacccacaccttctccgaccatcaacttttctggagggcttcccttgttcctaagaaataccactatccctatgctcgtgtacctaaactcgctttcatgtacctcactaggggacctttacccttgttgccactctgggagagattctttcaaggccactcccatctcttcaacatttatatccacgctcctcctggttatattctcaacgtttcagattcttctcccttttatcgacgcaacatcccaagtcaggtatgcatttcctttgctttttatttgggttgggtagaagaattactttaaatgaatgaatcataaaccacaacattcttatcatgtccatgtctttactcatattttcactcccactaaatcataaactaatttatgttatttgtagagagtattctattcttatgagttttgtcttattgacaggctgtttcttggggaacagttacgctggccgatgcagagaggcggctactagccaatgcactgctcgacttttcaaatgagcgctttgttctactctcagagagttgcatcccagtctacaacttccctactgtttacagatatctcattgattctgcacacagctttgttgaatcatatgacgatccttcccgttatggccgaggccgctacagtcgcaatatgcttcctgatattcagcttaaacactggcgcaaaggctctcaatggttcgaactcaaccgtgcacttgctgtttatatagtctctgacacccaatacttttctctcttccgtaaatactgtaagcctgcttgctacccagatgaacactaccttccaaccttcctgaatatgttccatggttcccttaattcaaacagaacagtcacatgggtcgactggtcaatgctcggtcctcatccagcaacctacgggagggacaatataactgtcggttttatacaggctataaggaacaatggatccctttgtccatataattcagatatgacttccatttgttacctctttgctcgcaagtttgatcccagtgcattggagcccttgcttgacctctcttccgaagtcatgaacttt

SEQ ID NO: 10772 - DNA, 1496 bp, Medicago truncatula; identical to SEQ ID NO: 10771

SEQ ID NO: 10773 - DNA, 1496 bp, Medicago truncatula; identical to SEQ ID NO: 10771

SEQ ID NO: 10774 - DNA, 1496 bp, Medicago truncatula; identical to SEQ ID NO: 10771

SEQ ID NO: 10775 - DNA, 874 bp, Glycine max
gggggcaccaccttgatgagatgctcccacgcaaacgctctcttcagagctctcaaacccaaaccccgcaattcttcactgccactttcttcaatggccatcaacaaaggtaatagtaataaggcatatgatgcattgctgttggatgctgggggcaccctattgcaattggcaaagccagttgaggagatttatgccactattggatccaaatatggtgtgactgtggatccagctatgataaagcagggatttaagagagcatttgctgctccgtggcctgaaaagctgcgctaccagggagatgggaggccattttggaaacttgtagtttctgaagccactggttgtggagatgaagattattttgaggaagtttatgagtactatgcaaaaggtgatgcgtggcatcttccagatggagcttttgaaacaattacttttctcaaggatgctggagttaagatggctgttgtatctaattttgacaaccgcttaaggaagctattgaaagatcttaatgttttaaatctgtttgatgctgtcattatatcatcagaggttggatatgaaaaaccagatccaagaatattccaagctgctcttgatgaagtaaatgtagaggcttgcaaagccttacacattggagatgatcagaaggcagataaactgggggccaatgctgtggggattgattgttgcagttatggggtatagatgtgaagacattctctgatatacaaattcgaattcttaattcagaggcatagcacttgatgtggtttgtagctctaatttgatcatgctgatactagctagcattttaattagtggatgactaacactgcccttcttaattttctatgcatgatgt

SEQ ID NO: 10776 - DNA, 1009 bp, Vitis vinifera
tttggtgtccgagaaaatcaaagcatggaggcttgtgtagctagatgttcggatggcgtgttcttcagatgccttaatcgtttcaattttaggcgttctttcaagccaatggcgtccatccatgcagcctcagatggaggaaggtggtttaacagagcatacgatggattgttgttggatgctgggggtacactcctgcagttggcaaagcctgtcgaaagcacttatgccgatattggcaggaaatacggtttgactgcaagctcagcagaaataaagcaaggatttaggagagcttttgctgctccatggcctgaaaagcttcgctaccagggtgatgggcgaccattttggaaacttgtcgtttctgaagccactggttgtgcaaataatgattattttgaagaagtatatgagtactatgcaaatggtgatgcatggcatcttccaactggagcttctgaaacaatgttccttctcaaagatgctggagttaagctagccgttgtatccaactttgacacccgcttaagaaagctattgaaggacctcaatgttttagatctgtttgatgctgttatcatatcttcagaggttggatatgagaaaccagatgcaaaaatatttaaagctgctttggatcaaattggagtagaggcagggaaagcagttcatgttggagatgatcaagaggctgataaggtgggggctagtgctgttgggattgattgctggttatggggaactgatgtaaagacattctcagacatacaaaagcaaatcctcatttcagagcattagcttctaaagaattaggattggtggtttaagtgattgcttgaaataagtatttaagggactgaaagggtgcaacatgcaatttattggcacggtaaactactttccaaagtggaggactttcacgggtacatgtaatggagtttttcaattttagtttgaattctggatctgacagcatgagttcaatcacccttgtgcaataagaatt

SEQ ID NO: 10777 - DNA, 2763 bp, Glycine max
atggcagaaactgcagtgtccttggctggtcagcatgcgcttccaaaaatattggaagctgtcaaaatgctgagagatctcccaaacgaagttagagacattacagatgaacttgaaagctttcaagatttcatcaatgatgctgataaagtggctgaagctgaagaagatgatggaaggcgtcatagaataaaagaaagggtgatgcgactgagagaagcagcttttcgcatggaagatgtcatcgatgaatataacatctcctgtgaggataagcaacctgatgatcctcgatgtgcagctttacaatgtgaggctgttgacttcatcaaaactcaaatccttcgccttcaaagtgcgtataagattcaggatgttaaattgcttgttcgtgctgaaagagatggtttccaacgccattttcctttagagaaaagatcaactagttctagaggaaatcaagatgtcacctggcagacacttagaagggctcctctctttattgaggaggatgaggttgtggggctcgataacgatagagctacattgaaatattggttgacaaatggaagagaacaacgcacagtcatctccgtggtgggaattgcaggggtgggaaaaacaactcttgccaagcaagtttatgaccaggtgcgtaacaatttcgagtgccatgcgttgatcacagtttctcaatccttctctgctgtaggattgctgacacatatgttgaatgagctttgcaaagaaaaaaatgaggaccctcccaaggatgtttctaccatcgagtcgttgacaaaagaagtcagaaaccgcttgcgcaacaagaggtatgttgtcttgtttgatgacgtatggaatgaaacattttgggatcacattgaatctgctgtaattgataataaaaatggaagtaggatattaatcacaaccagggatgagaaggttgcagaatattgtaggaaatcatcatttgttgaggtgcataacctagaaaaacctttaactgaagaagaatctttgaaattgttctgtaagaaggcatttcagtatagttccgatggagattgtccagaagaacttaaggatatatctcttgaaattgtcagaaagtgtaaagatttacctctagcaatagtggccattggtggtcttttgtctcaaaaagatgaaagtgcacctgaatggggacagtttagtcgagatctaagtttagacttggagaggaattctgagttaaatagtataacaaaaattttaggtttaagttatgatgatttgccgatcaatctcagatcatgtttattgtatttcggaatgtatccggaggactatgaagttaaatctgatagattgattagacagtggataactgaagggtttgtcaaacatgaaaccggaaaatctttggaagaagttgggcaaccatatttatcagggttggtccatagaagtttggtgcaagtatcctcacttagaattgatggcaaagttaaaaggtgtcgtgttcatgacttaatacacgacatgatccttagaaaagtcaaggatacagggttttgtcagtatattgacgggcgtgatcaatctgtatcaagtaatattgttcgacgcctgacaattgcaacccatgattttagtggaagtacaagaagctcacccattcggtcaattcttatcatgacaggaaaagatgaaaacttatctcaagacttggttaacaaattccctacaaattacatgctactgaaggtacttgattttgaaggttctgcttttagttatgttcctgaaaatttggggaatttatgccacttgaagtatttaagcttccggtatacatggatagcaagtctaccaaaatccattggtaagctcctgaatttggagaccttggatataagaggcacaggtgtgtctgagatgccagaggagattagtaagcttaaaaagctacgtcatcttctggcttattctaggtgttcaattcaatggaaggatattggaggcatgacatccctacaagagatacctccagtgattatagatgatgatggagtggtcattagagaggtaggaaagctaaagcagttaagggaactgtcggtgaatgattttgagggaaagcacaaagagactctgtgttccttgataaatgagatgccactcttggagaaactacttattgatgcagctgattggagtgaagtaattgacttgtacattacgtcacctatgtctacacttaggaagcttgtcctatttgggaagttaacaaggtttccaaattggatttcacagttcccaaatcttgtgcaactgcgtttgcgcggctccaggttgactaatgatgcattgcaatcactaaataatatgccaaggttgttgttcctcgttttaagagacaatgcttatgaaggtgaaactttgcattttcaacgtggatggtttcagagactaaagcaactgttcctccaaagtttggataagttgaagtccatccttatcgacagaggagcactgtgttctgtggaagaaattgttttacgagacctctcccaactcaaaacagttccctctggaattcaacacttggagaagcttaaagatctctatatcgacgacatgccaactgaatttgagcagcgcattgctcctgatggaggagaagaccactggatcatccaagatgtgccccatgtacgtatctggagtgaggatgctgaagaacctttgcatatattcggcagaagtcatcactaa

SEQ ID NO: 10778 - DNA, 672 bp, Lotus japonicus
atggggagggggaagattgagatcaagaggattgagaacacaactaatcgccaggtgacattctgcaagagaagaaacgggcttctgaagaaagcttatgagctatcagtgctgtgtgatgctgaagttgccctcattgtcttctccagccgtggccgcctctatgaatattcaaacaacaacatcaggtcaactatagagaggtacaaaaaggcttgttcagatcattcaagtacgagcactaccacagaaattaatgctcagtactatcaacaagaatctgccaagctgcgacaacaaattcagatgctgcaaaattcaaacaggcacttaatgggtgatgccttaagcaccctgacggtgaaggagcttaagcaacttgagaacaggcttgaaaggggaatcactagaattagatccaagaaacatgagatgctactagctgaaattgaatacttccagaaaagggagattgaactggaaaatgaaaatctttgccttcggactaagataactgatgttgagaggattcagcaagtaaacatggtttctggacaagagctgaatgccattcaggcattagcttctcgtaactttttcaatccacccatgattgaagatggaacttcctaccctcagcagcctgataagaagatccttcatcttgggtaa

SEQ ID NO: 10779 - DNA, 888 bp, Glycine max
atgggaagggggaagatcgaaatcaaaaggattgagaacacaacaaatcggcaagtgaccttctgcaagagaagaaatgggcttctgaagaaagcttatgagctgtcagtgctgtgtgatgcagaagttgccctcatcgtcttctccagccgtggccgtctctatgagtattccaacaacaacataagatcaacaatagagaggtacaaaaaggcatgttctgatcactcaagcgcgagcactaccacagaaatcaatgctcagtattatcaacaagaatctgcaaagctgcgacagcaaatacagatgctgcaaaattctaacaggcacctgatgggtgatgccttaagcacactgactgtgaaggaacttaagcagttggagaatagacttgaaagaggaatcactagaatcagatctaagaaacatgagatgctactggctgaaattgaatacttccagaaaagggagattgaactggaaaatgaaaatctttgcctccgaactaagataactgacgtggagaggattcagcaagtaaacatggtttctgggccagaactgaatgccattcaggcattagcttcccgtaacttcttcaatccaaatatgttggaaggtggaactgtttaccctcactcagataagaagattcttcatcttgggtgatcaataatatatgatcttggctagcctatggcatgtctatccaattagccggtggctaaatgcattattattactactcttttggttgctcattaactagaccatgtgatctatatactacttatggattatggatacttatgtatgatgattgtatgatatcataacaatcagttagaaataataattaaaaaatagagtgtgtttgaaaaaaaaaaa

SEQ ID NO: 10780 - DNA, 693 bp, Gossypium hirsutum
tcaagtgatcaaagagaatgggaagaggaaaaatagagataaagaggatcgaaaacacaacaaatcgtcaggttaccttttgcaaacgcaggaatggcctgctgaagaaagcttacgaactgtcagtcctgtgtgatgctgaagttgctctcattgtcttctccagtcgaggccgtctgtatgagtactccaacaacaacataagatcaacaatagacaggtacaagaaggcttgctcagatacttctaacacaaacactgttactgaaatcaatgctcagtattatcaacaagaatcagccaagttgagacagcagattcaaatgttacagaattctaacaggcacctaatgggagattccttgagttccttaactgtgaaagagttaaagcaggtagaaaacaggcttgaaagaggaattactaggatcaggtccaagaagcacgaaatgctgctagctgaaatagagtttttgcagaaaagggaaatcgaattggaaaatgaaagtgtttgtctccgaaccaagattgcagaaatagagaggcttcagcaggcaaacatggtgactggacctgagcttaatgctattcaagctttagcctctcgcaatttctttagccccaatgtcattgagcatccatctgcttactcccatccctctgacaagaagattctccatcttgggtagaaga

SEQ ID NO: 10781 - DNA, 1038 bp, Prunus dulcis
actttggcttctttgggattagaaattttccgaaagctgaagtgaacggagtggaagcaaaagtaaaggtaggtcttcaaatttaagatggggagaggaaagattgagatcaagaggatcgagaacaccacaaaccgtcaagtgaccttctgcaaacgaagaaatggactgctgaagaaagcttatgagctatccattctctgtgatgctgaagttgccctcattgtcttctccagtcgaggccgcctctacgagtactccaacaacaacataagaaacactatagaggggtacaagaaggcttgctcagatagctcaggttcaacctccattaccgaaattaatgctcaatattatcaacaggaatcggcaaagctgaggcaacagattcaaatgctgcagaattccaacaggcacttaatgggagatgccttgagtactttgagtgtgaaagagctaaagcagctggagaataggcttgaacgaggcattaatagaatcaggtccaagaagcatgaaatgctgcttgcagaaattgagtacttgcagaaaaaggagatcgagctggaaaacgaaaatgtgtgtcttcgaactaagatttcagaagttgagaggcttcaacaagcaaacatggttgggccagagctgaatgcaatccaggcattagcttctcgcaatttctttagccaaaatatgatggagggtggagcaacctacccacagcaagacaagaagattctccatcttgggtaagctttgtggagagagattcagcaaatgctagctcaatattattcaaaataatgatgtcactgcctactgtttttagtagcgttgtgtgtccaatagttctggaacattgccatttttagaaactgctgagcacttaattagcatatgcttgctgcatatgaacatggaaatgtatttggaaagattgttatatgacttggttcaatctccagaataattactttagtaaggctggtaattcagtaagtttaccgcaaaaaaaaaaaaaaaaaaaaaaaaaaaaaa

SEQ ID NO: 10782 - DNA, 1090 bp, Gossypium hirsutum
tagacccatttgaaaggtgagatttatgatgaaattggagtgcaaatgcaagctatatagttttgaatagggactgattttctttgcaatagctggcctcacatcttcaaccaaaaatccaaacactttggccttctttggaatctgtaattttccgaaagctgaagtggccggaactgtggcctaacctcagtaggaatatataaaagggtgaagatgggaagaggaaagatagagataaagaggatcgagaacaccacgaatcgtcaggttacgttttgcaagcgcaggaatgggctgctgaagaaagcatacgagctgtcagtcctttgtgatgcagaagttgctcttatcgtcttctccacccgtggccgcctctacgagtactccaacaacaacataagatcaacaatagagaggtacaagaaggcatgttccggtacctcaaacacaaataccgtcacggaaatcaatgctcagtattatcaacaagaatcagccaagttgaggcagcagattcaaatgctacagaattctagcaggcatctaatgggagattcgttgagttccttgacagtgaaggagttaaagcagctagagaatagacttgaacgagggattactagaatcagatcaaagaagcacgaaatgctgctagctgaaattgaatattttcagaaaagggaagttgagctggaaaatgaaagtgtatgtctccgagctaagattgcagagatagagagggttgaggaagcaaacatggtaacaggagcagagctgaatgctattcaagccttggcatctcgcaatttctttactccaaatgtgattgagagaggaactcccactccctactcccaccatgacaagaagattctccatcttgggtagagagagttggagagaacaaatctgaaaagggtgttgtgatattatgagattaaataaggatgcatttcaaccatatgtactctacatatattatgaagctgtcatgtaatttgttacttgttttgttctgttatattgtctgaaaacctatactagtgtaacgtgtttaattttgtgtgttaaaaaaaaaaaaaaaaaa

SEQ ID NO: 10783 - DNA, 856 bp, Prunus serrulata var. lannesiana
tggaagcaaaagtaaaggtaggtcttcaaattaagatggggagaggaaagattgagatcaagaggatcgagaacaccacaaaccgtcaagtgaccttctgcaaacgaagaaatggactgctgaagaaggcttatgagctatccattctctgtgatgctgaagttgccctcattgtcttctccagtcgaggccgcctctacgagtactctaacaacaacagcataagaaacactatagagaggtacaagaaggcttgctcagatagctcaggttcaacctccattactgaaattaatgctcaatattatcaacaggaatcggcaaagctgaggcaacagattcaaatgctgcagaattccaacaggcacttaatgggagatgccttgagtactttgagtgtgaaagagctaaagcagctggagaataggcttgaacgaggcattaatagaatcaggtccaagaagcatgaaatgctgcttgcagaaattgagtacttgcagaaaaaggagatcgagctggaaaacgaaaatgtgtgtcttcgaacaaagatttcagaagttgagaggcttcaacaagcaaacatggttgggccagagctgaatgcaatccaggcattagcttctcgcaatttctttagccaaaatatgatggagggtggagcaacctacccacagcaagacaagaagattctccatcttgggtaagctttggagagagattcagcaaatgctagctcaatcttattcaaaataatgatgtcactgcctactgtttttagtaatattgcagtgtgtccaacagttctggaacattgccatttttagaaactgctgaagcacttacttaattagcatat

SEQ ID NO: 10784 - DNA, 1001 bp, Momordica charantia
acgcgggggatctggtggtggggttttcagggaattaaagagggtggaagatggggagagggaagatcgagattaagcggatcgagaacacgacaaatcggcaggtgacgttctgcaagaggaggaatggactgctgaagaaagcttatgaactgtctgttctttgtgatgctgaagttgccctcatcgtcttctccagccgtggtcgcctctatgaatactccaataacagcatcaaaactaccattgggaggtacaagaaggcttgttctgatagctcagctactagctctgtcactgaactcaatactcaatattatcagcaagaatctgcaaagctgcgccaacaaatacaaatgctacagaattccaacagcaatcttgttaggcacttgatgggggactccttgagtgctcttacagtgaaggaattgaagcagcttgagaataggcttgaaagaggcatcactaggatcagatcaaagaagcatgaaatgttgctagcagaaattgagtacctgcagaaaagagagatcgagctggagaatgaaaatgtgtgtattagaaccaagatagcagaagtggagaggcttcagcaagccaacatggtttctgggcaagaactgaatgcaattcaggcattggcttctcgaaatttcttcactcctaatatgatggaaggtggagctgtcactttctcacaccaagacaagaagatgcttcatcttgggtgatgatgatgttggcagctacttttggaggtcataatgatgggacaaatgtttgttttaattaaaatttagaaaatcattgagatcacagaagagattaaaataaaatatgcccatcattttctaaagattaattaattttacttagtgaccaatgttcatgatgaacagtgtgatttgatttgcagctgtgtttcaaattatagataatatatacatatataatgacactaatgctgatgatgtgtaaaaaaaaaaaaaaaaaaaaaa

SEQ ID NO: 10785 - DNA, 1142 bp, Cucumis sativus
acacaaagttgcttagtaaagaagcttcatttttctctctttctttttattggaaattctttcccattcatcaacttctccttctcacctcaaaccccaatttctccaaggaagaagctgaagaagaagaagaattcagaagaaggatttttattggaagatcatataaataatggggagaggaaagatagagataaagagaatagagaacacaacaaatagacaagttacattctgtaagagaagaaatggacttttgaaaaaagcttatgaactctctgttctttgtgatgctgaagttgctctcattgtcttctccagccgtggccgtctctatgaatactccaataacagcatcaaaacaactattgagaggtacaagaaggcttgttctgatagctcagctactagctctgtcactgaactaaatactcaatattatcagcaagaatcggctaaactgcgtcaacagatacaaatgcttcagaattccaacaggcacttgatgggggactccttgagtgctcttactgtcaaagaactcaagcagcttgaaaataggcttgaaagaggcatcactagaatcagatcaaagaagcacgaaatgttgctagcagaaattgagtaccttcagaaaagggagattgagctggagaacgaaaatgtgtgtattagaaccaagatagcagaagtagagagggttcaacaagcaaacatggtatctggacaagaactgaatgcaatacaagcattggctaactctcgcaatttcttctctcccaatatcatggaacctgctggacctgtttcttactctcatcaagacaagaaaatgcttcatcttgggtgatgctgttttggagaccaaaatgatggggacaattgtttgttttaattaatattcagaaaatcattgagattacaaaaaagaattaaaataaaatatgcccatcattctctgaagtacaaaatttaattaattttactcaatgatcagtgatgatcagagcgtgagatgtgatttaatttgcagtttgtgtgtttcaaattctatataaatgttattatatatactacatacatatgatatgatatatataatatgctacaatgactctaatgctaaaaaaaaaaaaaattaa

SEQ ID NO: 10786 - DNA, 945 bp, Prunus persica
atttaagatggggggaggaaagattgagatcaagaggatcgagaacaccacaaaccgtcaagtgaccttctgcaaacgaagaaatggactgctgaagaaagcttatgagctatccattctctgtgatgctgaagttgccctcattgtcttctccagtcgaggccgcctctacgagtactccaacaacaacagcataagaaacactatagagaggtacaagaaggcttgctcagatagctcaggttcaacctccattactgaaattaatgctcaatattatcaacaggaatcggcaaagctgaggcaacagattcaaatgctgcagaattccaacaggcacttaatgggagatgccttgagtactttgagtgtgaaagagctaaagcagctggagaataggcttgaacgaggcattaatagaatcaggtccaagaagcatgaaatgctgcttgcagaaattgagtacttgcagaaaaaggagatcgagctggaaaacgaaaatgtgtgtcttcgaactaagatttcagaagttgagaggcttcaacaagcaaacatggttgggccagagctgaatgcaatccaggcattagcttctcgcaatttctttagccaaaatatgatggagggtggagcaacctacccacagcaagacaagaagattctccatcttgggtaagctttatggagagagattcagcaaatgctagctcaatattattcaaaataatgatgtcactgcctactgtttttagaagcgttgtgtgtccaatagttttggaacattgccatttttagaaactgctgaagcacttaattagcatatgcttgctgcatatgaacatggaaatgtatttggaaagattgttatatgacttggttcaatctccagaataattcctttggtaaaaaaaaaaaaaataaaaaaaagaaaaaaaaaaaaaaaaa

SEQ ID NO: 10787 - DNA, 681 bp, Phaseolus vulgaris
atgttgcagtgcttagagggatttaagcctttatttgcttccatattgagatgttgtgatctggacatatataaccagccaagaggccttgaagatcctgaacttcttgctagagagacagtgttcagtgtaagtgaaatagaagcactttatgagctcttcaaaaagatcagcagtgctgttattgatgatgggttgattaacaaggaagagtttcagttggcattgttcaagacaaataaaaaagaaagtctttttgctgatcgggtatttgatttgtttgacacaaagcacaatgggatactgggttttgaagagtttgctcgtgctctctccgttttccatccaaatgcccctattgatgataagattgaattttcctttcaactgtatgatctcaagcagcagggttttattgaaaggcaagaggtgaagcaaatggtagtagctacacttgctgaatctggcatgaacctatcagatgatgttatagaaagtataattgacaagacctttgaggaagcagatacaaagcatgatggcaagattgacaaggaagagtggagaaaccttgttctgcgccatccatcacttctgaagaacatgacccttcaatatcttaaggacatcaccacaacattcccaagctttgtattccattcacaagtagacgatacttga

SEQ ID NO: 10788 - DNA, 1278 bp, Glycine max
gggtcgcattcatccatttaacttccacaaattcctacaaattctaaccaaacccttcactactccaaatcccacaacttctctcttttttttccctccttcttttccctttttctgttgtccgatcttctgcctcctagatcttggtatttgggattgatcacctggagttggaaatggttaaaaggttcagttgccttgtgcccgcttatgatgactttatgagggatgaactaaatggaatgtctaactgatttgttcttggaacagttatggagtgttctgatttgcgaaagatatcatgttgcagtgcttagaaggacttaagcctttatttgcgtccatattgcgatgttgtgacctggatatatataaccagccaagaggccttgaagatcctgaacttcttgctagagagacagtgttcagtgtaagtgaaatagaagcactctacgagctcttcaaaaagattagcagtgctgtaattgacgatgggttgattaacaaggaagagtttcagttggctttgttcaagacaaataaaaaagaaagtctgtttgctgatcgggtatttgatttatttgacacaaaacacaatgggatactgggttttgaagagtttgctcgtgctctctccgttttccatcctaatgcccccattgatgataagatcgaattttcctttcaactatatgatctcaagcagcagggttttattgaaaggcaagaggtgaagcaaatggtagttgctacacttgctgaatctggcatgaacctatcagatgatgttatagaaagtataattgacaagaccttcgaggaagcagatacaaagcatgatggcaagattgacaaggaagagtggagaaaccttgttttgcgccatccgtcacttttgaagaacatgacccttcaatatctcaaggacatcaccacaacattcccgagctttgtattccattcacaagtagacgatacttgaagataatttctcctatggcttcttcctttgggctgcatggccacgtgtgtagtaaaaagggcatggcagatagccttgcttttaccttacatttgttatatctttgaataatgtagtttggtttgtggattcttttgctggggtttaactttctcattttttcttcaaacttccagacacatatggttcccatttttcaaaactaggatttcaaaagcaagattggaaggttgtgcagagtttgttttatatcatgagttctgaggccatgactataaaaaaaaaaaaaaaaaaaa

SEQ ID NO: 10789 - DNA, 1144 bp, Glycine max
tttttttttttttttttgcacaaccttggaatcttgcttttgaaatttgaaaaatgggaaccaaatgtgtctagaagtttgaagaaaaaatgaaagtaaaatcccagcaaaagaatccacaaaacaaaatacattattcaaagatataacaaatgtaaggtaaaagcaaggctgtctgccatgcccttttttgtacaaaagtggccatgcagcccaaaggaagaagccatgggagaaattatcttcaagtatcgtctacttgtgaatgaaatacaaagctcgggaatgttgtggtgatgtccttgaggtattgaagggtcatgttcttcaaaagtgacggatggcgcaaaacaaggtttctccactcttccttgtcaattttgccatcatgctttgtatctgcttcctcgaaggtcttgccaattatactttctataacgtcatctgatgggttcatgccagattcagcaagagtagcaactaccatttgcttcacctcttgtctttcaataaaaccctgctgcttgagatcatatagttgaaaggaaaattcgatcttatcatcagtaggggcatttggatgaaaaacggagagagcacgagcaaactcttcaaaacctagtatcccattgtgctttgtgtcaaataaatcaaatacccgatcagcaaacagactttcttttttatttgtcttgaacaatgccaactgaaactcttccttgttaatcaacccatcgtcgattacagcactgctaatctttttgaagagctcgtaaagtgcttctatttcgcttacactgaacacagtctctctagcaagaagttcaggatcttcaagacctcttggctggttatatatatccaggtcacaacatcgtaatatggaagcaaataaaggcttaagtccctctaagcaccgcaacatgatatcttttgcaaatcagaacactccataacttttaaccatttccaactccaggtgatcaatcccaaataccaaaatcttggaggcagaagatcgggcaacagaagagggaaaagaaggagtgtgaagaagttttggaatttggagtagtgaagggtttggttagaatttggaggaatttgtggaagtgagatggatgattgcaacgaatgtatctcc

SEQ ID NO: 10790 - DNA, 972 bp, Pisum sativum
actgcctctcaaccctcaaaatcatacccattcaaaactcttccacaaaaaagattttgccatttgggattggtcgcctgaagttggaaatggttaaaagttatggagcattctgattcacaagcgatatcatgttgcagtgcttagagggattcaagtctttgctcgcttctgtattacgttgttgtgacattgatattaaccagccaagaggccttgaagatcctgaacttcttgcaagggagacagtgttcagtgttagtgaaatagaagctctgtatgagctcttcaaaaagatcagcagtgctgtaattgacgatggactgattaacaaggaagagtttcaattggcactattcaagacgaataaaaaagaaagtttgtttgctgatcgggtgtttgatttatttgacacaaagcacaatgggatcctgggttttgaagagtttgctcgcgccttatccgttttccatccaaatgcccctattgatgataagattgaattttcctttcaattatacgatctcaagcagcagggttttattgaaagacaagaggtgaagcaaatggtggttgccacacttgcagaatctggtatgaatctatcagatgatgttatagaaagtataatcgacaagacttttgaggaagcagatacaaagcatgatggcaagattgacaaggaggaatggagaaaccttgttttgcgccatccgtcacttttgaagaacatgacccttcaatatctcaaggacatcaccacaacattcccaagctttgtattccattcacaagtagatgatacttaagggaaagtattttgttgatagttttcacctttggtttctctgtctctgtgctacgagtcacctctctttcctttttaaaatatagttggttgatttgcttaccttaaattggttatatatttgattaaggtatttggtttgataaaaaaaaaaaaaaaaaaaa

SEQ ID NO: 10791 - DNA, 1058 bp, Vitis vinifera
gcggagtgaatagacagtgagacatggtgggcgggcatcttcactcttcctcttcaggctttctctgcaggtatggagcattttgatgtgccgaaaatatcatgttgcagtgcttagagggatttaagcatttaattgcttccctactgcggtgttgtgatcttgatttgtataatcaagcaagaggtcttcaagatcctgaagttcttgcaagggaaacagtgtttagtgtaagtgaaatcgaggcactatacgagctgtttaagaagatcagcagcgctgtgattgatgacggtctgatcaacaaggaagagtttcaattggctttgttcaaaacaaacaaaaaggaaagcttatttgctgatcgggtatttgacttgtttgacacaaagcataacggaatacttggctttgaggagtttgctcgtgctctatctgtttttcaccccaacgcacctatcgacgacaagattgagttttcttttcagttatacgatctcaagcagcagggtttcattgagaggcaggaggtgaagcaaatggtagtggccacacttgctgaatctggtatgaatctttcggatgatgttatagaaagtatcattgacaagacctttgaggaagctgacacaaaacatgatggaaagattgacaaagaagagtggagaagccttgttctacgacacccatcccttttgaagaatatgactcttcaatacctcaaggacatcaccaccacattcccaagctttgtctttcattctcaagttgacgacacctgaagtcccatacatgaaagttgactggtttttgttaataattgcatctctatttctaaatgatataggccccttgtgtgtcgtaaagggcctaacaggaagtcttcactttgtaatgtttgttactatgggtggtgggtgtgatcatttatgccaaagaactagactctttccctttttagtagataaggtttcatagtgtgtgaacttgcaactcacattgtttgaatttttttgtgttcaacttatctactggatgggtaaacatacttgctctct

SEQ ID NO: 10792 - DNA, 681 bp, Gossypium hirsutum
atgttgcagtgcgtagctggtgtgaagcgtttatttgcttctgtactgcaatgttgtgatattgatttgtacaaacaatctagaggtctcaatgatcctgaacttcttgcacgagagactgtgtttagtgtaagtgaaatagaagctctttatgagctcttcaagaagataagtagtgcggtgatagatgatgggctgattaacaaggaggagtttcaattggcattattcaaaacaaacaaaaaggagagcttgtttgcagatcgggtatttgacttgtttgatacaaagcataatggaattctaggttttgaagagtttgctcgtgctctctctgtcttccatccgaatgcacccattgacgataagattaagttctcttttcaactatacgatctcaagcaacaaggtttcattgagaggcaggaagtgaagcaaatggtagtggctacgcttgctgaatcaggcatgaacctttcggatgatgttatagaaagtataatcgacaagacctttgaggaagctgatacgaaacacgatggaaggattgacaaggaagagtggagaagccttgttttacgacatccgtcccttctgaaaaacatgaccctgcaatacctcaaggacatcacaacaacattcccgagcttcgtttttcattcacaagttgatgatacctga

SEQ ID NO: 10793 - DNA, 2008 bp, Gossypium hirsutum
atgttgcagtgcgtagctggtgtgaagcgtttatttgcttctgtactgcaatgttgtgatattgatttgtacaaacaatctagaggtctcaatgatcctgaacttcttgcacgagagactgtgtgtatgttattgttttcttttcttttcattttgtttttttcttaaattgttaagcttttgaacaaattaatgtcttatttgagctttcccttaattcgcaccttgatgcagttagtgtaagtgaaatagaagctctttatgagctcttcaagaagataagtagtgcggtgatagatgatgggctgattaacaaggtattttttctaggttaaatctttctattagtccctattgtggatctagtccgtatattttaatttaactcgttgttctttttgaattttaaacttttagtcctaatccaaacagtaattgttaaatctgtttgattaaattcaaagctttgtactatgcatacaggtgtagatttagttcatattatgcaactaaatcatttaaagtctctatactttttaaattttgaaatttcaatcttgacataaatgacagtcgctaatatgttaactaggtttttagtgagtaatatgtggatacagctaaacttaacttaataaatttaacattttttattttggtgtggattgaaattttaaattttaaaaagtttagggactaaaatgaccaaattaaagtacaatgactaaatccacaactttcataaagtacagggactaattgcagaatttaaccatttttctattatcttttacttcacaaggtatttgttctattattatttttacttcacgttttattaaaccgatgctgttttgttatatttgactagttttgggacttgatgatcactcgaaatgctttttcatatctgagttttatttcatgttatcatttggcaggaggagtttcaattggcattattcaaaacaaacaaaaaggagagcttgtttgcagatcgggtattttttaatctaatgttaactgatattgtttttgtttccgtcctcgataaaataatgctcctaaatctcatcataccaatctttgcagttattagcatcttgtctgagccgttttgaacatgtttcgtacttcgctgcaggtatttgacttgtttgatacaaagcataatggaattctaggttttgaagagtttgctcgtgctctctctgtcttccatccgaatgcacccattgacgataagattaagtgtatgtgtctaatatttgtctacatcgagatctttatttgcatctttggccatcgttcataaacttggggatctgatgtaaatgactgccatggaaatggaactatgaactcaagtaccagttcattttccaataatcaatccaccgagtactttgttgtctcgtaattcttttgtgcccttttgcagtctcttttcaactatacgatctcaagcaacaaggtttcattgagaggcaggaagtaagtattatgttacccagttttgatcttttgtattctatatttctttgatccttctttccgtcattcatgcatatatttttacatataggtgaagcaaatggtagtggctacgcttgctgaatcaggcatgaacctttcggatgatgttatagaaagtataatcgacaaggtgattgatctcttaaatctgatttatttgatgtcatatcttgtaactttcattttcctttgtttttaacattttccaacagacctttgaggaagctgatacgaaacacgatggaaggattgacaaggaagagtggagaagccttgttatacgacatccgtcccttctgaaaaacatgaccctgcaatacctcaagtaagttgcaaacttccccgataaacaccttggtttcatcccagtctgctctcaccgtcaatgatttttgttctatatactcgaaacagggacatcacaacaacattcccgagctttgtttttcattcacaagttgatgatacctga

SEQ ID NO: 10794 - DNA, 1243 bp, Medicago truncatula
gatagtactccatctgtcatcacatcatcattcatcatcatcttcgttcttcacacactctcgattcgattcgattcgatttcattcgcctgcaaccaccgtcacaacaacccttcttcaccactatttccctaagcttttctaaaaatctcttttttctcactgatcctttaacttcaagatcttagcatttgggagttggccaactgaaattggaaatggttaaaagttatggaggattttgattttgaggtacaagagatatcatgttgcagtgcatagagggaattaagcatttgtttgctcctctattgcaatgttgtgacattgacttatataagcagacaacaggacttgaagatcctgaaattcttgcgagggagacagtgtttagtgtaagtgaaattgaagctctttatgagctctttaaaaagatcagcagtgcggtgattgatgatgggctgatcaacaaggaagagtttcaattggcattattcaagacaaataaaaaagagagtttatttgccgatcgggtatttgatttgtttgatacaaagcacaatgggatacttggtttcgaagagtttgcccgcgccctctctgttttccatccaaatgcccctattgatgaaaagattgagttttcctttcaactgtatgatctcaagcagcagggttttattgaaagacaagaggtgaaacaaatggtagttgctacgcttgctgaatctggcatgaatctatcagacgatgttatagagagtataattgacaagacttttgaggaagcggatacaaagcatgacggcaagattgacaaggaggaatggagaaaccttgttttgcgccatccatcactactcaagaacatgacccttcagtatttaagggatatcaccacaacattcccaagctttgtattccattcacaagtagacgatacttgaaggtcaaatattatttacttgatcatgttgcatatggtttcatttgtgtaagaaaggatattgcagagagatttacttgccatgcgttggttatatttcttcgaagatatttgtttttgtagttaagccttgtcgaaatacatttgatttattgcttcgttatttttttttttgccaaaatttaatttatggcttgaaaacatacaaagatccttattgttcctattcggtgttgttctggactatatttccattccttttgatccaaggattctgtaaaaaaaaaaaaaaaaaaa

SEQ ID NO: 10795 - DNA, 681 bp, Gossypium hirsutum
atgttgcagtgcttagacggattgaagcatttatttgcttctgtattgcactgttgtgatattgatttgtgcaagcaatccagaggtctcgaggatcctgaacttcttgcaagagagacagtttttagtgtaagtgaaatagaagcactctatgaactcttcaagaagataagcagtgcagtgatagatgatgggctgattaacaaggaggagtttcaattggcgttattcaagacaaacaaaaaggagagcctgtttgcagatcgggtgtttgacttgtttgatacaaagcataatggaattctaggtttcgaagagttcgctcgtgctctttctgtcttccatccaaacgctcctattgacaataagattgacttctctttccaactatatgatctcaagcagcaaggtttcattgagaggcaggaggttaagcaaatggtagtggctacgcttgctgaatctggcatgaacctttcagatgatgttatagaaagtataattgacaagacttttgaggaagctgatacaaaacatgatgggaggattgacaaggaagagtggcgaagccttgttttgcgacatccctcccttctgaaaaatatgaccctgcaataccttaaagatatcacgacgacattcccaagctttgttttccactcgcaagtcgatgatacctga

SEQ ID NO: 10796 - DNA, 523 bp, Vitis vinifera
atggccatccgctgcatcaatgacatttgttcatctgcccgagcatcctggagcctcatctccattgcagttgcccaccgcttgggcccagttccagtgggggaaaccagtatcttcattgcaatctcttctgttcaccgggctgatgcattggacgcttgtaagtttgtgattgatgaaattaaggcatcagttccaatatggaagaaggaggtgtatgcaaatggagaggtttggaaggagaactctgagtttttggagaggaggtcagagcttggtaatgctgggctgcaggagggaaggacatgctgttcaagaaaagtaaaggtggagacacaggagaggaagagttgctgtggggctaaggtgaaggtggaaggagaactcaagtttttggagaggaggtcagagcttggtaatgctgggctgcaggagggagggacatgctgttcaagaaaagtaaaggtggaggcacaggagaggaagggttgctgtggggctaaggtgaaggtggatgttgaat

SEQ ID NO: 10797 - DNA, 955 bp, Vitis vinifera
tctttttttcttactgcgtacatcttcatatttccgcacggatactgtaatccacggcgagggctgaaacgaaggttcctcacagctcaaatccaggcaatagacttcttacagctctctctctctctctctcgtttgtggagttctctggagtctgatcgtccatgggattgtgggaggctttcctcaattggcttcgcagcctctttttcaagcaggaaatggagctttctttgataggacttcagaatgctgggaaaacatcacttgttaatgttgttgcaactggtggatatagtgaagacatgattcctacggtaggattcaacatgaggaaagtaactaaagggaacgtcacgataaaattgtgggatcttggaggtcagcctaggtttcgcactatgtgggagagatactgccgtgcagtttctgctattgtttatgtggttgatgctgctgatccagataacattggcatctcaaaaagtgaactccatgatctgctgagcaaaccctcactgaatggtattcctttgctggtactgggaaacaaaatcgacaagccaggagctctgtccaaacacgctttgactgaagaaatgggactcaaatcaattactgacagagaagtatgctgcttcatgatctcttgcaagaattctaccaacattgattctgttattgattggcttgtaaagcattccaaatctaagagctgagaagggtttttctctcttcctgtattctggtttctctttgttgaaatttctgaatgatttgtttctgggttgttggtggtgagattcactggtctaactctattgctgattgttttacatttgtcttattttctttaaagctgctatatactgtacattagactatgtcctttgtaattgatgatttcagggtttttttttcatggttttaatgatcagaatttggctgcttctca

SEQ ID NO: 10798 - DNA, 1031 bp, Glycine max
gggaggagaggaagagagaaaagtgaattggattgcatctctcgctttgtgttggaagaggggaatcgtagatctgatttctttctttcttttaataataattttgtgatcagaattattgagctgaagaaaagacaatgggattgtgggaagcttttctcaattggctacgcagccttttcttcaagcaggaaatggagttatctctaataggacttcagaatgctgggaagacttcccttgtaaatgtagttgctactggtggatatagtgaggacatgattccaactgtgggattcaatatgaggaaagtgacaaaagggaatgttacaataaagttatgggatcttggaggacaacctaggttccgcagcatgtgggaacgttactgtcgtgccgtttctgctattgtttatgttgttgatgcggccgatccagataacattagcatatcaagaagtgagcttcatgatttgctgagcaaaccttcattgagtggcatccctttgctggtattggggaacaagattgacaaagcggaggctctgtctaaacaagcactgaccgaccaaatggatttgaagtcaattactgacagggaagtttgctgcttcatgatctcatgcaaaaactcgaccaacatcgactctgttattgactggcttgtaaagcattccaaatcaaagagctgagaacctactttctgttttgaattctaatgcaatttacgggtaacattttctggatttactagaggcatttgcatgtctaactcgtttgctgattgatttattcatcccttttgtcagatgctttgtaatataatatcatatcattcttgtccgatagggaattaaacgggatgacatacatgtgaagggttactttatgagcaaattatatcgtgtcataggagtagctatatcattaaaaattcactgaactgccatgagaactgatctttttatcgttgtaaattagattggatattagattctttcgaaggaccctaaaaaaaaaaaaaaaaaaaa

SEQ ID NO: 10799 - DNA, 784 bp, Glycine max
gtgagttcttggtgaaacaaaggaatcgtagatccgtttgtttgtgtagtttttttttttgtcagagaagagaagcgatggggttgtgggaatcttttctcaattggcttcgcagcctctttttcaagcaggaaatggaattatctctgattggacttcagaatgctgggaagacttcacttgtaaatgttattgctactggcgggtatagcgaggacatgattcctacagtgggattcaatatgaggaaggtaacaaaaggaaatgttacaataaagttatgggatcttggaaggcaacctagattccgcagcatgtgggaacgttattgtcgtgcagtttctgctattgtttatgttgttgatgctgcagatccagataaccttagcatatcaaagagtgaactacatgatttgttgagtaagccatcattgagtggtattccattgctggtattggggaacaagattgacaaacctggggttctgtctaaagaagctttgaccgaccaaatggatctgaagtcaattactgacagagaagtgtgctgcttcatgatctcgtgcaaaaactcgactaacattgactctgttatcgattggcttgtaaagcactccaaatcaaagagctaagaggctcccttatgttttgtactctaatgtaatttcagtgacatatatctggaagttgctggaggcatctgcatggctaacttggttgcagattactttattcctgcccttttctcatcgcttctatgtaatatcatgtccaatgacgtgta

SEQ ID NO: 10800 - DNA, 775 bp, Glycine max
atctctctctgtgtgttggaagaggggaatcgtagatctgatttctttctttctttttaataattttgtgatcagaattattgagctgaacaaaagacaatgggattgtgggaagcttttctcaattggcttcgcagcctttttttcaagcaggaaatggagttatctctaataggacttcagaatgctgggaagacttcccttgtaaatgtagttgctaccggtggatatagtgaggacatgattccaactgtgagattcaatatgaggaaagtgacaaaagggaatgttacaataaagttatgggatcttggagggcaacctaggttccgcagcatgtgggaacgttactgtcgtgccgtttctgctattgtttatgttgttgatgctgccgatccagataaccttagcatatcaagaagtgagcttcatgatttgctgagcaaaccatcattgggtggcatccctctgttggtattggggaacaagattgacaaagcgggggctctgtctaaacaagcattgactgaccaaatggatttgaagtcaattactgacagggaagtttgctgcttcatgatctcgtgcaaaaactcgaccaacatcgactctgttattgactggcttgtaaagcattccaaatcaaagagctgagagcctactttctgttttgaactctagtgtaatttatgggtgacacattttctggatttactagagcatttgcatgtctaactcggtgctgattgatttgttttccctttgtcagatgctt

SEQ ID NO: 10801 - DNA, 939 bp, Arabidopsis thaliana
agagagagatatcatcgacagagatcaacgaggacaagaagcttctcagagagatccgtggaggagaattctctcaggcggatctgtttgtcggagcttttgtgaatcatcatcatcaatgggtttgttggaagcttttctcaattggcttcgtagcctcttcttcaagcaagaaatggagctttctttgataggacttcaaaatgcaggaaagacatcacttgtaaatgttgttgcaactggtggatacagtgaagacatgattcctacggtcgggtttaacatgaggaaagtaacaaaaggaaatgttacaatcaaactatgggatcttggtggtcaaccaagattccgcagcatgtgggaacgttactgtcgcgctgtttctgccattgtgtatgtagttgatgctgcagatcctgacaacctaagtgtgtcgaaaagtgaactccatgatttgttgagcaagacttcgcttaatggtatccctcttctcgttcttgggaacaagattgacaaacctggagctctgtccaaagaagccttaacagacgaaatgggacttacatcacttacagatagagaagtctgctgtttcatgatatcatgcaagaactctaccaacattgatcaagtcattgattggctcgtaaagcattcaaagtcgaagaactaatcttcaccaagaacatatattctctcttcttgattcttcttagtcttcctgtattgtctagttgatgatgatggtgacaatttttcgtgtgaaacaagagtgtctttatttttcgccttccgtctctccttcttctgctggtctggtcttgtttggtcctccagtcttgtctttgtatattagatgtggattgtttttctattcccaaggctttgcaatttttgaaacacaaaaacataagtgtcccaaaaaaaattttacttctg

SEQ ID NO: 10802 - DNA, 796 bp, Glycine max
ggaggagaggaagagagaaaagtgaattggattgcatctctcgctttgtgttggaagaggggaatcgtagatctgatttctttctttcttttaataataattttgtgatcagaattattgagctgaagaaaagacaatgggattgtgggaagcttttctcaattggctacgcagccttttcttcaagcaggaaatggagttatctctaataggacttcagaatgctgggaagacttcccttgtaaatgtagttgctactggtggatatagtgaggacatgattccaactgtgggattcaatatgaggaaagtgacaaaagggaatgttacaataaagttatgggatcttggaggacaacctaggttccgcagcatgtgggaacgctactgtcgtgccgtttctgctattgtttatgttgttgatgcggccgatccagataacattagcatatcaagaagtgagcttcatgatttgctgagcaaaccttcattgagtggcatccctttgctggtattggggaacaagattgacaaagcggaggctctgtctaaacaagcactgaccgaccaaatggatttgaagtcaattactgacagggaagttcgctgcttcatgatctcatgcaaaaactcgaccaacatcgactctgttattgactggcttgtaaagcattccaaatcaaagagctgagaacctactttctgttttgaattctaatgcaatttacgggtaacattttctggatttactagaggcatttgcatgtctaactcgtttgctgattgatttattcat

SEQ ID NO: 10803 - DNA, 1123 bp, Arabidopsis thaliana
gacctacataaatatagacggttcagatttactgagccattttgtaactttaattcgccggctctcttgccgtgttttcgattttgacaaacgaaaaaaaaatcttcaatgagataacaataatatcagcagcggaacaaggattgagaaaaggaacctttcccttttaataagccgatatagatccttggaggagaatttgtagcagaccgatctctgtctgttgtctctgtttctacgaatctctgtgtttgtcggaaatcgtaaattatgggtttgtgggatgctcttctcaattggcttcgcagcctcttcttcaagcaagaaatggagctttcattgataggacttcaaaatgcaggaaagacatcacttgttaacgttgttgcaaccggtggatacagtgaagacatgatccctacggttggtttcaacatgaggaaagtgacaaaaggaagtgtcacgatcaagctttgggatctcggtggtcaacctaggttccgcagcatgtgggaacgttactgccgttctgtttccgcgattgtgtatgtagttgatgctgctgatcctgataacctcagtgtctcgaagagtgaactccatgatttgttgagcaagacgtcgcttaatggtatccctctcctagtccttgggaacaaaatcgacaagcctggagctttgtccaaagaagccctaaccgatgaaatgggtctcaagtcactgacagatagagaagtctgttgcttcatgatatcttgcaagaactctaccaacatcgatcaagtcattgattggcttgtaaagcactccaaatcatcgaattaaactttaccccaaaaggagagaagtcaactctctgcagttgtcgatctttcttgtgtttttggtcatttgatgatgatgatggtgattgtggaagaagacacagcttttttcttttatcctgtgaaaaacaagatttgtctatgttctctgtctgattctttatctgtctttcttctgcgtatgtggctgtgttctctgtatattagatttgattggtgttccctcttcttaaagccatgatgagatcacttccttcggggtcagctttttcaattttacgagttcattgcatgttttg

SEQ ID NO: 10804 - DNA, 1065 bp, Glycine max
ttttttttttttttttttaaccacaaaaatgtagaggactagaggataaaaacaaaggtcggtacagtaatcatcttgaaaaactttgggagtttaagagaaagtatatatatatcaatacaagaagcaaatcaaaggatcaaaccctgagcaggagcaggcttggaagatttctgctcacttgcttctgctgcttttggggactcagaaaggacttgtgcatattgatcttccacttttcgtttctgatgttcttctgcaccctctactttctcttttgtcttctgtcctacttccccagccgccttaaaaaccttactaaaagcgccagttacccaggatgccccagtaagcacatagcgattcttcattagggcagagccagcattactcactgtctgttctgcagcagcaaatgctgatttggtcttttctgaaacctggaacttttggtccacttctcgaactctatcactcactactgtagctccagcacttattttctcgctaagcccaattttctgatcgaaagatgcaacttttgctgaggctgtcgacgataactggtgcttctcatcaaaggtctttgctttgttgacagcatcttttcctaagataaagcccttggctagcatgccggagaccacatcctctgccttccgtaaagcagagtcagcaccaccaggagtttgagtttctcttacagatgacgctaacgcagcaggtggaagctggtaatctggatcccgagttattgtaactggcatatcgactattgttgcccctgaaagcagtagtgcagtctcagctccctgtgaatccttgaaggtaatataagcaatttgagatcgttcatcgtggctccgtagttcaacatattcaatatcaccagaaaatgaaaagaactccttaatgtcttgctcagttgctcccaaggaaacgttactgactttaacagttttcatcgtcatcggaaaacgatttcggatagaatctccggtgaccggtaacagccgcgaaaatcagctctgatcggtgaacaagtcgtgctgtgaggagcaatcc

SEQ ID NO: 10805 - DNA, 1061 bp, Glycine max
tttttttttttttttttttttagtggtatcatagaagcaaaataaataattgcaagcacgtccaacagtaaatcagtcctacattcactttcgatctggataaaataaaggtcggtacgaggaagtatatttatcaatacaagaagcaaatcaaaggatcaaaccctgggcaggagcaggcttggaagatttctgctcacttgcttctgctgcttttggggactcagaaaggacttgtgcatattgatcttccacttttcgtttctgttgttcttctgcactctccactttctctttcgtcttctgtcctacttcaccagccgccttaaaaaccttactaaaagcacctgttacccaggatgccccggtaagcacatagcgattcttcattatggcagaaccagcattactcactgtctgttctgcagctgcaaatgctgatttggtcttctctgaaacctgaaacttttggtccacttctcgaactctatcacccactactgtagcaccagcacttattttctcgctaagcccaattttctgatcgaaagacgcaacttttgctgaggctgtggaggataactggtgcttctcgtcaaaggtctttgctttgttgacagcatctttccctaagataaagcccttggctagcatgccggagaccacatcctctgccttccggaaagcagagtcagcaccgccaccaggagttcgagtttctcttacaggtgatgctaaggcagcaggtggaagctggtaatctggatccagagatattgtaactggcatatcgactattgttgctcccgaaagcagtactgcagtctcagctccctgtgaatccttgaaggtaataaaagcaatttgagatcgttcatcatggctctgtagttcaacatattcaatatcaccagaaaatgaaaagaactccttaatgtcttgttcagttgctcccaaggaaacgttactgactttaacagtttttatcgtcatcggaaaacgattttggatagaatctccgatgagtggtaaccaccgcgaaaatcagctctggtcggtga

SEQ ID NO: 10806 - DNA, 1181 bp, Medicago truncatula
gcttcttcttttctccatcacaccgtaacttgctttctcaacccaattcattttatcctttccatctaaacgctctccgatcaccacaaaacccttccgatgtcgataaaaaccgttaaagtcggcaatgtttccttgggagcaaccgagcgggacattcaagagttcttttctttttctggggacattgcatatgttgaactacggagtcatgatgaacgatcgcaaactgcttatgttaccttcaaggattcacagggagctgagactgcagtattgctatcgggagcaacaatagtcgacctgtcagttaatataactctggatccagattaccagcttccacctgaggccctggtttcacccgtaagtgaaagcaaaactcctggtggtgctgactctgctttgcggaaggcagaggatgtagtcaccagcatggcagccaaaggctttatcttaggcaaagatgctgtcaacaaagcaaagacttttgatgagaagctccagttatcatcgaaagcctcagcaacagttgcatctgttgaccaaaaactcgggcttagtgacaaaataggtgctggtgcttcagttgtgagtgataaagttcgaggagtggatcaaaagtttctggtttcagaaaagacaaaatcagcatttgcagctgcggaacagacagtcagtaccgctggttctgccataatgaagaatcgctatgtacttactggggcctcttgggtaacgggtgcttttaacagggtgtctaaggcagctgtggaagtaggtcagaaaacaaaagagaaagtggagaatgcagaacagcaagagaagcgacaggttgaagatcagtatgcacaggtcctttccgaaccctcaaaagcagcagcagcagcaagtgagcagcagtcttccaagcctggtcctgctcctgctcagggtttgatcctttgatctgcttcttccgtatatatttatcttgtttgaaactcctgcagactgtttccagactatcttgtatttgtttttttgcaaattggatgtgaatgaacgataggtttgaccagttacatggaccaatttgctatttaattttcttttgtaagataaactggatttcctaggtgttagattatatatttctcctattttctttgctggtaaaagaaaaaaaaaaaaaaaaaaaa

SEQ ID NO: 10807 - DNA, 1133 bp, Populus trichocarpa
gacgaaacgaacgcttctctcgtcctcttttaacaactcccgtccttcccctctcttttcaacgcagctcgccatgtcggtaaaaacagtaaaagtcagcaacgtttccttaggagcatctgagcgagacctcaaagaattcttttctttttctggtgatattgaatatgttgaaatgaaaagtgataatgagcgttctcaaattgcatatgttaccttcaaagattctcaaggagcagacactgctgttcttctctcgggagcaacaatagttgatctttctgtcactgtggctttggatccagattaccagcttccacctgctgctttagcagaactctctgcaacaggaaataaagctcctggtgatgaatcagctcttcggaaggcagaagatgtagtcagtggcatgcttgcaaagggtttcatcttgggcaaagatgcaatcaacaaagcaaagggttttgatgagaagcaccagttgacttcgacagcctcagctaaagttgtttctttcgacaaaaagataggtctcactgagaagattagtgctggcaccactgttgttggtgacaaagtccgggaagtggatcagaaatttcaggtttctgagaaaaccaaatcagcatttgcagttgccgagcagaaagtcagtagcgcaggatctgccataatgagtaataggtacgtgtttactggggctgcttgggtgactggtgcattcaataaggttgccaaggcagctggggatgttggccagaaggcaaaagaaaaggcaggaatggctgaagaggaacaaaagaggaaaatggtggatgactttgctcaggtccacctatctgagtctcccaaagcatccagtgcaagtgaccagaagccgtccaagcctccacctgcacaaggtttgattctttgatttacagttgtaaatttttcaactagaacgtttgtattttattatctcttgattacttgctggagttctttcagcatggaaaaagctgtgaatgtaggactggttgctccaattagttggataagattgcatgcaatgtctcgacttcttccctcagaatgacaatgtacaaaatttccgttaaatcctgttgtttctgtcaaaaaaaaaaaaaaaa

SEQ ID NO: 10808 - DNA, 1258 bp, Vitis vinifera
caaattcccagtgcgttgtccccagtcccaaatcccaataccgtggtgcctcgccggagtccttctcccacgtgccaccgctgcggggcccaccctccttccagtctttctatataaagtctcttgtcagactacaggcctttgatccctcggcttgcttacgactctccggcgagtttcccatcattttccgccaccggccatatctcaatcttctgcttgaccgctatgccgataacaactgtcaaagtcagcaatgtttccttaggggcaactgagcaggacatcaaagaattcttttctttttctggtgacattgaatgtgttgaaatgcaaagtgataatgagaggtctcaaattgcatatgttaccttcaaggatatgcaaggagcagagactgctattcttctttcgggagcaacaattgtggatatgtctgtgaccataactcctgctccagactaccagctcccgcctgctgctgcttcagcaccacctcttccaaaggaaaataaaactccaggtcgtgctgaatctgcttttcgaaagacagaagatgttgtcagtggaatgcttgctaaaggctatatcttaggcaaagatgcagttaataaagcaaaatcctttgacgagaaacatcaattgacttccacagccacgtctaaagttgtttcctttgacaaaaaaatcggtttcactgagaagataagtgctggtacttctgttgtgaatgaaaaagttcgagaagtggatcacaaatttcaagtttccgataaaaccaagtcagcatttgcggctgctgagcaaaaagtcagtagtgctggatctgccataatgaaaaaccgatatgtatttaccggagcttcatgggtaacaggcgctttcaataaggttgctaaggcagctgaggaagtgggccagaaggcaaaagagaaggtgggaaagtctgaagatgaacagaaaagaagagtagtggaggactttgcccaggttcatctatctgattctccaaaagcttctgcttccaatgagcagcatccttacaagcctgctcctccacaaggtttgattctctaattcgcttcagtaaatatctttgtccaaacttttggaattcattttctcttgattatttgcactgttctttttgtatggaagtggcgaatgtagaatatagtgtcccttattgttggatatggttgcactttatatcaacttttcttttgttgaaatggcaatgaattgaacattcatgata

SEQ ID NO: 10809 - DNA, 1190 bp, Vitis vinifera
ttcttcacgaaccgaaattttctgagttcccaattgatcttcgaagctctactcatggcgataagcacggtgaaagtcagcaatgtctccttaggtgcatctgaacaagatataaaggagttcttctccttttctggtgaaattgaatatgtggaaatgcaaagtgagaatgaacggtctcaagttgcatatgttaccttcaaggatacccaaggggcagagactgcagttcttctttcgggagcaacaattgttgatatgtctgttataatagcgccggcacctgattacaagcttccagctgctgcttctgtacagcctagggcaacagagaacacaaatgtgggggctggtgaatcccccctccaaaaggctgaggacgttgtcagtggtatgctagccaagggcttcattctggggaaagacgcactcaacaaggcaaagtccttcgatgagaggcaccaattcacctccactgcctcggcaaaagtcgtatctctggatcaaaaaatcggcctcaccgacaaaatcagcatgggcacaaccctggtgaaagacaaagttggggaaatggaccagaagttccaggtttctgaaaaaaccaagactgccttcgcagctgctgagcagacagttagcaatgctggttcagccatcatgaaaaaccgttacgtcttgaccggtgcttcatgggtcaccggagccttcaacaaagtcgccaaggcagcaggagaagttgggcaaaaggcaaaggagaaggtggctgaggaggaacaaggaagaaacgtggggcaaggctattctcagattcacgagtcggaatccccgaaagctgctacgagtgagcagccttccaagccagccccggctcaaggtttgatcctttaacttcctaaaactcttgtgtaaatgagagaggattggatctttatcctcttcagattgcctgctctttttcttccgcatgaatgtgggaaatgtagaatagtttgacatataaactgttgaaaatggctgctatacatgacttcaaatttgatgattctgttttattcaattcctttgatttagatttatgtagtgctaaattcatcttttgttaatctctttcgtgtttattgagaatcttgtatttttatcacgcttttatatatggtagtacgtaaacatgtgatgcattgtgagggtgt

SEQ ID NO: 10810 - DNA, 1065 bp, Glycine max; identical to SEQ ID NO: 10804

SEQ ID NO: 10811 - DNA, 1971 bp, Trifolium pratense
gcttatccatctacactcttccaaacatggcttcaacaaacgctttatcctcaacctcaattcttcgttctccaaccaacaaccaggcacaaactagtcttagcaagaaggctaaacaacatggcagagttaattacagacagaatcctaaccgttttatggttaaagctgctgctaaagatattgcctttgaccaacattcacgccgcgctatgcaggccggaattgataaacttgctgatgctgttggtcttactcttggacctagagggaggaatgttgtcttggatgagtttggtagtcctaaggtagttaatgatggtgtcacaattgcaagagctattgagctacctgatcccatggaaaatgctggtgcagctcttattagggaggttgcaagtaaaactaatgactctgctggtgatgggactacaaccgcttcgattcttgcacgggaaattattaagcttggacttctcagtgtgacatctggtgctaatcccgtgtctatcaagaagggaattgataaaactgtggcaggtttgattgaagagctcgagaagttggctaggcctgttaaaggcggagatgatattaaagctgttgcttctatttctgctggaaatgatgagttgatcggaaaaatgattgctgaagcaattgacaaggttggacccgatggtgttttatctattgagtcgtcgtcatcatttgagacaaccgttgaagttgaagaaggaatggagattgacagaggttatatctccccccaatttgttacgaatcttgagaaatcaattgttgaatttgagaatgcaagagttttgataaccgatcagaagatttcagccataaaagatataattcctctgctagagaaaaccactcaattgagagcccccttgtttatcattgccgaagatatcactggtgaagctttggctacccttgttgtgaataagctacgtggtatccttaatgttgcagccatcaaagctccaggctttggtgagagacgaaaggccctccttcaagacattgctatattgacaggtgccgagtaccaagccagtgatctaggacttcttgtcgaaaacacctcaattgaacaacttggtttggcccgtaaagtgaccatctccaaggattctaccaccattattgctgatgctgcatcaaaggatgagttgcaatctagggtggcacaactgaagaaagagttgtctgaaacagactcagtttatgattctgagaaactggctgagaggattgctaaattgtctggtggagttgcagtcatcaaggttggtgctgctacagagaccgaacttgaggatcgtaagctccgaattgaggatgccaagaatgcaacttttgctgccattgaggaaggtattgttcctggtggaggtactgcattggttcatctctctgcttatgttccagcaattaaagaaaagcttgaagatgcagatgagaggctaggagctgacattgttcaaaaggcactggtcgcacctgcatcattgattgctcaaaatgctggaatagagggtgaagtagttgtggagaaaattaggaatggtgaatgggaggttggttacaatgccatgactgacacttatgagaatttaattgagtctggagtcattgaccctgccaaggtaacacgttgcgctttgcagaatgctgcatcagtggccggaatggtcttgaccacacaggccattgtggtcgaaaagcctaagcccagggcacctgtgcctggcgccccacaaggccttactgtttaagttttaggttaattattgtggtaggttaattattgcggcaaacagttttgagcagaaaagttgaaagagctgtgtttcggatgcctgttcaattaaaaaaaaaaaaaaaaaaaacctgcagcccgggggatccactagttctagagcggccgccaccgcggtggagctccagcttttg

SEQ ID NO: 10812 - DNA, 1982 bp, Trifolium pratense
gatcttatccatctacactcttccaaacatggcttcaacaaacgctttatcctcaacctcaattcttcgttctccaaccaacaaccaggcacaaactagtcttagcaagaaggctaaacaacatggcagagttaattacagacagaatcctaaccgttttatggttaaagctgctgctaaagatattgcctttgaccaacattcacgccgcgctatgcaggccggaattgataaacttgctgatgctgttggtcttactcttggacctagagggaggaatgttgtcttggatgagtttggtagtcctaaggtagttaatgatggtgtcacaattgcaagagctattgagctacctgatcccatggaaaatgctggtgcagctcttattagggaggttgcaagtaaaactaatgactctgctggtgatgggactacaaccgcttcgattcttgcacgggaaattattaagcttggacttctcagtgtgacatctggtgctaatcccgtgtctatcaagaagggaattgataaaactgtggcaggtttgattgaagagctcgagaagttggctaggcctgttaaaggcggagatgatattaaagctgttgcttctatttctgctggaaatgatgagttgatcggaaaaatgattgctgaagcaattggcaaggttggacccgatggtgttttatctattgagtcgtcgtcatcatttgagacaaccgttgaagttgaagaaggaatggagattgacagagggtatatctccccccaatttgttacgaatcttgagaaatcaattgttgaatttgagaatgcaagagttttgataaccgatcagaagatttcagccataaaagatataattcctctgctagagaaaaccactcaattgagagccccgttgtttatcattgccgaagatatcactggtgaagctttggctacccttgttgtgaataagctacgtggtatccttaatgttgcagccatcaaagctccaggctttggtgagagacgaaaggccctccttcaagacattgctatattgacaggtgccgagtaccaagccagtgatctaggacttcttgtcgaaaacacctcaattgaacaacttggtttggcccgtaaagtgaccatctccaaggattctaccaccattattgctgatgctgcatcaaaggatgagttgcaatctagggtggcacaactgaagaaagagttgtctgaaacagactcagtttatgattctgagaaactggctgagaggattgctaaattgtctggtggagttgcagtcatcaaggttggtgctgctacagagaccgaacttgaggatcgtaagctccgaattgaggatgccaagaatgcaacttttgctgccattgaggaaggtattgttcctggtggaggtactgcattggttcatctctctgcttatgttccagcaattaaagaaaagcttgaagatgcagatgagaggctaggagctgacattgttcaaaaggcactggtcgcacctgcatcattgattgctcaaaatgctggaatagagggtgaagtagttgtggagaaaattaggaatggtgaatgggaggttggttacaatgccatgactgacacttatgagaatttaattgagtccggagtcattgaccctgccaaggtaacacgttgcgctttgcagaatgctgcatcagtggccggaatggtcttgaccacacaggccattgtggtcgaaaagcctaagcccagggcacctgtgcctggcgccccacaaggccttactgtttaagttttaggttaattattgtggtaggttaattattgcggcaaacagttttgagcagaaaagttgaaagagctgtgtttcggatgcctgttcaattgaaaggaaaaaacaaaaactgtatttgtaaacatagtttaagatttgttttggttgatgagggataagggaagttataaatttggattctagt

SEQ ID NO: 10813 - DNA, 1986 bp, Trifolium pratense
gctatcatatcatcttatccatctacactcttccacactcttccaaacatggcttcaacaaacgctttatcctcaacctcaattcttcgttctccaaccaacaaccaggcacaaactagtcttagcaagaaggctaaacaacatggcagagttaattacagacagaatcctaaccgttttatggttaaagctgctgctaaagatattgcctttgaccaacattcacgccgcgctatgcaggccggaattgataaacttgctgatgctgttggtcttactcttggacctagagggaggaatgttgtgttggatgagtttggtagtcctaaggtagttaatgatggtgtcacaattgcaagagctattgagctacctgatcccatggaaaatgctggtgcagctcttattagggaggttgcaagtaaaactaatgactctgctggtgatgggactacaaccgcttcgattcttgcacgggaaattattaagcttggacttctcagtgtgacatctggtgctaatcccgtgtctatcaagaagggaattgataaaactgtggcaggtttgattgaagagctcgagaagttggctaggcctgttaaaggcggagatgatattaaagctgttgcttctatttctgctggaaatgatgagttgatcggaaaaatgattgctgaagcaattggcaaggttggacccgatggtgttttatctattgagtcgtcgtcatcatttgagacaaccgttgaagttgaagaaggaatggagattgacagaggttatatctccccccaatttgttacgaatcttgagaaatcaattgttgaatttgagaatgcaagagttttgataaccgatcagaagatttcagccataaaagatataattcctctgctagagaaaaccactcaattgagagcccccttgtttatcattgccgaagatatcactggtgaagctttggctacccttgttgtgaataagctacgtggtatccttaatgttgcagccatcaaagctccaggctttggtgagagacgaaaggccctccttcaagacattgctatattgacaggtgccgagtaccaagccagtgatctaggacttcttgtcgaaaacacctcaattgaacaacttggtttggcccgtaaagtgaccatctccaaggattctaccaccattattgctgatgctgcatcaaaggatgagttgcaatctagggtggcacaactgaagaaagagttgtctgaaacagactcagtttatgattctgagaaactggctgagaggattgctaaattgtctggtggagttgcagtcatcaaggttggtgctgctacagagaccgaacttgaggatcgtaagctccgaattgaggatgccaagaatgcaacttttgctgccattgaggaaggtattgttcctggtggaggtactgcattggttcatctctctgcttatgttccagcaattaaagaaaagcttgaagatgcagatgagaggctaggagctgacattgttcaaaaggcactggtcgcacctgcatcattgattgctcaaaatgctggaatagagggtgaagtagttgtggagaaaattaggaatggtgaatgggaggttggttacaatgccatgactgacacttatgagaatttaattgagtccggagtcattgaccctgccaaggtaacacgttgcgctttgcagaatgctgcatcagtggccggaatggtcttgaccacacaggccactgtggtcgaaaagcctaagcccagggcacctgtgcctggcgccccacaaggccttactgtttaagttttaggttaattattgtggtaggttaattattgcggcaaacagttttgagcagaaaagttgaaagagctgtgtttcggatgcctgttcaattgaaagggaaaaaaaaaaactgtatttgtaaacatagtttaagatttgttttggttgatgagggataagggaagttat

SEQ ID NO: 10814 - DNA, 2018 bp, Trifolium pratense
gctcaattcttcgttctccaaccaacaaccaggcacaaactagtcttagcaagaaggctaaacaacatggcagagttaattacagacagaatcctaaccgttttatggttaaagctgctgctaaagatattgcctttgaccaacattcacgccgcgctatgcaggccggaattgataaacttgctgatgctgttggtcttactcttggacctagagggaggaatgttgtcttggatgagtttggtagtcctaaggtagttaatgatggtgtcacaattgcaagagctattgagctacctgatcccatggaaaatgctggtgcagctcttattagggaggttgcaagtaaaactaatgactctgctggtgatgggactacaaccgcttcgattcttgcacgggaaattattaagcttggacttctcagtgtgacatctggtgctaatcccgtgtctatcaagaagggaattgataaaactgtggcaggtttgattgaagagctcgagaagttggctaggcctgttaaaggcggagatgatattaaagctgttgcttctatttctgctggaaatgatgagttgatcggaaaaatgattgctgaagcaattggcaaggttggacccgatggtgttttatctattgagtcgtcgtcatcatttgagacaaccgttgaagttgaagaaggaatggagattgacagagggtatatctccccccaatttgttacgaatcttgagaaatcaattgttgaatttgagaatgcaagagttttgataaccgatcagaagatttcagccataaaagatataattcctctgctagagaaaaccactcaattgagagcccccttgtttatcattgccgaagatatcactggtgaagctttggctacccttgttgtgaataagctacgtggtatccttaatgttgcagccatcaaagctccaggctttggtgagagacgaaaggccctccttcaagacattgctatattgacaggtgccgagtaccaagccagtgatctaggacttcttgtcgaaaacacctcaattgaacaacttggtttggcccgtaaagtgaccatctccaaggattctaccaccattattgctgatgctgcatcaaaggatgagttgcaatctagggtggcacaactgaagaaagagttgtctgaaacagactcagtttatgattctgagaaactggctgagaggattgctaaattgtctggtggagttgcagtcatcaaggttggtgctgctacagagaccgaacttgaggatcgtaagctccgaattgaggatgccaagaatgcaacttttgctgccattgaggaaggtattgttcctggtggaggtactgcattggttcatctctctgcttatgttccagcaattaaagaaaagcttgaagatgcagatgagaggctaggagctgacattgttcaaaaggcactggtcgcacctgcatcattgattgctcaaaatgctggaatagagggtgaagtagttgtggagaaaattaggaatggtgaatgggaggttggttacaatgccatgactgacacttatgagaatttaattgagtccggagtcattgaccctgccaaggtaacacgttgcgctttgcagaatgctgcatcagtggccggaatggtcttgaccacacaggccattgtggtcgaaaagcctaagcccagggcacctgtgcctggcgccccacaaggccttactgtttaagttttaggttaattattgtggtaggttaattattgcggcaaacagttttgagcagaaaagttgaaagagctgtgtttcggatgcctgttcaattgaaaggaaaaaacaaaaactgtatttgtaaacatagtttaagatttgttttggttgatgagggataagggaagttataaatttggattctagtcattgtgtttcataataatttaaaatagtctttgatgtccttcctccagtaattatatgttttaaggcatttgcttcagcggacatttacac

SEQ ID NO: 10815 - DNA, 2002 bp, Medicago truncatula
ttttttttttttttttttttttatccctcatcaatcaaaacaaatcttaaactatgtttacaaatacagttttttttttttcaattgaacagtcatccgaaaacacaagctctttcacttttctgctcaaaactgtttgccgtaattaacctacaacaataattaaaatctaaaacttaaacggtaaggccttgtggggcagcagccgcagctgccctgggcttaggcttttcgacaacaatggcctgtgtggtcaagaccatcccagccactgaagcagcattctgcaaagcacgccttgttacctttgcagggtcgatgactccaaactcaattaaattctcataagtgtctgtcatggcattgtaaccaacctcccattcaccacttctaattttctccacaactacttcaccttctattccagcattttgagcaatcaatgatgcaggtgctaccaatgccttttgaacaatgtcagctcctagcctctcatctgcatcttctagtttttccttgattgctggaacataagcaaaaagatgaaccaatgcagtacctccgccaggagcaataccttcttcaatggcagcaaaagttgcattcttggcatcctcaattctaagtttacgatcctcaagttcggtctctgtagcagcaccgaccttgatgactgcaactccaccagacaatttagcaatcctctcggccaatttctccgaatcgtaaactgagtctgtctcaaacaactctttcttcaactgtgcaaccctagattgcaactcatcctttgatgcagcatcagcaataatagtggtagaatccttggagatggtcactttccgagccaaaccaagttgttcaattggggtgctttcaacaagaaggcccagatcactggcctggaactcagcacctgtcaatattgcaatgtcttgaaggagagcctttcttctttcaccaaatcctggagctttgatggcagccacattaaggataccacgcagcttgttcacaacaagggtagccaaagcctcaccggtgatatcttcggcaatgataagcaaaggggctctcaattgagtggttttctccaacagaggaattatatcttttattgcggaaatcttttggtcggtaatcaagactcttgcattctcaaattcaacaattgatttctcaagatttgtaacaaattggggagagatgtagcctctgtcaatctccattccttcttcgacttcgacggttgtctcaaatgaggaggaagactcgatggataaaacaccatcaggtccaaccttgccaattgcttcagcaatcattgttccaatcaactcatcatttccggcagaaatagaagcaacggcttttatatcatctccacctttaacaggcctagccaacttctcaagctcttccaccaaagccgctactgttttatcaattcctttcttgatggacacaggattagcacctgatgtcacactgagaagtccaagcttaatgatttcccgagccaaaatcgaagctgttgtagtcccatctccagctgagtcattagttttactagcaacctccctaattagagcagcaccagcattttccatggcatcaggtaactcaatagctcttgcaattgtcacaccatcattaactaccttaggactaccaaactcatccaaaacaacattcctccctcggggtccgagagtgaggccaacagcatcagcaagtttatcaattccagcctgcatagcacggcgtgaatcttggtcaaaggcaatatctttagcacttgctttaaccacgaaacggttaactttctgtctgtaattaacccttccatgttggttcgccttcctgctaagacttgtttgtgcctggttggtaggagaacggagaattgaggttgaggatagagcgttggttgaagccatgtttggagagtgtggataagaagatggtgtttgagatagaatgaacgaaactcaacgaagtc

SEQ ID NO: 10816 - DNA, 2027 bp, Glycine max
  misc_feature (644)..(644): n is a, c, g, or t
ggttgttgttttcagtgtagtggaagaatcactcccttatccatttccacaccacaccatggcctcaaccaacgctctctcttcagcctccattctacgctctcccaaccgccagtctctgacccgaagagcgaaccataatggaagagtaaattaccggaaaccgaataaccgtttctccgtgaaagcctccgccaaagagattgcctttgaccagcattcccgctctgctatgcaggccggcattgacaagctcgccgacgctgttgggctcactcttgggcccagagggaggaatgttgtgttggatgagtttggaagtcctaaagtggtcaacgatggtgtcaccattgctcgcgcaatcgagcttcccgatcctatggagaatgctggtgcagctcttatcagagaggttgctagcaagactaacgactctgcgggtgatgggactaccacggcttcggttcttgctcgcgagataattaagctggggcttctcagtgtgacttctggggcaaatcctgtgtctcttaagagagggattgataagactgtgcagggtttggtggaggagttggagaagaaggctaggcctgtcaaaggtggagatgatatcaaagctgttgcttccatttctgctgganatgatgagttgattgggcaaatgattgcggaagcaattgataaggttggacctgatggtgttttgtccattgagtcttcgtcttcatttgagaccacagttgaagtggaagaaggaatggagattgacagagggtatatctcgcctcaatttgtgacaaaccctgagaagttgattgttgaatttgagaatgcgagagtgttgatcacggatcagaagatttcagcaataaaagatattataccactgttggagaaaaccactcagttgagagctcctttgcttatcattgctgaggatgtcactggtgaggctttggccacccttgttgtgaataagctacgtggtatccttaacgttgctgccatcaaagctcctgggctttgtgagcggcgaaaggccctgcttcaagacattgctatattgactggtgctgagttccaagctagtgatctgggtctgcttgttgaaaacacctcagtggagcagcttggcttggctcggaaaattaccatctccaaggattctaccactatcattgctgatgctgcaacaaaggatgagctgcaagccagggttgctcagttaaagaaggagctgtcacagacagactcagtatatgatactgagaaactggctgagaggatagctaaactgtctggtggagttgcagtcatcaaggttggtgctgccacagagaccgagcttgaggatcgtaagctccgaattgaggatgccaagaatgcaacttttgctgccattgaggaaggtattgtacctggtggaggtactgcactggttcatctctccactcatgtcccagcaatcaaggacaagcttgaggatgcagatgagaggctaggagctgacattgtgcaaaaggcactgatagctcctgcagcattgattgctcaaaatgctggaatagaaggtgaagttgttgtggagaaaataaagagtggtgaatgggaggtcggttacaatgccatggcagacaggtatgagaatttagtggaggctggagttatcgaccctgccaaggtaactaggtgtgctttgcagaatgctgcttcagttgctggaatggtgttgaccacgcaggccattgtggtggagaaacctaagcccaaggcacctgtagctggtgccccacaaggccttaccgtttgatttttaggctgtagggctacggcgaagaacagttttgtgcagaaaattgaaagtgcgtatgtgttcgaattctgttcaatcggaaaaaaaaatgtatttgtaaacagttttagatttgttgggcttgatgagagaaaagagattataatattggattctagtcatggcatgtttaatgattgaaaataaggtagtcatttgataaaaaaaaaaa

SEQ ID NO: 10817 - DNA, 2040 bp, Canavalia lineata
gcgcgcctgcaggtcgacactagtggatccaaagaattcggcacgagcccttatccatttctctccacaccacgaagccatggcctctaccaacgctttatcatcagcctccattttgcgttctcccaaccaccagagtttgagcagacgggcgaaccagaacgggagagtaaattaccggcaaccgaatcaccgtttcgcggtgaaagcctctgccaaagagattgccttcgaccagagttcccgcgccgcaattcaagccggcattgacaagctcgccgatgctgttggtctcactcttggtcctagggggaggaatgtggtgttagatgagtttggaagccctaaggtagttaatgatggtgtgaccattgctcgagctattgagcttccggatgccatggaaaatgctggtgcagctctcattagggaggttgctagtaaaaccaatgactctgctggggatgggacaaccacggcttctgttcttgctcgggagataattaagcttgggcttctcagtgtgacctctggtgccaatcctgtttctctcaagagagggattgataaaactgtgcagggtttggtggaggagcttgagaagagggccaggcctgtcaaaggtggagatgatatcaaagctgttgcttctatttctgctggaaatgatgagttgattggaaaaatgattgcggaagcaattgacaaggttggacctgatggtgttttatccattgagtcttcgtcctcttttgagacgacggttgaagttgaagaaggaattgagattgacagagggtacatctcctcatttgttacaaaccttgagaagtcaattgtggaatttgagaatgcaagagtcttggttactgatcagaagatttcagcaataaaagatataattccactgttggagaaaaccactcaattgagagcccccttgattatcattgctgaagatgtcactggtgaggctttggctacccttgttgtgaataagctgcgcggtatccttaatgtagctgccatcaaagctcctagctttggtgagcggcgaaaggctgtccttcaagatattgccatattgacaggtgctgagttccaagcctctgatctggggctacttgttgagaacacctcaattgagcagcttggtttggctcgcaaagtgaccatctccaaggattctaccactatcattgctgatgccgcatcaaaggatgagttgcaagccagggttgcacagttaaagaaagagttggcggagacagacgcagtctatgactcagtaaaactggctgagaggattactaagttgtctggtggagttgcagttattaaagttggtgctgctacagagactgaacttgaggatcgcaagctccgtattgaggatgccaagaatgcaacattcgccattgaggttggtattgtactggtggatactgcattgcttcatctctccactcatgtcccggctatcaaggacaagcttgaagatgcagatgagagactaggagctgacattgtgcaaaaggcactgatagcacctgcatcattgattgctcaaaatgctggaatagaaggtgaagttgttgtcgagaaagtaaagaatggtgaatgggaggttggttacaatgccatgacagacagatatgaaaatttagtggaggctggagtgatcgaccctgccaaggtaacaaggtgtgcattgcagaatgctgcttctgttgctggaatggtgttgaccacacaggccattgtggtggaaaaaccaaagcccaaggcacctacggctgctgccccacaaggccttactatttaatttttaggttacttgcttgtagggttacggcaaagaacagttttgtgcagaaaattgaaagagcgtgagtgttcggatatctgttcaatcgaaaaaaaaatgtatttgtaaacatagttctagatttgttcggatcctggtcaccggtatgttttatgattgaaataagataagtctttggatgtatttttcttttaaaaaaaaaaaaaaaaaaa

SEQ ID NO: 10818 - DNA, 782 bp, Glycine max
tttttttttttttttttttgaggtacaaaagaacatgttcttaagatgctaaaagataaattaatggctgttgagttttcactagtttttagacatttccatctgttttcttttcacaagttttcggttccatagctttgcaataaaggaacactctcagtagctggtgattccgggtaatcaacttcttcctctatctcctctgttgctttgccccacaacacagcataaaagccaaatgatactattgccgctccaactatacttccaacatgaagagagtcaccaaggaagatgacacccatggcaatagaaaaaacaatttggaggggtgagaatgatgctagatacacaggccctttccaagcatttgcgtttggcactgcaaataaagctacaagtgtagacatgactgtggaagtcacgttgtaagaggactattgtcacttcatccgggaacacttttagaacatcagcctgcacaatgtaacataatgaacctattaaacattcagctgtgagcagaatgccagcaatgacccaatctgcatccccagatttaagaaagctaaatggatgttgaagtggtatggaaagatcatgggaatgagctttgatgattgaatggcctttgtacaaagtcaatacaaatgctcctgttattgatattatgcttccaactaccttagcttgactacttctgcttttggcagctatcttttccatcctgaaaatgatggcaagaatgaaggtgaaagcagggcccagattggcgattgatc

SEQ ID NO: 10819 - DNA, 1443 bp, Trifolium pratense
ggcacgaggctgctggtgatgggactacaaccgcttcgattcttgcacgggaaattattaagcttggacttctcagtgtgacatctggtgctaatcccgtgtctatcaagaagggaattgataaaactgtggcaggtttgattgaagagcttgagaagttggctaggcctgttaaaggcggagatgatattaaagctgttgcttctatttctgctggaaatgatgagttgatcggaaaaatgattgctgaagcaattggcaaggttggacccgatggtgttttatctattgagtcgtcgtcatcatttgagacaaccgttgaagttgaagaaggaatggagattgacagagggtatatctccccccaatttgttacgaatcttgagaaatcaattgttgaatttgagaatgcaagagttttgataaccgatcagaagatttcagccataaaagatataattcctctgctagagaaaaccactcaattgagagcccccttgtttatcattgccgaagatatcactggtgaagctttggctacccttgttgtgaataagctacgtggtatccttaatgttgcagccatcaaagctccaggctttggtgagagacgaaaggccctccttcaagacattgctatattgacaggtgccgagtaccaagccagtgatctaggacttcttgtcgaaaacacctcaattgaacaacttggtttggcccgtaaagtgaccatctccaaggattctaccaccattattgctgatgctgcatcaaaggatgagttgcaatctagggtggcacaactgaagaaagagttgtctgaaacagactcagtttatgattctgagaaactggctgagaggattgctaaattgtctggtggagttgcagtcatcaaggttggtgctgctacagagaccgaacttgaggatcgtaagctccgaattgaggatgccaagaatgcaacttttgctgccattgaggaaggtattgttcctggtggaggtactgcattggttcatctctctgcttatgttccagcaattaaagaaaagcttgaagatgcagatgagaggctaggagctgacattgttcaaaaggcactggtcgcacctgcatcattgattgctcaaaatgctggaatagagggtgaagtagttgtggagaaaattaggaatggtgaatgggaggttggttacaatgccatgactgacacttatgagaatttaattgagtccggagtcattgaccctgccaaggtaacacgttgcgctttgcagaatgctgcatcagtggccggaatggtcttgaccacacaggccattgtggttgaaaagcctaagcccagggcacctgtgcctggcgccccacaaggccttactgtttaagttttaggttaattattgtggtaggttaattattgcggcaaacagttttgagcag

SEQ ID NO: 10820 - DNA, 782 bp, Glycine max; identical to SEQ ID NO: 10818

SEQ ID NO: 10821 - DNA, 1971 bp, Trifolium pratense; identical to SEQ ID NO: 10811

SEQ ID NO: 10822 - DNA, 1982 bp, Trifolium pratense; identical to SEQ ID NO: 10812

SEQ ID NO: 10823 - DNA, 1986 bp, Trifolium pratense; identical to SEQ ID NO: 10813

SEQ ID NO: 10824 - DNA, 2018 bp, Trifolium pratense; identical to SEQ ID NO: 10814

SEQ ID NO: 10825 - DNA, 2002 bp, Medicago truncatula; identical to SEQ ID NO: 10815

SEQ ID NO: 10826 - DNA, 2027 bp, Glycine max; identical to SEQ ID NO: 10816
  misc_feature (644)..(644): n is a, c, g, or t

SEQ ID NO: 10827 - DNA, 2040 bp, Canavalia lineata; identical to SEQ ID NO: 10817

SEQ ID NO: 10828 - DNA, 1603 bp, Glycine max
ttttttttttttttgtgaactccaatttatttcatccaataaccctgctctctattgtttagtatttgaataaaacaaatgagactgtgagaatcattttctgcagtccaaaaatagaaaagatgaaaaaaaaaaacaaataaatttacatttgttacagtctctgctttgtcagcctatttagagaaaactccaggcaggcccagattttattcagacttttatgacaaagcccaaatttcaattgaggcttgaatttccaggtcctaacttaagggcttgtctcgaactgaacccttttaggcccggcaccaatttaggaatgaagcaaaggaagaagctgaacaaaaactggctcaatgtcaatcatggaattaaaactaaatgtgcattgcaacatcatcatcagcttaatccctgcctagaagaaactcgattctgagtctcagctttggagtgccatttctgagcaagaattttcttagtcttctcaagaacacaaaaaaatattgaacctccaattcctatccacaaaactctaggcccaatacctttaaaaagagcatgacttccttcttctttaactattgttctcacacaatcagaaatgcctttgtaatggttttgtgatccctgaaccatcaatctggtctttactacatcaagaggagttgtaactgctccagttaccgcaccagccactgccccaagcatagcattctctggatcattaggatctctttttgccgctaatttatacccaatacggagctgctcataaatgcataattctatagcatcaaatggtaaatctcgcaataagaaagatccatatcccgcaaaaagacctttaaaaccctcattagcaacaataagacggacagcatctggggctgatttaaattgcccaatctgcatcctttgcttaacaacctcagttggaacccgaacaacagaagaagcaatgcctccaatagcacctgcagcaaaatgagccacggcactgagattttcaggcaatgactttagcaattgctgctttgtgggttcatacacaccaataaaaattgctgaagctggtaagacaccaacaatatttccagccaacccagagtacagacccttcaaaacaattttccctccgtcgcgagcaacctgtagtcgagttttgatggtatcaatggggtataaagctgtttctacaacaacaccagcagcacctccagcaatgcaaccatcatataaaacacgtaaaaagtcaaatggttttttctctccttgactgatggacaagaagaacttatcttgatccttttgaacagacattttagacttcaatgcatctgtacgttacggtttgacattcgttaactacccattattcaatctctcattctagagaaaaggaacagcatgaagaacctttaggcaattgaatctgggtggggacttttggaggttattggcaatgtgcaaagccaaagatcaaagctttatctaacaaaacaaaaactctccaacaatttaaccagtttcgtgtcctcccatacgagttgcggcgaagtggaaaaaccaaaccctcgaccaaatgtgttttacctcc

SEQ ID NO: 10829 - DNA, 1020 bp, Nicotiana benthamiana
aacttcccaagaactgaggggagaattaaaagcttcaaaatgggaccttttgcattagctttggatacaaaaaattcttttgcagcctcctcttctgcctcagatgcatctggtagaaaaatggataaccttcagatggtaccaaaaaagttctttgcatcagtcaacagtggagaagagaaaccatttgattttttgcgtatactatttgagggtgtcatagcaggagggacagcaggcgttgtcgttgaaacagctttatatcccattgatacaataaaaacacgactgcaggcagctcgtggtggaggacaaatagccttgaaagggttgtattctgggcttgctggaaatcttgctggagtcctaccggcttctgccatttttgttggtgtatatgaaccggcaaagcaaaagttattgaagatgcttcctgaaaatcttagtgctgtggcccatcttactgctggtgctttaggaggccttgctgcttctttcgttcgtgttccaactgaggtcattaaacagcggatgcagactaggcaatttgcttcggctcctgatgctgttcgcctaattgtttctaaggaaggttttaaaggtctttatgcgggatatgggtcatttctacttcgagatttgccatttgatgccatccaattttgtatctatgagcagctgcggataggttataagctggcagcaaaaagggacttgaatgatccagagaatgctgttattggtgcctttgctggtgctctaactggagctataaccacccctcttgatgtcattaagacaagattaatggttcagggttctgccaaccaatacaaaggcatcattgattgtgtgaggactattgttacagaagaaggagctccagcacttctaaagggcatcggtccaagagtgctttggataggcattggcggatcaatattctttggtgttcttgagaggacaaagcgataccttgcacaaaatcgtcctgataatgcagcctcaaagcaggattag

SEQ ID NO: 10830 - DNA, 981 bp, Capsicum annuum
atggggccttttgcattagctttggatacaaagaattcttttgtggcctcctcttctgcttcagatgcatctggtagaaaaatggatagccttcagatgttaccaaaaaagttcttcgcatcaatcaacaatgaagaagagaaaccttttgatttcctgaggattctatttgagggtgtcatagcaggagggactgccggcgttgttgttgaaacagctttatatcccattgatacaataaagacgcgactgcaggcagctcgtggtggaggacaaatagtcttgaaagggttgtattcggggcttgctggaaatcttgctggagtcctaccggcttctgctatttttgttggtgtatatgaaccggcaaagcagaaactattgaagatgtttcctgaaaatcttagtgctgtggcccatcttagtgctggtgctttaggaggcattgctgcttcttttgttcgtgttccaactgaggtcattaagcagcgaatgcaaactaggcaatttgcttcacctccggatgccgttcgcctaattgtttcaaaagaaggttttaaaggtctttatgcgggatatcgatcatttctacttcgagatttgccatttgatgccatccagttctgtatctacgagcagctgcggataggttataagctggctgcaaaaagggaattgaatgacccagagaatgcagttatcggcgcttttgctggtgctctaactggagctataactacccctcttgatgtcataaagacgagattaatgattcagggttctgccaaccagtacaaaggcattgttgattgtgtgaagaccattgttgcagaagaagggcctccagcacttttaaagggcattgggccaagagtcctttggataggcattggaggatcaatattctttggtgttcttgagagaacaaagcgattccttgcacaaaatctccctgataatgcagcctcaaagcaggtttaa

SEQ ID NO: 10831 - DNA, 1296 bp, Vitis vinifera
atgggtccttttacgttagccattgatgcgaagaagtcttcactggcggtttcagattcatccaataggaaagtgcaaaatgcgcagcttggaaaaaagaaattttttgcatccatcagcacgggggaggaaaaagaattcaactttttacgtgttctacttgagggcattgtagcaggaggtacagctggtgtggttgttgaaacagctttatacccaattgataccataaagactcgactgcaggcagttcgaggaggaggtaaaatagtttggaatggcctttactctgggttggctggaaaccttgctggggtcttgccggcttctgccatatttgttggtgtttatgagcctacaaagcaaaaactgttacagatatttcctgaaaatcttactgctgttgctcatttgactgcgggtgccattggagggcttgccgcttctctcgttcgtgttccaacagaggttgttaagcaaaggatgcagactggccaatttgcttcagctccagatgcagtacgcatgatcgtttccaaagagggctttaaaggtctctatgctggatatcgatcttttctattgcgagatcttccatttgatgcgattcagttttgcatttatgagcagatgcggataggttacaagttggcagcaaagagagatttgaatgatcctgagaatgccctcattggtgcttttgctggggcgttaactggagctataactacaccccttgatgtgattaagacaaggctaatggttcagggacctgcaaaccagtataatggtatcattgactgtgttcagactattgttagggaagaaggacctcctgctcttttgaagggcattggaccgagagtactgtggataggcattggaggttcaatcttttttggtgtgctggagaggacaaagcgggcgcttgctcagaggcggccttcacctaatcaacactccgacagcccaaagcaggattgaaactacccaagctctaccaatctgaatacctctcttctagactccttggaaagacgaggtgctgaataggcttcctgcaggtagtcctgcagtttttggtatggctagcttagaatggaaagaaaattcagagtaacttcccagttctcacaaataataaagtcattttcctttatttagacgacagataaaagagtcctttgccaaggagatgctgctaatgtactattggtttgccttgtacatgaaaaaccctaaattttctttttagggttcaaaatcaaggaaaggattacttaattctctatataa

SEQ ID NO: 10832 - DNA, 782 bp, Glycine max; identical to SEQ ID NO: 10818

SEQ ID NO: 10833 - DNA, 1443 bp, Trifolium pratense; identical to SEQ ID NO: 10819

SEQ ID NO: 10834 - DNA, 1330 bp, Glycine max
ttttttttttttttttttttagcaaagaagaaaaaaaaatcatccactaaataaaattaactacaaatatttataagtttaaattacaagtcccattttcctaatatatagggacacatcatggatgggtatacattaatagctaaaacaccacaggtaaaacataagtactcaccatgacttaaaacaatggattgattttatcttcccccttatacctttttttttcttgtttttttttttaaaaaaaaaaatttcatggtggcataggtggaggagagggtttaagtactaaagtctcacatcagtaattccacacgtggggcatccccacttcagataaataactctctgaacttccttctcctaagcttggtgacccttttagactttggttaagtggattcctttccatctttgtgatttgattcaaaacagcttttaacatttttctgtcacaagataaagggtctaagcaataacccaaatttggtgctcctccatatgctgtagttgcatggttgagagggaacttaggctccatagtggtcatgtggttgaaaatggggtttgtttggttctgagagaaaatggagaagcagggcacttgctcaaactcatctgcatgggtttgagtttggtcaaaacttatgtaagagtccattaacgcaggaagagttgaagatcccgtgtcctcatagcagctacccatgctaggtttggctaaaacttcactgtttttgtagaacaccctacacaaaacccaatcttccttggaagaagaaattttaggaggtccatgaggtccttcgatacgaaactcatgcatgacccactcagtttttctccctttgggtgcccttccttgatagaacaccaaagtcttcctcatccctacatgggtgcccttgcggaggataggcctgtccttccctgtggccttccaataccctgaggcagtggcacgatttgtgcgtaaccctgttgcatacttacggtctctttgtgtgtagaaataccactccttccctccaacgcatgctgtttcaggaatatcccatggctcacacttgttaaggtcaacatctatcaagagaagggaatcattgtgttgcaccttcttcatcaagtaatcacacacaagctcttcatctcttggatgaaacctgaatcctggtggcagctttgcctctaccatgcttatgttgctcatttttttttttctttcaataaaaaggtgaaggaagataagagatgaagaaaaagagaaagataataataatagagaaaagaagttcaaagttgaagtgagaaattttgtgaggtgtcc

SEQ ID NO: 10835 - DNA, 976 bp, Glycine max
gattcatctcttatcttccttcacctttttattgaaagaaaaaaaaaatgagcaacataagcatggtagaggctaagctgccaccaggattcaggtttcatccaagagatgaagagcttgtgtgtgattacttgatgaagaaggtgcaacacaatgattcccttctcttgatagatgttgaccttaacaagtgtgagccatgggatattcctgaaacagcatgcgttggagggaaggagtggtatttctacacacaaagagaccgtaagtatgcaacagggttacgcacaaatcgtgccactgcctcagggtattggaaggccacagggaaggacaggcctatcctccgcaagggcacccatgtagggatgaggaagactttggtgttctatcaaggaagggcacccaaagggagaaaaactgagtgggtcatgcatgagtttcgtatcgaaggacctcatggacctcctaaaatttcttcttccaaggaagattgggttttgtgtagggtgttctacaaaaacagtgaagttttagccaaacctagcatgggtagctgctatgaggacacgggatcttcaactcttcctgcgttaatggactcttacataagttttgaccaaactcaaacccatgcagatgagtttgagcaagtgccctgcttctccattttctctcagaaccaaacaaaccccattttcaaccacatgaccactatggagcctaagttccctctcaaccatgcaactacaacatatggaggagcaccaaatttgggttattgcttagaccctttatcttgtgacagaaaaatgttaaaagctgttttgaatcaaatcacaaagatggaaaggaatccacttaaccaaagtctaaaagggtcaccaagcttaggagaaggcagttcagagagttatttatctgaagtggggatgccccacgtgtggaattactgatgtgagactttagtacgatc

SEQ ID NO: 10836 - DNA, 973 bp, Glycine max
atatttcacctttattacctttatcgaaggaaaaatgagcaacataagcatggtagaggcaaagctgccaccagggttcaggtttcatccaagagatgaagaacttgtgtgtgattacttgatgaagaaggtggcacacaatgattcccttctcatgataaacgttgaccttaacaagtgtgagccatgggatattcctgaaacagcttgtgtgggagggaaggagtggtatttctatacacaaagagaccgtaagtatgcaacagggctacgcacaaatcgtgccactgcttcagggtattggaaggccacagggaaggacaggtctatcctccgcaagggcacccttgtagggatgaggaagactttggtgttctatcaagggagggcacccaaaggaaataaaactgagtgggtcatgcatgagtttcgaattgaaggacctcatggacctcctaaaatttcttcttccaaggaagattgggttttgtgtagggtgttctacaaaaacagagaagtttcagccaaacctagaatgggtagctgctatgaggacacaggatcttcatctcttcctgcattaatggactcttacataagttttgaccaaactcaaacccatgcagatgagtttgagcaagtgccctgcttctccattttctctcagaaccaaacaagccccattttcaaccacatggccactatggagcctaagttacctgccaaccatgcaactaatgcatatggaggagcaccaaatttgggttattgcttagaccctttatcatgtgacagaaaaatgttaaaagctgttttgaatcagatcacaaagatggaaaggaatccacttaaccaaagcctaaaagggtcaccaagcttaggagaaggaagttcagagagttacttatctgaagtggggatgccccacatgtggaacaattactgatgtgggacttcagtccttaaaccctct

SEQ ID NO: 10837 - DNA, 1206 bp, Phaseolus vulgaris
ctttatccattccaaatcatgagcaacataagcatggtggaggcaaagttgccaccagggttcaggttccatccaagagatgaagagcttgtctgtgattacttgatgaagaagctcacacacaatgattcccttctcatgatagatgttgaccttaacaagtgtgaaccttgggatattcctgaaacagcatgtgtgggagggaaagactggtatttctatacacaaagagaccgtaagtatgcaacagggttacgcacaaatcgtgccactgcctcagggtactggaaggccacagggaaggacagacctatccttcgcaagggcacccttgttggtatgaggaagactttggtgttctatcaaggaagggcacccaaagggagaaaaactgaatgggtcatgcatgagtttcgcatagaaggtccccatggaccccctaaagtttcttcttctaaggaagactgggttttgtgtagagtgttctacaaaagcagagaagtttcagccaaacctagcatgggtagctgctatgaagacacaggctcttcatctcttcctgcattaatggactcttacattagttttgatcaaactcaagctcatgcagatgagtttgagcaagtgccctgcttctccattttctctcagaaccaagcaaaccccattttcaaccacatgactaccatggagcctaaactacctgcaactacatatggaggagcaccaaatttgggttactgtttagaccctttatcctgtgacagaaaagtgttgaaagctgttttgagtcagatcacaaaaatggaaaggaatcctctgaaccaaagtcttaaagggtctacaagctttggagaaggaagctcagagagttacttatctgaagtggggatgcctcacatgtggaacaattactgatgtgggacttcagtccccaatgccaccatgccaaagaaaaattaaaacaataaaaaaaaatgaagatgaaattaatccattgtttgaagtgagtgatggtgagtgcatatgtttttacctgtggtgtttagctattactatgatacacatcctccattatgtgtcccaatatattaggaaaatgggacttgtaattcaaacttataaatatctgtagttaatttctagttagtggatgatttttttttcttgttgctgaaaaaaaaaaaaaaaaaaaaaaaaaaaaaa

SEQ ID NO: 10838 - DNA, 921 bp, Medicago truncatula
atgagcaacataagcatggttgaggcaaagctaccaccagggttcagatttcatcctagagatgaagaacttgtgtgtgattacttgatgaagaaggtgacacatagtgattcctttctcatgattgatgttgaccttaacaagtgtgagccatgggatattcctgaagcagcatgtgtgggagggaaagagtggtatttctacacacaaagagatcgtaaatatgcaacaggactacgaacaaatcgtgcaactgcatcaggttattggaaagcaacaggaaaggacagagctatccttcgtaagggcactcttgttggaatgagaaagactttagtgttctatcaaggaagggcacctaaagggagaaaaactgaatgggttatgcatgagtttcgtattgagggtcctcatggccctcctaaaatttcatcttctaaggaagattgggttttgtgtagggtgttctacaaaaacagagaagttgctacaaaacctccaagcatgggtagttgctatgatgacacaggctcttcatcacttccagcattaatggattcttacataagttttgaccaagctcaattccatacagatgaatatgagcaagtgccctgcttctccatgttttctcaaaaccaaaccaacccaatctacaacaatataacaaccaatatggaaccaaaattacctctagccaacaataacaatgcaagtacatttggaggagcaccttatagcttagaccctttatcatgtgatagaaaagtgttaaaagctgttttgagtcaactatcaaagatggaaagaaaccctattaatgatcaaaacctaaaagggtcatcaccaagcttaggtgaaggaagttctgagagttacttatctgaagtgggtatgccccacatgtggaacaatttctaa

SEQ ID NO: 10839 - DNA, 1206 bp, Phaseolus vulgaris; identical to SEQ ID NO: 10837

SEQ ID NO: 10840 - DNA, 1206 bp, Phaseolus vulgaris; identical to SEQ ID NO: 10837

SEQ ID NO: 10841 - DNA, 973 bp, Glycine max; identical to SEQ ID NO: 10836

SEQ ID NO: 10842 - DNA, 1330 bp, Glycine max; identical to SEQ ID NO: 10834

SEQ ID NO: 10843 - DNA, 3149 bp, Glycine max
gcacaacacaacactgaactcaggctcaggtggttaattccaagtctccatcacgtttctgtttcagttattctcttcgttcgcgacgcggatcactttatctgtttctgaataggttcccgacgtattttgacagaggatggcttcaagattctggacccagggtggaagtgattccgaggaggaggagagtgattatgatgaggaggttgataccacagtgggtgaagcttctggtcaagcagtgacaagcaggtacctgcaggataatgcaagtgacagtgatgactctgatggccaaaagcgcgttgtgaggtctgcaaaagataagcgttttgaggagatggcttccactgtcgaccagatgaagaatgccatgaagatcaatgattgggtgagcttgcaagagagttttgacaagattaacaaacagcttgagaaggtcatgcgtgtcactgagtctgaaagggtccccaatctttacatcaaggctctcgtgatgttggaagatttcttggctcaggctttggctaataaggatgccaagaagaaaatgagcagtagcaatgctaaagccttgaactcaatgaagcagaagctgaagaagaataataagcagtatgaggacttgattaataagtgcagggagaaccctgagagcgaggaggaaaaagaagaagaggagagcgatgaagagtatgacagtgatggtgagattattgatccggatcagcttcaaaaacccgaagcaaaatctgattcggaagcctctcaatatgaagatgaaaagccagatgctggtgaaggtccttgggaccaaaagcttagcaagaaggacaggcttttggatagacagttcatgaaaaaccctagtgagatcacgtgggatgcggttaacaagaagtttaaagaggttgtggctgccaggggaagaaagggaactggtaggtttgaacaggttgagcagctcaccttcttaacaaaagttgctaagacacctgcacagaagctggaaattctgttcagtgtggtttctgctcagtttgatgttaatccgggcctcaatgggcatatgcccatcaatgtatggaaaaaatgtgtacagaacatgctgatcattcttgatattttggtgcagtacccaaacataatggttgatgattccgtggaaccggatgagaatgaaactcagaaaggtgctgaacataatggaacaattcgggtttggggtaacttagttgcttttttagaaagaattgatgtcgagtttttcaagagcctgcagtgcatagatcctcatacgcgtgactatgttgagagacttagggatgagcccacgtttctggttcttgcccagaatgtccaggaatatcttgaaagagttggaaatttcaaagccgcttctaaggttgccttgaggagggttgagctcatttactacaaaccccaagaggtttatgatgccatgagaaaattgactgaattgacagaagatggagataatggaggggaggcaagtgagaaggaatttgaggaatcaaggattcctactgcatttgtagttaccccagaggttgttacacggaaacccaccttccctgagaatagcaggaccctaatggatatattggtatctatgatatacaaatatggagatgagcgaactaaagcacgtgcaatgctctgtgatatatatcatcatgctcttcttgatgagttttcaatagcccgtgatctgcttcttatgagccatttgcaagacagtgttcagcatatggacatttcaacgcagatactttttaacagggccatgtcacagttaggtttatgtgcttttcgggttggactgatttctgaagcacatggctgtctgtctgaactctactctggtggaagggtgaaggagttgctggcacaaggcgtttcacaaagtcgttatcatgagaagactcctgaacaggaaaggttggaaagaagacgacagatgccgtatcatatgcacatcaatctagagctcctagaggcagtacatctcgtatctgctatgctgctggaagtgcccaatatggcagccaatgttcatgatgccaaacggaaggtcattagtaagactttccgtcgcttgcttgaggtaagtgagaaacaaacatttactggtccaccggaaaatgtcagagatcatgttatggctgccacaaggattcttcgcaagggagacttccagaaggcttttgacattattgtgtctcttgatgtatggaaatttgtgagaaatcgagacacggtacttgaaatgctaaaggacaaaatcaaggaggaggcattgaggacatacctctttaccttttcttcatcttatgaatcgttgagcctggatcagctcacaaaattttttgatctctctgtttcgcgcactcatagcattgtcagtaggatgatgatcaatgaggagcttcatgcaagctgggaccagccaactgggtgcattcttttccaagatgtcgaacactccaggctgcaggcattggtattccaattgacagagaaattatctgtccttgcagagagtaatgaaaaagcaacagaggccagggtaggtggtggtggattggatctgcctctaaggcggagagatggccaggactatgctgccgccgctgctgccggcagtggaacagcctctacaggtggtaggtggcaagacctgtccccttctcagccaaggcaaggcagtgggcgtgcagggtatggtggaagaccaatgacattaggccaagcagctgggagtggctattcaaggggacgaggaagaggttcgtatggaggttcagggaggacttctcaaaggggttcagcattgaggggaccccagggcgatggacctgctcgcatggttagccttaagggagttcgtgcttgaataagtttaataataattatcttcagtatacctcagttttgataatttggctataaccgcactatagcattctgattttcatttttgtagccttttattttcttatggattttatctaaatttatgcgtatttgtttattcgttacattggagcttgctttcacctggctttattttgattgaattgttcccttgagtgatgcagatttgccttgctcatttacgtgag

SEQ ID NO: 10844 - DNA, 3098 bp, Glycine max
attcccgacgcatctcataacttttgacaaaggatggcttcaagattctggacccagggtggaagtgattccgaggaggaggagagtgattatgatgaggaggttgataccacggtgggtgaatctggtagtcaagcagtgacaagcaggtacctgcaggataatgcaagtgacagtgatgactctgatggccaaaagcgcattgtgaggtcagcaaaggataaacgtttcgaggagatggcttccactgtcgaccagatgaagaatgccatgaagatcaatgactgggtgagcttgcaagagagttttgacaagattaacaaacagcttgagaaggtcatgcgtgtcactgagtctgagaaggtccccaatctttacatcaaggcactcgtgatgttggaagatttcttggctcaggctttggctaataaggatgccaagaagaaaatgagcagtagcaatgctaaagccttgaactcaatgaagcagaagctgaagaagaataataagcagtatgaggacttgattaataagtgcagggagaaccctgagagcgaggaggaaaaagaagaggagagcgaggaagagtatgacagtgatggtgagattattgatccagatcagcttcaaaaaccagaagcaaaatctgattcggaggcctctcaatatgaagatgaaaagccagatgctggtgaaggtccttgggaccaaaagcttagcaagaaggacaggcttttggatagacagttcatgaaaaaccctagtgagatcacgtgggacgcggttaacaagaagtttaaagaggttgtggctgccaggggaagaaagggaactggtaggttcgaacaggttgagcagctcactttcttaacaaaagttgctaagacacctgcacagaagttggaaattctgttcagtgtggtttctgctcagtttgatgttaatccgggcctcaatgggcatgtgcccataaatgtatggaaaaaatgtgtgcagaacatgctgatcattcttgatattttagtgcagtacccaaatatagtggctgatgatttggttgaaccagacgagaatgaaactcagaaaggtcctgaacataatggaacaattcgggtttggggtaacttagttgcttttttagaaagaattgatgtcgagtttttcaagagcctgcagtgcatagatcctcatacacgtgactatgttgagagacttagggatgagcccacgtttctggttcttgctcagaatgtccaggaatatcttgaaagagttggaaatttcaaagccgcttctaaggtggccttgaggagggttgagctcatttactacaaaccacaagaggtttatgatgccatgagaaaattgactgaattgacagaagatggagataatggaggggaggcaagtgagaaggaatttgaggaatcaagaattcctactgcatttgttgttaccccagaggttgttgcgcggaaacccaccttccctgagaatagcaggaccctaatggatgtattggtatctatgatatacaaatatggagatgagcgaactaaagcacgtgcaatgctctgtgatatatatcatcatgctctacttgatgagttctcaacagcccgtgatctgcttcttatgagccatttgcaagatagtgttcagcatatggacatttcaacgcagatactttttaacagggccatgtcacagttaggtttatgtgcttttcgggttggactgatttctgaagcacatggctgtttgtctgaactctactctggtggaagggtgaaggagttgctggcacaaggcgtgtcacaaagtcgttatcacgagaagactccagaacaggaaaggttggaaagaagacgacagatgccctatcatatgcacatcaatctagagctcctggaggcagtacatcttgtttctgctatgctgctggaagttcccaatatggcagccaatgttcatgatgccaaacggaaggtcattagtaagactttccgtcgcctgcttgaggtaagtgagaaacaaacatttactggtccaccggaaaatgtcagagatcatgttatggctgccacaagggttcttaacaagggagacttccagaaggcttttgacattattgtgtctcttgatgtgtggaaatttgtgagaaatcgagacaccgtacttgaaatgctgaaggacaaaatcaaggaggaggcattgaggacatacctctttaccttctcttcatcttatgaatcgttgagcctggatcaactcacaaaattttttgatctctctgtttgtcgcactcatagcattgtcagtaggatgatgatcaatgaggagcttcatgcaagctgggatcagccaactgggtgcattcttttccaagatgttgaacactccaggcttcaggcattggcattccaattgaccgagaaattatctgtccttgcagagagtaatgaaaaagcagcagaggccagggtaggtggtggtggattggatctgcctctaaggcgtagagatggccaggactatgctgccgccgcggctgccggcagtggtacagcctcttccggtggtaggtggcaagacctgtccctttctcagccaaggcaaggcagtgggcgtgcagggtatggtggaaggccaatggcattgggccaagcagctgggagtggctattcaaggggacgaggaaggggttcgtatggaggttcagggaggactgctcaaaggggttcagcattgaggggaccccagggagatggatctactcgcatggttagccttaagggagttcgtgcctgaataagagttttgataatttggctaacgcactatagcattctagttttcattcttgtaggctttaattttcttacggattttatctttgtttatttgttacattggagcttgctttcattttacacctattttcacctggttttattttgtttgaattgtacccttaagtgatgcatattgaccttgctcatttacgtgagctatcaatgtctttcacacaaacttatctttgtttttctttttgtaatgaaagtaataatttaaagaaatttttcataattttctaa

SEQ ID NO: 10845 - DNA, 3144 bp, Glycine max
agccgccgcttctgtttctttgttctctccttctcttacagagcacacgccgcttgcaaaaccgattcttgacgctactcacgacttttgacagaagatggcttcaagattctggactcagggtggaagtgattccgaggaggaggagagtgattatggtgaggaagatgaacactcggcgggtgaacaagctccgaatcaagacgtgacaagcaagtactttgtggacaatgcaagtgacagtgatgattccgatggccaaaagcgcgttgtgaggtcggcgaaagataagcgattcgaggagatggtatccactgttgaccagatgaagaatgccatcaagatcaatgactgggtgagtttgcaagagagctttgacaagattaacaaacagcttgagaaggtcatgcgtgtcaccgagtctgagaaggttccgaatctgtacatcaaggcgcttgtgatgctggacgatttcttggttcaggctttggctaataaggatgccaagaagaagatgagtagtagcaatgccaaggccttgaactccatgaagcagaagttgaagaagaataataagcagtatgaggagttgattaccaaatgcagggagaatcctgagagtgaggaggaaaaggaagaggaggagagcgaggacgagtatgagagtgatgatattgagccggagcagcttccggaagcaaaatctgattctgaagcctctcagtatgacaatgaaaagcaagatgctggtgatggtccttgggaccaaaagcttagcaagaaggaccggcttttggataaacagtttatgaaagaccctagtgagatcacgtgggacactgtcaacaagaagttcaaagaggttgtggctgctaggggccggaagggcactggcagatttgaacaggttgagcagcttactttcttaacgaaggttgcgaagacagctgcacagaagctggaaattctgttcagtgtggtttctgcccagtttgatgttaatccagggctcaatgggcacatgcccataaatgtatggaaaaaatgtgtgcaaaacatgcttgtcattcttgatattctagtgcagcatccaaacatagtggttgatgattcggtggaaccagatgagaatgagactcagaaaggggttgactataatgggccgattcgggtttggggtaacttggttgctttcttagaaagaattgatgttgaatttttcaagagcttgcagtgcatagatcctcatacccgggactatgttgagagactcagggatgagcccttgtttctggttcttgcccagaatgttcaggaatatcttgaaagagttggaaatttcaaagctgcatctaaggtggccttgaggagggttgagctcatttactacaaaccacaagaggtttatgttgcaatgaaaaaattgactgagctgacagaggatggagataatggagtggaggcaagtgaggagaaaggatttgaggaatcaagaattcccactgcatttgttgctaccccagaggttgtggcccggaagcccaccttccctgagaatagcaggaccataatggatgtattggtatcattgatatacaagtacggcgatgagcgaactaaagcacgtgcaatgctctgtgatatataccaccatgctcttcttgatgaattctcaattgcccgtgatctgctgcttatgagtcatctgcaagatagtgttcaacatatggacatttcaacgcagatactttttaacagagctatgtcacagttgggtttatgtgcttttcgggttggactgatttctgaagcccatggctgcctgtctgaactgtactctggtgggagggtgaaagagttacttgcacaaggtgtgtcacaaagtcgctatcatgagaagactccagaacaggaaaggttggaaagaagacggcaaatgccttatcatatgcacatcaatcttgagctcctggagacagtacatcttgtatctgctatgctgctggaagttcctaatatggcagccaatgttcatgatgcaaaacgcaaactcatatctaagactttccgtcgcttgcttgaggtgagtgacagacaaacattcactggtccaccagaaaatgtaagagatcatgttatggctgccacgaggtttcttagcaagggagacttccagaaggcttttgacattattgtgtctcttgatgtgtggaaatttgtgagaaatcgagacactgtgcttgaaatgcttaaggacaaaatcaaggaggaggcattgaggacatacctctttaccttctcttcatcttatgaatccttgagcctggatcagctcacaaaattttttgatctccctgtttcttgcactcatagcattgtcagtaggatgatgatcaatgaggagcttcatgcaagctgggaccagccaactgggtgcattcttttccaagatgttgaacactctaggctgcaggccttggcattccagttgacagagaaattatctatccttgcagagagtaatgaaagagcaacagaggcaaggataggtggtggtggattggatctgcctctaaggcgcagagatggccaggactatgccgctgccgctgctggtagtggaacagcctcgtcaggtggtagatggcaagacctgtccctttctcagccaaggcaaagcagtgggcgtgcaggatatgttggtggtggtggaaggccaatggcattaggccaagggagtggctattccagggatcgatcgggacgaggatcaggtgctggctatcagagtggacgatatcaggggggttcagcattgaggggaccccatggcgatgtatctacacgcatggttagccttaagggtgttcgtgcttagagaagttcaaaattatcttctgtacgccagttttgataatttgactaaatgcactatagcatttctggttttcatttctgtaacattttacttctggattttgtctaaatttgcattgaaatgtatgatcggagcttgtggattttgtctggatttgttataatcggagcttgctttcattttacaccgatttccccctgggtttattctgtttgaatttgattaaccataacaagacaagtattaaaggtttatacaagtttagg

SEQ ID NO: 10846 - DNA, 2955 bp, Medicago truncatula
atgtgcattatatgcataagacctttgagagttgaggtgaaaactctaaagaaaagtttcaatgtgccagggttcttcagcatccaagacaatcgcacaagaggttttttgttgccgattgtattgctactgtccttttcaagccaaatgacttccagattcttttaccagggtggtgatcacagtgataccgacgatgaacccactgatattgatgatgaacccagtgatactgaacccgctccaacagatccaaacggtaaaagcaaatactacgttgatggtaatgctgatgacagtgacgacgatgatggccaaaagcgtgttgttaaatctgctaaagataagcgttttgatgagatggcttccaccgtcgatcagatcaagaatgccatcaagatcaatgactgggtcagcttgcaagagagctttgacaagatcaacaaacagctcgagaaagttatgcgtgttatcgagtcccaaaagatccccaatctctacatcaaggctcttgtaatgcttgaagatttcctcgctcaggcttctgctaataaggatgccaaaaagaagatgagtcccagcaatgccaaagctttcaactcaatgaagcagaaactgaagaagaacaataagcaatacgaggacttgattatcaaatgcagggagagtcctgagagcgagggggaaaaggatgacgatgatgacgactctgacgactacgactccgatgatgagattattgaacctgatcagctcaggaagccggagcccatatccgattctgaaacttctgagcttggtaatgataggcctggtgatgatggcgatgctccttgggatcaaaagcttagcaagaaagacaggcttttggagaaaatgttcatgaaaaaacctagtgagatcacatgggacactgttaacaagaagttcaaagagattctggaagccaggggcaggaagggaactggaaggtttgaacaggttgagcagcttactttcctaacaaaagttgctaaaacacctgctcagaagctgcaaattcttttcagtgtggtttctgctcagtttgatgttaatccaggactcagtgggcatatgcccataaatgtgtggaaaaagtgtgtgcagaacatgctggtcatcctcgacattctcgtgcagcacccaaacataaaggttgatgattctgtggagctagacgagaatgaaactaagaaaggggatgactatgacggacccattcatgtctggggtaacttagttgctttcttagaaaaaatagatgccgagtttttcaagagcttgcagtgcattgatccccacacacgtgaatatgttgagagactcagggatgagcctcagtttgttgttcttgcacagaatgtccaggaatatcttgaaagcattggagatttcaaagcttcttctaaggtggccttgaagagggttgaactcatttactacaagccacatgaggtttacgaagcaacgagaaaattggctgagatgacagttgagggagataatggagagatgagtgaggagtcaaaaggttttgaggatacaagaattcctgctccatttgttgttaccccggaacttgtggcgcggaaaccaaccttcccggaaaatagcaggaccttaatggatgtgttagtatcactgatatacaaatacggagatgagcgcactaaagcacgcgcaatgctttgtgatatatatcaccatgctcttcttgacgagttcacagtagcccgtgatttgttgcttatgagtcatttgcaagaaaatgttcaccacatggacatttcgacacaaatactttttaacagggctatgtcacagttaggtctatgtgcttttcgggttgggctggtttctgaagcgcatggctgtttgtcggaactttattctggtgggcgtgtgaaagaattgcttgcgcaaggagtttcacagagccgttatcatgaaaagactccagaacaggaaaggttggaaagaagacggcagatgccatatcatatgcatataaatcttgagctcctggaatcagtgcatcttacatctgctatgctgctggaagttccaaacatggcagccaatgttcatgatgctaagcgtaagatcatcagtaagaatttccgccgcttgcttgaggtcagtgagaaacaaacattcaccggtcctcctgaaactgtcagggatcatgttatggctgccacaagggttcttattaatggagatttccagaaggcctttgacattattgcatctcttgaggtttggaaatttgtgaaaaatcgtgacaccgtgctagaaatgctgaaggacaaaatcaaggaggaggcgcttaggacatacctatttactttctcttcatcatatgattctttgagtgtggatcagctcacaaattttttcgatctctctcttcctcgtgttcatagtattgtcagtaggatgatgatcaatgaggagcttcatgcaagctgggatcagccaactgggtgcattattttcagaaatgttgaacactcaagggtgcaggctttggcattccagttgactgagaaattatctatccttgcagagagtaatgaaagagctacagaagcaaggttaggcggtggtgggttggatctgcctccaaggcggagagatgggcaggattatgccgctgcagctgctggcggtggcagtggaacgtcttcaggtggcaggtggcaagacttgtcctattctcaaacaaggcaaggcagtggacgcacgggatacggtggaggaagggcattatcgttcagtcaagctggtgggagtggcggctattctagaggacggggaacgggtggaggcggctatcagaattcagggaggactcaagggggttcaacattgaggggaccccacggagatacttcaacccgcatggttagccttaggggagttcgtgcttga

SEQ ID NO: 10847 - DNA, 4457 bp, Medicago truncatula
tccaacagatccaaacggtaaaagcaaatactacgttgatggtaatgctgatgacagtgacgacgatgatggccaaaagcgtgttgttaaatctgctaaagataagcgttttgatgagatggcttccaccgtcgatcagatcaagaatgccatcaagatcaatgactgggtcagcttgcaagagagctttgacaagatcaacaaacagctcgagaaagttatgcgtgttatcgagtcccaaaagatccccaatctctacatcaaggctcttgtaatgcttgaagatttcctcgctcaggcttctgctaataaggatgccaaaaagaagatgagtcccagcaatgccaaagctttcaactcaatgaagcagaaactgaagaagaacaataagcaatacgaggacttgattatcaaatgcagggagagtcctgagagcgagggggaaaaggatgacgatgatgacgactctgacgactacgactccgatgatgagattattgaacctgatcagctcaggaagccggagcccatatccgattctgaaacttctgagcttggtaatgataggcctggtgatgatggcgatgctccttgggatcaaaagcttagcaagaaagacaggcttttggagaaaatgttcatgaaaaaacctagtgagatcacatgggacactgttaacaagaagttcaaagagattctggaagccaggggcaggaagggaactggaaggtttgaacaggttgagcagcttactttcctaacaaaagttgctaaaacacctgctcagaagctgcaaattcttttcagtgtggtttctgctcagtttgatgttaatccaggactcagtgggcatatgcccataaatgtgtggaaaaagtgtgtgcagaacatgctggtcatcctcgacattctcgtgcagcacccaaacataaaggttgatgattctgtggagctagacgagaatgaaactaagaaaggggatgactatgacggacccattcatgtctggggtaacttagttgctttcttagaaaaaatagatgccgagtttttcaagagcttgcagtgcattgatccccacacacgtgaatatgttgagagactcagggatgagcctcagtttgttgttcttgcacagaatgtccaggaatatcttgaaagcattggagatttcaaagcttcttctaaggtggccttgaagagggttgaactcatttactacaagccacatgaggtttacgaagcaacgagaaaattggctgagatgacagttgagggagataatggagagatgagtgaggagtcaaaaggttttgaggatacaagaattcctgctccatttgttgttaccccggaacttgtggcgcggaaaccaaccttcccggaaaatagcaggaccttaatggatgtgttagtatcactgatatacaaatacggagatgagcgcactaaagcacgcgcaatgctttgtgatatatatcaccatgctcttcttgacgagttcacagtagcccgtgatttgttgcttatgagtcatttgcaagaaaatgttcaccacatggacatttcgacacaaatactttttaacagggctatgtcacagttaggtctatgtgcttttcgggttgggctggtttctgaagcgcatggctgtttgtcggaactttattctggtgggcgtgtgaaagaattgcttgcgcaaggagtttcacagagccgttatcatgaaaagactccagaacaggtactaaatcccagcttttttttctttctcaaatagatatctaagtgcatacaggtgcttaaattatatctgatgttcagtaatataattataatatatccaacgtcactgctctaaagaaatctctgtctgatttttcatagaaatagaaaaaataaaaggtgatctggattgcagtttagttgccttatttatctttacattgacattgagtggggattaatcaattttgaggtataatattattgctcaactgggctacttcaaacagaaattaaatttgattgttggctgcatatttctccgttctctttgctgctgcatttcatttgaatcataatcttcaattgaatcacatatatcttttgtttttgtttctaaggttatttttttatttttttattttttttatcttgttactggctctgtggtcaaacgcggccgctcccggcgctaccgcggccaaaaacaaggagccgcgtcacaacgctaccgagtcatgcgtttgtggaaagcgggtcaatagcgggtttcgcggacgcgtttctgtgaagcgaagcgggtcgaaatcgggtcaaagcgggcgcgttttgcttcgtgtgtaaaatctcgtggtaaaattccatatctgttcttgattggattgggtcattgggctaggcccaacgatgacattagcttacagattttaaataagtaaataacaatggtgttaatactaaatatgaatacaaaataaaattttcatttatattaataaattaataaatatattgttaaaaaataataataaatatatgcttcatttatattgatagcaattattaaatacattttattatagtttttaatactaaaaaaaaaaattaatcatctttaatttttcatttatattaatactaaacatattttttcatactttcttagtccttgttattatatatatactaatgattctattcaattatgtctaagacttgtggcttttatttcaaattatggatactacataaatttaaagtaatatgtaaggtattttagcatattttttatgtaaggtattttagtatattttttgtatagtatggtattttaatattaaatatattagtgtccgcgttatgaaatagcgcctgcataccgtgccgtgtcaatttttggggtggccgcgccgcttttccgctttgacaacagaggttactggggggctattttgtttacaaatattgtgtcagagtctccctgttgtataaaccatagcaaattaagggaataggaaaggatagtgttaaactaataaagcatgagtgggaagcgtttccttttcttaccccactcgattcaggattttttatttttgccactggtagttcagttttgctaacaaagtgtgcctgaattttagcataactgaaattgatgagggaacttttgtgagatttttagataaccatatagtgtaatcagagcatggcatttttttcttagctgagtacattttattagatatcacagaaagtagttttcctgtcttggtaggttcaaacctcaaaattttggattacgatttttatgatgatgttaataccactaaaacaataatgtctcaaactttatattggattttttgaaatcctaatcggcaacttttgccgtatttctatcggctcagtttctttcagctgccatgaaaatgtaagggtttaatctttaacatactgttaactattctttaattatctttcaggaaaggttggaaagaagacggcagatgccatatcatatgcatataaatcttgagctcctggaatcagtgcatcttacatctgctatgctgctggaagttccaaacatggcagccaatgttcatgatgctaagcgtaagatcatcagtaagaatttccgccgcttgcttgaggtcagtgagaaacaaacattcaccggtcctcctgaaactgtcagggatcatgttatggctgccacaagggttcttattaatggagatttccagaaggcctttgacattattgcatctcttgaggtttggaaatttgtgaaaaatcgtgacaccgtgctagaaatgctgaaggacaaaatcaaggaggaggcgcttaggacatacctatttactttctcttcatcatatgattctttgagtgtggatcagctcacaaattttttcgatctctctcttcctcgtgttcatagtattgtcagtaggatgatgatcaatgaggagcttcatgcaagctgggatcagccaactgggtgcattattttcagaaatgttgaacactcaagggtgcaggctttggcattccagttgactgagaaattatctatccttgcagagagtaatgaaagagctacagaagcaaggttaggcggtggtgggttggatctgcctccaaggcggagagatgggcaggattatgccgctgcagctgctggcggtggcagtggaacgtcttcaggtggcaggtggcaagacttgtcctattctcaaacaaggcaaggcagtggacgcacgggatacggtggaggaagggcattatcgttcagtcaagctggtgggagtggcggctattctagaggacggggaacgggtggaggcggctatcagaattcagggaggactcaagggggttcaacattgaggggaccccacggagatacttcaacccgcatggttagccttaggggagttcgtgct

SEQ ID NO: 10848 - DNA, 2835 bp, Medicago truncatula
atggcttcgagattctggacacagggtaatagcgatagtgacgatgacgaacccactgatattgatgaacctagtagcgatactgaacccgttgatgaacccacaaacaatacagccaatagatacattgctggtattcatcctgatgacagtgacgatgatgatggccaaaagcgtgttgttaagtctgctaaagataagcgttttgatgagatggcttccactgtcgatcagatcaagaatgccatcaagatcaatgactgggtcagcttgcaagagacctttgataagatcaacaaacagctcgacaaagttatgcgtgttatagagtcccaaaagatccccaatctctacatcaaggctcttgtaatgcttgaagatttcctcgctcaggcttcttctaataaggatgccaaaaagaagatgagtcccaccaatgccaaagccttcaactcaatgaagcaaaaattgaagaagaacaataagcaatacgaggacttgattatcaaattcagggagactcctcagagtgaggaggaaaagtttgaagacgatgaggactctgaccaatatgggtccgatgatgatgagatcattgaacctgatcagctcaagaagccggagcccgtatcggattctgaaacttctgagcttggtaatgacaggcctggtgatgatgacgatgccccttgggatcaaaagcttagaaagaaagataggcttttggagaaaatgttcatgaaaaagcctagtgagatcacatgggatactgttaacaacaagttcaaagagattctggaagccaggggcaggaagggaactggaaggtttgaacaggttgagcagtttaccttcctaacaaaagttgctaaaacacctgcacagaagctgcaaattcttttcagtgtggtttctgctcagtttgatgttaatcctggcctcagtgggcatatgcccataaatgtgtggaaaaagtgcgtgcagaatatgctggtcattcttgatattctcgtgcagcacccaaacataaaggttgatgattctgtggaactagatgagaatgaatctaagaaaggggatgactatgacggacccattcatgtctggggcaacttagttgctttcttagaaaaaatagatgccgaatttttcaagagcttgcagtgcatagatccccacacacgtgaatatgttgagagactcagggatgagcctctgtttgttgttcttgcacagaatgtccaggaatatcttgaaagcatcggagatttcaaagcttcttctaaggtggccttgaagagggttgaactcatttactacaaaccacatgaggtttatgaagcaacgagaaaattggctgagctgacggtagatggagataacggagaggaggtgagtgaggagtcaaaaggttttgtggatacaagaatcattgctccatttgttgttaccccagagcttgtggcccggaaacccactttcccggagaatagcaggaccttaatggatgtgttggtatcactaatatacaaatacggagatgagcgcactaaagcacgcgcaatgctttgtgatatatatcaccatgctcttctagatgagtttgcagttgcccgtgatctgttgcttatgagtcatttgcaagaaaatgttcaccacatggacatttcgacacagatactctttaacagggctatgtcacagttaggtctatgtgcttttcgtgttggcctggtttctgaagcacatggctgtttgtctgaactttattctggtggacgggtgaaagaactgcttgcacaaggagtttcacagaaccgttatcatgaaaagactccagaacaggaaaggttggaaagaagacggcagatgccatatcatatgcatataaatcttgagctcctggaatcagtgcatcttacatctgctatgctgctggaagttcccaacatggcagccaatgttcatgatgctaagcgtaagatcatcagtaagaatttccgccgcttgcttgaggtcagtgagaaacaaacattcaccggtcctcctgaaactgtcagggatcatgttatggctgccacaagggttcttattaatggcgatttccagaaggcctttgacattattgcatctcttgaggtgtggaaatttgtgaaaaatcgtgacaccgtgctagaaatgctgaaggacaaaatcaaggaggaggcgcttaggacatacctatttaccttctcttcatcatatgattctttgagcgtggatcagctcacaaattttttcgatctctctcttcctcgtgctcatagtattgtcagtaggatgatgatcaatgaggagcttcatgcaagctgggatcagccaactgggtgcattattttcagaaatgttgaactctcaagggtgcaggctttggcattccagttgactgagaaattatctatccttgcagagagtaatgaaagagcttcagaagcaagattaggtggtggtgggttggatctgcctccaaggcggagagatgggcaggattatgccgctgcagctgctggcggtggtggtggaacgtcttcaggtggcaggtggcaagacttgtcctattctcaaacaagacaaggcagtggacgcgcaggatatggtggaagggcattgtcattcaatcaagctggtgggagtggcggctattctagaggacggggaatgggtggaggcggctatcagaattcaagtaggactcaagggggttcagcgctgaggggaccccatggagatgtatctacccgcatggttagccttaggggagttcgtgcttaacgttgcatttacttagtactacaa

SEQ ID NO: 10849 - DNA, 3183 bp, Vitis vinifera
atgtcatcacgtttttggactgctcagggtgacagtgacactgaggaggaggagagtgattatgaggatggagttgaaaggggaggagcagcaggtgagtctgcaccacatgctggcagcagatacctacaggctaatgctagtgatagtgatgattctgatggtcaaaagcgtgttgtgcgatctgctaaagacaagcggtttgaggagatgtctgctactgttgatcagatgaagaatgctatgaagatcaatgactgggtcagcctacaagagagctttgacaaaataaataagcagcttgagaaagtcatgcgggttacagaatctgataaagttcctaccctttacattaaggcgcttgtgatgttggaggactttttgagtcaggctttggcaaataaggatgccaagaagaagatgagtagtagtaatgccaaggccctgaactcaatgaaacagaaattgaagaagaacaataagcagtatgaagatctgattaataagtatagggaacatcctgagagcgaagaagaaggtgatgaggatgaggagatggaggaggatgaggattctggctcagagtttgaggaggacccttcaaaaattgcaatgagatcagattctgaagaagacgaggaggatggagaggatagagaagatagtgctgctgaagctggtgggggttgggagaaaaagatgagcaagaaagataagctaatggacaagcagttcatgaaggacccaagtgagattacatgggatacggttaacaagaaattcaaggagattgtggctgttcgtggtaggaaaggaactggaaggattgagcaggtcgaacagcttactttcttgacaagggttgccaagacccctgcccagaagctggagatccttttcagtgtcgtttctgctcagtttgatgttaatccaagtcttagtgggcacatgccaataaatgtgtggaagaagtgtgtgcagaatatgcttgttatacttgacattctagttcagcattcaaacattttggtggatgatgttgttgagcctgaagagaatgaaacccaaaaaggagcagactataaggggacaattcgagtttggggaaatttggttgccttccttgagaggatagatgtggagttctttaagagcttgcagtgcattgatccacacactcgcgagtatgttgaaagactgagggatgagcctttgtttcttgtgcttgcccaaaatgtccaggattatttagagcgagtcggggatttcaaggctgcttcaaaggtagctctgaggcgggttgagctcatctattataaaccacaggaggtgtatgacgcaatgaaaaatttggctgaacaaacagaagatacagagaacggagaatcagaggcaggtgaggagcccagagttgaagaaagtaggggtccacctgcatttgttgttactcctgaggtggtgcctcgaaaacccacatttccagagaatagtaggactctgatggatattctagtttccctcatatacaatcatggggatgaacggactaaggctcgggctatgctctgtgacatttaccaccatgctatcctggatgagttttcaactgcccgtgatctgttgctgatgagtcacttgcaggacaatgttcagcatatggacatttcaacgcagatcctttttaacagggccatggcacagcttggactgtgtgcatttagggttggactgattgctgaaggacatggttgcctgtctgaactatattcaggagggagagtaaaggaattgctcgcacaaggtgtttcacaaagtcggtaccacgagaagactccagagcaggagaggattgaaaggagacgacagatgccttaccacatgcacataaatcttgagctcctggagggagtccatctaatatgtgccatgctcctggaggtcccaaacatggctgccaatacgcacgatgccaagcgcaaggttataagtaaaacatttcggcggttgcttgaggtgagtgaaaggcagacattcactggcccacctgaaaatgttagagaccatgtaatggctgccaccagggcccttagcaagggggacttccagaaagcctttgatgttatcaagtcccttgatttttggaagctcctcaggaaccgtgaggatgtccttgagatgctgagggcgaagataaaggaagaggctctgaggacctacctttttacctactcattatcctataatactctgagcttggaccagcttaccaaaatgtttgacctttcagaaactctgacccacagtatcatcagtaagatgatggtcatggaagagttgcatgcaagctgggaccagcccacccgttgcattgttttccatgatgtggagcacacaaggctgcaggccttgtcattccagctgacagacaagctgacaattcttgcagaaaacaacgagcgggcatatgaggctaaaataggtggtggtgggttggatctgccactaaggcggagggatggccaggattatgctggtgcagcttctgttggtggtaaatggcaggacaacttttctttcagtcagggaaggcaaggtggtgtgcgcactggatatggtgtgggtgggaggccattaggtcctggctcttctgcaggcaccttttcaagggacagaggtggtcagtcacgaggaacaggaggctattcagggggctaccagagcactcggtatcaagatgctgcatatgggaggactgcttatcagactagttcagctgtaaggggatcccagatggatacttcaacccgcatggtcagtctgaacaggggtgttcgtgcttagtgtagtaaatcaaaagttgaattggacacagttacgtggtgtggttttggctcttcaaaagcaggttctgctccattggatctgattttgaattttttctagtaagctataaaatttgttaaggcacaagtttatttatatctttttaattatgtacttgcggcaattaaaagaccgggaaatgcagcgagtagcttctaatgttggtttacttatattcagattggtgcaagaactcatttaactttgtgatttgtgaatttggcttctatctttttctatgaagtcattgctcctcacatttgcactgaataagtggaatcagacaatacttccttgcta

SEQ ID NO: 10850 - DNA, 3264 bp, Medicago truncatula
atggtctgttcaaggtggaccaaaccccaacacggtgttattaaatgtaatgttgatcgtgccttgtttaacaacaattcactcatgggttatggtatgtgttttagagactcaatgggtcaatttttatttgggaaatcaaattggttgcattatagagttaccactatggaagctgaagctattggactcctagaggccatcaaaacagctatagagaagggaatgcactatgtggagtttgaaactgactgcaaacctgtagcagatgcactatccctgcctacagcaccccataatgaattagaccttatagctaacaatagcgattatgtggtatcgtttgttccgaggcaagcaaataaagtagctcatagcattgctagagcctctttatctaatcctagcgggtgggaaaaaaaaaagagtggggttcttcagcatccatcttccagacaagacaagacaatcacacaagagggtggtgatcaaagtgataccgacgatgaacccactgatattgatgacgaacccagtgatactgaacccgctccaacagatccaaacggtaaaagcaaatacttggctggtggtaatgctgatgacagcgacgatgatgatggccaaaagcgtgttgttaagtctgctaaagataagcgttttgatgagatggcttccactgttgatcagatcaagaatgctatcaagatcaatgactgggtcagcttgcaagagagctttgacaagatcaacaaacagctcgagaaagttatgcgtgttatcgagtcccaaaagatccccaatctctacatcaaggcgctcgtaatgcttgaagatgtcctcgctcaggcttctgctaataaggatgccaaaaagaagatgagtcccagcaatgccaaagccttcaactcaatgaagcaaaaattaaagaagaacaataagcaatacgaggacttgattatcaaatgcagggagagtcctgagagtgagggcgaaaaggatgaagacgatgaagactctgacgaatatgagtccgatgatgagatgattgaacctgatcagctcaggaagccggagcctgtatcggattctgaaacttctgagcttggtaatgacaggcctggtgatgatggcgatgctccttgggatcaaaaacttagcaagaaagacaggcttttggaaaaaatgttcatgaaaaagcctagtgagatcacatgggacacggttaacaagaagttcaaagagattctggaagccaggggcaggaagggaactggaaggtttgaacaggttgagcagcttaccttcctaacaaaagttgctaaaacacctgctcagaagctgcaaattcttttcagtgtggtttctgctcagtttgatgttaatccaggcctcagtggccatatgcccataagtgtgtggaaaaagtgtgtgcagaacatgctggtcattctcgacattctcgtgcagcacccaaacataaaggttgatgattctgtggagctagacgagaatgaaactaagaaaggggatgactataacggacccattaatgtctggggcaacttagttgctttcttagaaaaaatagatgccgagtttttcaagagcttgcagtgcattgatccccacacacgggaatatgttgagagactcagggatgagcctcagtttgttgttcttgcacagaatgtccaggaatatcttgaaagcattggagatttcaaagcttcttctaaggtagccttgaagagggttgaactcatttactacaaaccacatgaggtttacgaagcaacgagaaaattggctgagatgacagtagagggagataatggagagatgagtgaggagccaaaaggttttgaggatacaagaattcctgctccgtttgttgttaccctggaacttgtggcgcggaaacccaccttcccggaaaatagcaggaccttaatggatgtgttagtatcactgatatataaatacggagatgagcgcactaaagcacgcgcaatgctttgtgatatatatcaccatgctcttcttgatgagtttgcagtagcccgtgatctgttgcttatgagtcatttgcaagaaaatgttcaccacatggacatttcgacacaaatactttttaacagggctatgtcacagttaggtctttgtgcttttcgggctgggctggtttctgaagcgcatggctgtttgtctgaactttattctggtggacgggtgaaggaattgcttgcgcaaggagtttcacagagccgttatcatgaaaagaccccagaacaggaaaggttggaaagaagacggcagatgccatatcatatgcatataaatcttgagctcctggaatcagtgcatcttacatctgctatgctgctggaagttcccaacatggcagccaatgttcatgatgcaaagcgtaagatcatcagtaagaatttccgacgcttgcttgaggtcagcgagaaacaaacattcaccggtcctcctgaaactgtcagggatcatgttatggctgccacaagggttcttattaatggagatttccagaaggcctttgacattattgcatctcttgacgtctggaaatttgtgaaaaatcgagacgccgtgctagaaatgcttaaggacaaaatcaaggaagaggcacttaggacatacctatttaccttctcttcatcatatgattctttgagcgtggttcagctcacaaattttttcgatctctctcttcctcgtgttcatagtattgtcagtaggatgatggtcaatgaggagcttcatgcaagctgggatcaaccaactgggtgcattattttccgaaatgttgaacactcaagggtgcaggctttggcattccagttgactgagaaattatctatccttgcagagagtaatgaaagagctacagaagcaaggttaggcggcggtgggttggatctgcctccaaggcggagagatgggcaggattatgccgctgcagctgctggcggtggtagtggaacgtcttcaggtggcaggtggcaagacttgtcctattctcaaacaaggcaaggcagtggacgtacgggatacggtggaggaagagcattatcgttcagtcaagctggtgggagtggtggctattctagaggacggggaacgggtggaggcggctatcagaattcagggaggactcaagggggttcagcattgaggggaccccacggagatacttctacccgcatggttagccttaggggagttcgtgcttga

SEQ ID NO: 10851 - DNA, 4871 bp, Vitis vinifera
ggagttgaaaggggaggagcagcaggtgagtctgcaccacatgctggcagcagatacctacaggctaatgctagtgatagtgatgattctgatggtcaaaagcgtgttgtgcgatctgctaaagacaagcggtttgaggagatgtctgctactgttgatcagatgaagaatgctatgaagatcaatgactgggtcagcctacaagagagctttgacaaaataaataagcagcttgagaaagtcatgcgggttacagaatctgataaagttcctaccctttacattaaggcgcttgtgatgttggaggactttttgagtcaggctttggcaaataaggatgccaagaagaagatgagtagtagtaatgccaaggccctgaactcaatgaaacagaaattgaagaagaacaataagcagtatgaagatctgattaataagtatagggaacatcctgagagcgaagaagaaggtgatgaggatgaggagatggaggaggatgaggattctggctcagagtttgaggaggacccttcaaaaattgcaatgagatcagattctgaagaagacgaggaggatggagaggatagagaagatagtgctgctgaagctggtgggggttgggagaaaaagatgagcaagaaagataagctaatggacaagcagttcatgaaggacccaagtgagattacatgggatacggttaacaagaaattcaaggagattgtggctgttcgtggtaggaaaggaactggaaggattgagcaggtcgaacagcttactttcttgacaagggttgccaagacccctgcccaaaagctggagatccttttcagtgtcgtttctgctcagtttgatgttaatccaagtcttgagtgggcacatgccaataaatgtgtggaagaagtgtgtgcagaatatgcttgttatacttgacattctagttcagcattcaaacattttggtggatgatgttgttgagcctgaagagaatgaaacccaaaaaggagcagactataaggggacaattcgagtttggggaaatttggttgccttccttgagaggatagatgtggagttctttaagagcttgcagtgcattgatccacacactcgcgagtatgttgaaagactgagggatgagcctttgtttcttgtgcttgcccaaaatgtccaggattatttagagcgagtcggggatttcaaggctgcttcaaaggtagctctgaggcgggttgagctcatctattataaaccacaggaggtgtatgacgcaatgaaaaatttggctgaacaaacagaagatacagagaacggagaatcagaggcaggtgaggagcccagagttgaagaaagtaggggtccacctgcatttgttgttactcctgaggtggtgcctcgaaaacccacatttccagagaatagtaggactctgatggatattctagtttccctcatatacaatcatggggatgaacggactaaggctcgggctatgctctgtgacatttaccaccatgctatcctggatgagttttcaactgcccgtgatctgttgctgatgagtcacttgcaggacaatgttcagcatatggacatttcaacgcagatcctttttaacagggccatggcacagcttggactgtgtgcatttagggttggactgattgctgaaggacatggttgcctgtctgaactatattcaggagggagagtaaaggaattgctcgcacaaggtgtttcacaaagtcggtaccacgagaagactccagagcaggtgctcatatctgttttaagttaaattttacagggatatctttctagtccattcgtttctagtccattatgagtttcttctagttaaggaatggcatgaattttgtgatgtttctgtgattttgcawttgtgtggaaagaaagaactggacatgtttttagctgcattagtggtaaaggatatggataaaaaaatatggaatcatgtcaataattatggagaaaattcatgtatgcttagtgtgtacgtagagggtgttttttttttttggttagattttgtttccttttatgttgttttcccttcattttgtttgaatttttattccataaatatcatgcattttggaatctgtatgtgggattccataatatcaatgattccatgatacagttggaaatcctgctggagtttatttattttgattcagctggtacatttttctgttgtgttgggttgggctattacaatttgctggctgtgggcttagatttttgtgtggggttgccctgctgattattttggccggtggttgtagactttttactatatttgtttttttgtgttgagccactttttgttgtaggggttttgcatttgaattcagggatctgtggaacttttaactgtgtctcacactattgttatatatatatttattgttaatttaggtacaatgtatwtttgtccatggattcacttttgtaaataattgtttttatcaggagaggattgaaaggagacgacagatgccttaccacatgcacataaatcttgagctcctggagggagtccatctaatatgtgccatgctcctggaggtcccaaacatggctgccaatacycacgatgccaagcgcaaggttataagtaaaacatttcggcggttgcttgaggtgagtgaaaggcagacattcactggcccacctgaaaatgttagagaccatgtaatggctgccaccagggcccttagcaagggggacttccagaaagcctttgatgttatcaagtcccttgatttttggaagctcctcaggaaccgtgaggatgtccttgagatgctgagggcgaagataaaggaagaggctctgaggacctacctttttacctactcattatcctataatactctgagcttggaccagcttaccaaaatgtttgacctttcagaaactctgacccacagtatcatcagtaagatgatggtcatggaagagttgcatgcaagctgggaccagcccacccgttgcattgttttccatgatgtggagcacacaaggctgcaggccttgtcattccagctgacagacaagctgacaattcttgcagaaaacaacgagcgggcatatgaggctaaaataggtggtggtgggttggatctgccactaaggcggagggatggccaggattatgctggtgcagcttctgttggtggtaaatggcaggacaacttttctttcagtcagggaaggcaaggtggtgtgcgcactggatatggtgtgggtgggaggccattaggtcctggctcttctgcaggcaccttttcaagggacagaggtggtcagtcacgaggaacaggaggctattcagggggctaccagagcactcggtatcaagatgctgcatatgggaggactgcttatcagactagttcagctgtaaggggatcccagatggatacttcaacccgcatggtcagtctgaacaggggtgttgcttatcgtgcttagtgtagtaaatcaaaagttgaattggacacagttacgtggtgtggttttggctcttcaaaagcaggttctgctccattggatctgattttgaattttttctagtaagctataaaatttgttaaggcacaagtttatttatatctttttaattatgtacttgcggcaattaaaagaccgggaaatgcagcgagtagcttctaatgttggtttacttatattcagattggtgcaagaactcatttaactttgtgatttgtgaatttggcttctatctttttctatgaagtcattgctcctcacatttgcactgaataagtggaatcagycaatacttccttgctacatcatccgtcttggtgtagcctggacaatgttcctwgtgggtagttgaagttgagaaaaccctatgcaaattagtggctgttttttaagttgatttattttttcaactgctagtgttttagcacctaagttctggacctcatcaggtttttttataactgactacaccacagaaactgttcaatattttctctgtgaaatgggttgcagaaaaattagkttcaaaatttcaactttyctgacttgagccccatgagctccaaactgtcctttccggaaatatgacttgcagagaacagatyatctcccttgggacctactagtgattctcacctcttctaaaaarattayaacatmcatrggaaaaactgcttacaagaaagaaacgattttgtaactaagtcaacatgggagattggwwggcaaggaaaaaatgaaccaaaaaaaaaagaaaaaagtwaaggcatgcagcctctcaaaaggatacattcgttaaacaatccagaattttgaatgacaaattggtatataggattctcttaatgatcagtagacagcacagaagaatgttcataacgatacagtctcttctgtgaagaataaaaaaatcaatatgatcataaacatgtgagtaagatgcatactatagctgtcaaacacatgtatgaaatttgaatgaaataaaaaaggaaaacrccaacamttcctatctatacttttgcttctcttttaatgaatctagttttcttaaaatgcatgcataattggtgggcgggaatttcagctttcggcttcaactggaatttgtgcractgaatctgaagtttctgtgttcttctcgctcactgttttggggacagttarttctaatggcccaagcttcgattcaagattcttgactgcagatgttaaagatctgacatttttagcttctgctagctcactgggagacgacaactgccacaacacatcaaaagatatacactcttcgttagatgttaccaagcaattggtttcagggtatt

SEQ ID NO: 10852 - DNA, 2635 bp, Glycine max
atggcggaatcatttctcttcagcattgcagagtcactcctttcaaagcttgcttcgcaggcttatgaggaagcttctcgtgtgctgggtttgtacgaccatctcaaaaaccttaaagacaccctatcattagtccaggctgtcctgttggacgctgatcaaaagcaggagaagaaccatgagctgcgggaatggctgaggcagctcaaacgtgtcttctttgatgccgaaaatgttctagatgaatttgaatgccaaacactgcaaaaccaagttatcaaagctcatggtaccaccaaagacaagatggctcaacaaatcaaagatatcagcatgagactagacaaggttgcagctgataggcataagtttggccttcaaccaattgatgttgacacacgtgttgtgcaccggagagagatgagagagatgacatactcccatgtgaacgattcagatgtgataggaagggaacaagacaaaggagagatcatagagctcttgatgcagcagaatcccaatgatgatcataaaagtctctctgttatccccatagtggggatgggaggcttgggaaagaccacacttgcaaagtttgtgttcaatgacaaggggataaataagtgtttcccattgaagatgtgggtgtgtgtttctgatgactttgaccttaagcaactcattatcaaaatcatcaattctgctgatgattctgtttttcttgctgatgctcctgatcgccaaaagaatttaaacaaaatggatctggagcaactgcaaaatcaattgagaaacaaacttgctgatcaaaagttcctactcgtcttggacgacgtatggaatgaagaccgtgttaaatgggttggcttgaggaatttaattcatgtaggtgctgctgcaggtagtaagattctagttactacgcgtagtcattccattgcttccatgatgggcacggcttcctctcatattttacaaggtctttctctggaggattcatggtctttgtttgtcagatgggcgtttaatgaaggagaagaggaaaactatcctcagttgataaatattggcagagaaattgtgaaaaaatgcagaggggttcctttggcggtgagaacactagggagtttactattctccaaatttgaggcaaatcagtgggaagatgcgagagacaatgaaatttggaatttgccacagaaaaaagatgacattttaccagccctcaaattgagttacgatctcatgccgtcctatttgaggcaatgctttgctctattttctctttaccctaaggattacaactttactagttatggtgtgattcacctttggggggcactcggattccttgcatcaccaaaaaagaatagggctcaagatgatattgcgattcagtatttgtgggaactattctcaagatctcttcttcaagattttgtaagccatggcacctattatacatttcacatacatgatttggtgcatgatcttgctctgttcgttgcaaaagatgattgtctacttgtaaattcccacattcaaagtatacctgagaacattcagcatctatcttttgttgaaaaagattttcatggcaaatcactcaccacaaaagcagtaggtgtgagaaccataatttatcctggtgctggagcggaggcaaactttgaagctaataaatacttgaggattttgcatttaacgcattctacctttgaaactttgcctcctttcattgggaagttaaaacatttaagatgtcttaatcttcgcaaaaataagaaaattaagagactccctgattccatttgtaagctccaaaatttgcagtttttgttcctgaaggggtgcactgagcttgaaaccctgcccaaaggtttaagaaaattgataagcctctatcatttcgagataaccacaaagcaagctgttttacctgagaacgagatagcaaacttgagttatcttcaatatttgacaattgcatattgtgataatgtggagtctttattctcagggatagagtttcctgttcttaaactactgtctgtttggtgctgtaagagactaaagtctttgccacttgacagtaaacattttcctgcattagagactttgcatgttataaaatgtgacaagttggaattgttcaagggccatggagatcaaaacttcaacttaaagttaaaagaagtaacatttgtcataatgccacagctagagattctacctcattgggttcaaggatgtgctaacacattactatccttgcatctatcatactgcctcaatcttgaggtgcttcctgattggctgccaatgctaactaatctaagagaactgaatattgatttttgtctaaagctgcggtctcttccagatggcatgcatcgcctcactgcccttgaacatttgcgaatcaaagattgtgatgaattatgcataaaatacaagccgcaagttggagagtgttgggaccaaatatcacacatcaagcagattacgattgatgaacaaaaaatctggaagaagaggtagtggaaaagaggaagaagaattcgaggaagttgaaagctttaataaatgtcgaaggccttttcttttttgtggtttctgtaatgcagattgttgt

SEQ ID NO: 10853 - DNA, 1159 bp, Glycine max
tatctgataattacaataatgggttccctccctcacgtagtagaggattgcatgggcttcctccaactctatagcgacggttccattttccgttccaacggcatagaattcaaagtttcacccattcaagacaactccataacctataaggattatctctttgacaaaagattcaacctttctcttcgcttctacaagccccaacaacaacacatagcactcagcaataagaaggtccctattgtgattttccttcacggtggaggcttttgcttcggttcgcgcacctggccccatattcacaactgttgcatgcgcctcgcgtcggggctccaagcggcggtggtttcgccggactaccgtctcgcgccggagcaccgtcttcctgctgcggtggacgacgccgtggaggcggtgaggtggctccagaggcagggcctgagcttgagggaggacgcgtggttgagtgggggcgttgactttgaccgcgtcttcgtcgtgggtgactcgtctggcgggaacattgcgcaccacctggcagttcggttggggtccggttcgagagagatggacccggttcgggtacgaggttacgtcttgtttgcgccgttttttggcggggaggttcggaccaagtccgaggaaggtccaccagagcacatgttgagccttgagttactagacagattttggaggctttcgatgcctgttggaaagagccgagaccacccattggcgaatccgttcggacctggaagcccaaatcttgaacaagagaagcttgatcctattttggtgatagtaggtggcaatgaattgctcaaggatagggcaaaaaattatgctacaaggttaaaagaattagacaaggacattaaatacgttgagtttgaggggtgcgagcatgggtttttcacgcatgattcattctcatcagaagttgcagaagaggtcatccaaatccttaaacgattcatgcttgcaaacttctagttagaaggcacgcacgcacctgaaaaaacaaattcaacagtagaaagacactcatagtgaaatgtaattaaggttaattaattagtctgtgtaattttagcccggtataagtagttcgtgggaatttataagtatatataaatgtcaatttcatggtgtgtacgtg

SEQ ID NO: 10854 - DNA, 975 bp, Glycine max
atgggttccctccctcacgtagtagaggactgcatgggcttcctccaactttatagcgacggttccattttccgttccaacgacatagaattcaaagtttcacccattcaagacaactccataacctataaagattatctctttgacaagagattcaacctttctcttcgcttctacaagccccaacacgtagcacccatagacaataacaagaagcttcctattgtgatgttccttcacggtggaggcttttgcttcggttcgcgcacgtggccccatattcacaactgttgcatgcgcctcgcgtcggggctccaagcggtggtggtttcgccggactaccgtctggcgccggagcaccgtcttccggccgcagtagacgacgccgtggaggcggtgaggtggctccagaggcaggggctgagcttgaaggaggacgcgtggttgagtgggggcgttgactttgattgcgtgttcgtggtgggtgactcgtctggcgggaacattgcgcaccacctggcggttcggttggggtccggttcgagagagatggacccggttcgggtacgaggttacgtgttgtttgctccgttttttggcggggaggttcggaccaagtccgaggaaggtccaccagagcacatgttgaacctcgagttattagacagattttggaggctgtcgatgcctgttggagagagcagagaccacccattggcgaatccgttcggacctggaagcccaaatcttgaacaagtgaagcttgatcctattttggtaatagtaggtggcaatgaattgctcaaggatagggcaaaaaactatgcaacaaggttaaaaaaattagacaaggacattaaatacgttgagtttgaagggtgcgagcatgggtttttcacgcatgattcattctcatcagaagttacagaagaggtcatccaaatccttaaaggattcatgcttgcaaacttctag

SEQ ID NO: 10855 - DNA, 1170 bp, Glycine max
atggctttccctccccacgtagtagaggactgcatgggcctcctcaaactcctgagtgacggcaccgttttgcgctccaatatcaacttccaagaacaacctcaacctacccaacacgacaacctcgtacaattcaaagactttgtcttcctcaaaaaattcaacctccacctccgtttctacaaacccaaatttgaggacaatgatgatgacgacaacgaaaacaacaacaagaagttgttgcccgtggtgatgtttctccacggcggcggcttctgctttggctcgcgcgcgtggccacacatgcattcgtgctgtgtgcgtcttgccacgagcctccgtgccgccgtggtggccccggactaccgtctcgccccagaacaccgccttcctgccgcggtggacgacggggtggaggccgtgcggtggctccagcggcagaagggtcaccacggcggggacgagtgggtgacccggggtgttgactttgaccgtgttttcatccttggtgactcctctggcgggaacattgctcaccacttggcggttcagctcggacccggttcgagggagatggacccggttcgcgtacgaggttacgttctgctgggcccctttttcggtggggtggttcggactaggtcggaggtgggtccaccggaacaaatgctgacccttgagttgctcgacagattttggaggctgtcaatacctattggagagacaagagatcacccattggcgaacccttttggacctaacagtccaaaccttggacatgtgaagcttgaccctatcttagtaatagttggtggcaatgaattgctgaaggacagagcagcggactatgcaacaaggttaagagaacaagggaagaacattgaatacgttgagtttgaggggaaggaacatggctttctcactcatgattcgcactcagaggctgcagaagagctcgtgcaaatcattaaacgattcatgcttgaaaattctaattagaatatatatgtgaaaaaaaaaaatatcatcaaagggtgttagacttttcatatgtagtgatctagagttaatccatgttttctagtttggtaaaaagggtaataagtgtacgttggttgcagatggagaatgtagtcaattgttaattttatatatgttatttttaactag

SEQ ID NO: 10856 - DNA, 1257 bp, Glycine max
aacaacgttttcttcttcactaaaatggctttccctccccacgtagtagaggattgcatgggcctcctcacactcttgagcgacggcaccgttttgcgttccaacatcaacttccaagaacaacctcaacccacccaacacgacaacctcgtacaattcaaagacttcctcttccacaaaaaattcaacctccacctccgtctctacaaacctaaatttgacgacaacattaataatgatgacgacaagaacaacaacaataagtcgttgcccgtggtgatgttcctccacggcggcggcttctgcttcggctcgagagtgtggccacacattcattcgtgctgtgtgcgcctagctacgagcctccatgccgccgtggtgaccccggactaccgcctcgctccagagcaccgccttcccgccgcagtggatgacggcgtggaagccctgcggtggctccagcgacagggccaccacggcggggatgagtgggtgacccggggcgttgactttgaccgtgctttcatcctcggtgactcctctggcgggaacattgcgcaccacttggcggttcagctcggacccggttcgagggagatggatccggttcgcgtacgaggttacgttctgctgggcccgtttttcagtggggtggttcggaccaggtcggaggtgggcccaccggaacaaatgctgacccttgagttgctcgacagattttggaggctgtcaatacctattggagagacaagagatcacccattggcgaacccatttggagctaacagtccaaaccttggacatgtgaagcttgaccctatcttagtgatagttggtggcaatgaattgctgaaggacagagcagtggactatgcaacaaggttaaaagaactagggaagaacattgaatacattgagtttaaggggaaggaacatggctttctcactcatgattcgcactcagaggctgcggaagaggtcgtgcaaatcattaaacgattcatgcttgaaaattctcattaattagaatatatatgtgtgaaacactgaagatcatcaaaggggattaggcttttcatatgtagtgatttaaagttaatccatgttttctagtttggtaaaatgggtaataaaatgtacgtaggttgcacatggaattgaaaatgctgcattgtaaaattttaattgctatcgtttgattttttgtactaatattctaaaaaaagttaatttacgtagtaatcatttttgtcttaa

SEQ ID NO: 10857 - DNA, 1410 bp, Glycine max
aagttgaaagataacaaacaacaaacaagaatgcccatcttctctgcaacgttgggctccttcacttccatctcctcctccttcctctcacagtcacacctttctcctttcgtgaagacaccttgccaatggcagcatcactatcacactgctaaagtcttggtctctgcctctggcaatacccaaattgaccaaaatcccgactctggacttcttcaacgccctactcctccagacccactcgatgacgctcgtcaggctcggagatcgtcagattggaaggctgcaaagacatatcaagatagtaaagtcatttataatggtagggttgaaggttttaattctggaggcctgctggttcggttttattctgttatgggctttctcccattcccacaattgagtccagtgcatgcttctaaagaaccagagaaatctatccaagaaattgcacaaggcttaattggttcaatcatgtcggtgaaggtaattctagcagatgaggataacaagaaattgatcttctctgaaaaggaagctgcctggtccaaatattcaaaacaggtcaatgtaggggacatttttgaagtaagagttggttatgttgaggactatggtgcttttgttcatttgcgcttccctgacggtctttatcaccttactggactaatacacgtctcagaagtgtcatgggatctaattcaggatgtcagagatatcttaaaagtaggtgatgaagtgagggccaaagttgttggtattgattggggaaaatcaaggattaacctatcaattagacagctagaagaagatccactcttagaaactctggacaaagtaatacctcaggatggttcagctgatcctgattctatgagtggtggtgatagcggtagcattgagcctcttccagggcttgaaacaatccttgaagagctactacaggaagatggaatatatgacgtaagaatcagccgtcaagggtttgaaaaaagagtggtctcgcaagacttgcagctttggctttctaatgcacctcccacgaaccaaaggtttactctacttgcccgggctggaagacaggtgcaggagatacatctcactacatcccttgatcaggaaggtatcaggagggcattacaacgagtattggagcgtgtcccctgaatttcattcactcagacctttcttccgataatcactgcgatcgattttgtacagttacatgcatgccattatatatatatggagtgtatttattatatatccgatcttcttattcctcaaatgttcaagattaaaaaaagttcttagttgtaaaatcatgcacattactcgagttattcattcagaattgccaacacatttgtgctacaccggatatatatatatatattattcttagcaaaa

SEQ ID NO: 10858 - DNA, 1363 bp, Glycine max
atgcccatattctctgcaagcttgggctccttcacttccatctccttcctctcaacttcacaatcacaatcacaatcacacctttctcctttcaagttaactgtgaagacaccttggcaatggcagcatcatcactatctcacttctaaagtgttggtctctgcctctggcaacacccaaattcctaatactgaacttcttcaacgccctactcctccagaccctctcgatgacgttcgtcaggctcggagatcgtcagattggaaggctgcaaagacatatcaagatagtaaactcatctataatggtagagtggaaggttttaattctggaggcctgctggttcggttttattctattatgggctttctcccattcccccaattgagtccagtgcatgcttctaaagaaccagagaaatctatacaagaaattgcacaaggcttaattggttcaatcatgtcggtgaaggtaattctagcagatgaggataacaagaaattgatcttctctgaaaaggaagctgcctggtccaaattttcaaaacaggttaatgtaggggacatttttgaagtaagagttggttatgttgaggactatggtgcttttgttcatttgcgcttccctgacggtctttatcgccttactggactaatacacgtgtcagaagtgtcatgggatctaattcaggatgtcagagatatcttaaaagtgggcgatgaagtgagggtcaaagttgtcggtattgattggggaaaatcaaggattaacctatcaattagacagctagaagaagatccactcttagaaactctggacaaagtaatacctcaggatggttcagctgatcctgattccatgagcggtggtgatagcggtagcattgagcctcttccaggacttgaaacaatccttgaagagctgctacaggaagatggaatatatgacgtaagaatcagccgtcaagggtttgaaaaacgagtggtctcgcaggacttgcagctttggctttgtaatgcacctcccacgaaccaaaggtttactcttcttgctcgggctggaagacaggtgcaggagatacacctgactacatcccttgatcaggaaggtatcaagaaggcattacaacgagtactggagcgtgtcccctgaatttcattcactcacagcgatcaattttgtacagttacatctcacaaatttcaaacatgcgtcccattatggagtgtattaatagatcccatgtccttattcctcaactgttcaagatttaactagtgaaaaagctcttaattgtaaaaactaaaaacacatcactcgagttattcattaagaaatcagaattgccaacacatttgtgcta

SEQ ID NO: 10859 - DNA, 1325 bp, Medicago truncatula
aaacctattcctcttcttcaccaccatcaacaacgcgatttggttccgttgttgaactcgaaatggctattttctctgcaaccctaggttcctttggtgccatttccttcctctcatcttcacaatcacaacaacacgatccttcttcttcttccatcgtcaatcctttcaatttccctaaatgccctcacaagttaccaccaccttgccaatggcatcctcactatcgtcatcacaatcctaaaatcatggtatctagtagtagtagcagtaacaatactcatattgatgaattcgacagcggtcttcttcaacgcccttctgctcctgactcttatgatgctcttcgtcaagccaggagatcgtcagattggaaggctgcaaacgcatatagagacagtggactcatttacaatggtagggttgagggttttaatgctggaggcctgctggttcggttttactctatcatgggctttctcccgtacccacagctgagccccgtgcattcatgccaagaaccagatcaaactatcaaagaacgcgcaagagagttgatcggtgccatcttatcagtgaaggtaattatagtagacgaggagaaacggaaattggtcttatctgaaaaggaagcttcatggtttaaacattcaaaacatatcaacataggggacctttttgaaggaagagtcggttctgttgaggactatggggcttttgttcatctgcgcttccctgacggtctttatcaccttaccggactaatacatatctcagaagtgtcgtgggatctagttcaagatgtaagagacttcttaagagaaggtgaagaagtgagggtcaaagttatcagtattgatactgtaaaaatgaggcttacactgtcaattaaacagctagaagaagatccactgctagaaactctggacaaagtaatacgtcaggatggttcaggtgttcccaattctatcagcagtactactagcagtcccatcgatcccctaccggggctggatacaatacttgaagagctattgcaggaagatggcataaacgaggcaagaatcagccgtcaggggtttgaaaaacgagtggtctcacaagacttgcagctttggctttctaatgcacctccgatggaccaaaggtttactctccttgctcgagctggaagacaggttcaggagatacatctgaaaacttcccttgaccaggaaggtataaaaaaggcaatacaacgagtattggagcgtgttccttgaatctgattgattacacttccctctcaataataatcacaagattttgtacagctttcacattta

SEQ ID NO: 10860 - DNA, 2868 bp, Vitis vinifera; identical to SEQ ID NO: 10590

SEQ ID NO: 10861 - DNA, 2700 bp, Glycine max; identical to SEQ ID NO: 10591

SEQ ID NO: 10862 - DNA, 2709 bp, Glycine max; identical to SEQ ID NO: 10592

SEQ ID NO: 10863 - DNA, 3066 bp, Nicotiana sylvestris; identical to SEQ ID NO: 10593

SEQ ID NO: 10864 - DNA, 2769 bp, Glycine max; identical to SEQ ID NO: 10594

SEQ ID NO: 10865 - DNA, 3227 bp, Glycine max; identical to SEQ ID NO: 10595

SEQ ID NO: 10866 - DNA, 2663 bp, Malus x domestica; identical to SEQ ID NO: 10596

SEQ ID NO: 10867 - DNA, 3108 bp, Medicago truncatula; identical to SEQ ID NO: 10587

SEQ ID NO: 10868 - DNA, 2718 bp, Glycine max; identical to SEQ ID NO: 10583

SEQ ID NO: 10869 - DNA, 3046 bp, Glycine max; identical to SEQ ID NO: 10584

SEQ ID NO: 10870 - DNA, 2828 bp, Vitis vinifera; identical to SEQ ID NO: 10588

SEQ ID NO: 10871 - DNA, 2727 bp, Glycine max; identical to SEQ ID NO: 10585

SEQ ID NO: 10872 - DNA, 2879 bp, Vitis vinifera; identical to SEQ ID NO: 10606

SEQ ID NO: 10873 - DNA, 2856 bp, Malus x domestica; identical to SEQ ID NO: 10586

SEQ ID NO: 10874 - DNA, 2694 bp, Vitis vinifera; identical to SEQ ID NO: 10598

SEQ ID NO: 10875 - DNA, 3035 bp, Glycine max; identical to SEQ ID NO: 10599

SEQ ID NO: 10876 - DNA, 3797 bp, Glycine max; identical to SEQ ID NO: 10600

SEQ ID NO: 10877 - DNA, 2857 bp, Malus x domestica; identical to SEQ ID NO: 10601

SEQ ID NO: 10878 - DNA, 3794 bp, Glycine max; identical to SEQ ID NO: 10602

SEQ ID NO: 10879 - DNA, 2568 bp, Populus trichocarpa; identical to SEQ ID NO: 10603

SEQ ID NO: 10880 - DNA, 3061 bp, Gossypium barbadense; identical to SEQ ID NO: 10604

SEQ ID NO: 10881 - DNA, 2682 bp, Medicago truncatula; identical to SEQ ID NO: 10608

SEQ ID NO: 10882 - DNA, 3048 bp, Glycine max; identical to SEQ ID NO: 10609

SEQ ID NO: 10883 - DNA, 2810 bp, Glycine max; identical to SEQ ID NO: 10610

SEQ ID NO: 10884 - DNA, 3060 bp, Malus x domestica; identical to SEQ ID NO: 10611

SEQ ID NO: 10885 - DNA, 2978 bp, Malus x domestica; identical to SEQ ID NO: 10612

SEQ ID NO: 10886 - DNA, 2736 bp, Vitis vinifera; identical to SEQ ID NO: 10613

SEQ ID NO: 10887 - DNA, 3080 bp, Citrus trifoliata; identical to SEQ ID NO: 10614

SEQ ID NO: 10888 - DNA, 692 bp, Antirrhinum majus; identical to SEQ ID NO: 10597
  misc_feature (351)..(351): n is a, c, g, or t

SEQ ID NO: 10889 - DNA, 3046 bp, Glycine max; identical to SEQ ID NO: 10584

SEQ ID NO: 10890 - DNA, 2963 bp, Glycine max; identical to SEQ ID NO: 10589

SEQ ID NO: 10891 - DNA, 2520 bp, Medicago truncatula; identical to SEQ ID NO: 10582

SEQ ID NO: 10892 - DNA, 3108 bp, Medicago truncatula; identical to SEQ ID NO: 10587

SEQ ID NO: 10893 - DNA, 3227 bp, Glycine max; identical to SEQ ID NO: 10595

SEQ ID NO: 10894 - DNA, 2724 bp, Medicago truncatula; identical to SEQ ID NO: 10618

SEQ ID NO: 10895 - DNA, 3048 bp, Glycine max; identical to SEQ ID NO: 10609

SEQ ID NO: 10896 - DNA, 2682 bp, Medicago truncatula; identical to SEQ ID NO: 10608

SEQ ID NO: 10897 - DNA, 2727 bp, Glycine max; identical to SEQ ID NO: 10585

SEQ ID NO: 10898 - DNA, 1485 bp, Glycine max
gaagagcattatctgtttaacatcctataaaggattaaatgtaccactttctctcaagggaaaatcttttatcttttaaaaagttatcttaaatatcttaattttattttcgtaattcagagataacactataaaacctacgcaacaaccttacatcgaagcagaggaacaaagaaaggaaaagagaaaaaaatttctcagaagagtctccgctgaaagttttggtttcttgaagatgtcgttgctctccgatcttatcaaccttaacctctccgacatcaccgataaagtgatcgccgagtacatatgggtaggtggatctggcatggatatgaggagcaaagcaaggacactctcaggaccggttaaagacccttcgaagcttcccaagtggaactatgatggttccagcactggtcaagctcctgggcaagatagtgaagtgatcttatatccacaagcaattttcaaggatccattcaggaggggtagcaatatcctggttatgtgtgatgcttacactcctgctggggaacccattcctacaaacaagagaaataatgctgcaaagatattcggccatcctgatgttgctgctgaagaaccctggtatggcctagagcaagaatacaccttgttgcaaaaagatgtccaatggcctctaggatggcctcttggtggttttcctgggccacaaggaccatattattgtggtactggtgctaacaaggctttcgggcgtgatattgttgactcacattacaaagcatgtatttatgcgggcattaacatcagtggaatcaatggagaagtgatgcctggtcagtgggaattccaagttggtccatcaattggcatctctgctgctgacgaattgtgggttgctcgttatattttggagaggatcaccgagattgcaggagtggtgctttcctttgaccctaaaccaattcagggtgattggaatggtgctggtgctcacacaaattacagtaccaagtccatgagaaacgatggtggctatgaagtcatcaaaaaagcaattgctaagttggaaaagagacacaaggagcacattgcagcttacggagaaggcaacgaacgtcgtttgactggacgacacgagacagctgacatgaacacctttgtatggggtgttgcaaaccgtggtgcttctattagagtagggagggacactgagaaggcagggaaggggtattttgaggataggaggcctgcctctaatatggacccttatgtggtcacttccatgattgctgagacaaccattctttggaaaccataagcagcctcaaaaataatcacacatgccttgttttttcatgttttgtgtgcactcttgttgtgactacctcgccttttcttaggcattgtttgttggtagtactgaagtgaagaattgtcgtgtcattccattaatgtacgttttcaaaggaattgtttgtgtgcactcttgttgtgatt

SEQ ID NO: 10899 - DNA, 1477 bp, Glycine max
aaatcccacgcaacaacaaccttatatcgaagcagtggaacaaagcaaggaagagaaagaaatttgtttctctctaaagagtctccgctgaactttttggtttcttgaagatgtcgttactctccgatcttatcaaccttaacctctccgacatcaccgataaggtgatcgccgagtacatatgggttggtggatctggcatggatatgaggagcaaagcaaggactctctcgggactggttaatgacccttccaagcttcccaagtggaactatgatggttccagcactggtcaagctcctggacaagatagtgaagtgatcttatatccacaagcaatttttcgggatccattcaggaggggtaacaatatcctggttatgtgtgatgcttacactcctgctggggaacccattcctaccaacaagagaaataaagctgcaaagatattcagtaatccggatgttgctgctgaagaaccctggtatggtcttgagcaggaatatacattattgcagaaagatgtccaatggcctcttggatggcctcttggtgggtttcctgggccccagggaccatactattgtggaactggtgctaacaaggcttttgggcgtgatattgttgactcacattacaaagcatgtatttatgcgggaattaacataagtggaatcaatggagaagtgatgcccggtcagtgggaattccaagttggtccatcggttggcatctctgctgctgacgagttgtgggttgctcgttacattttggagaggatcaccgagattgctggagtggtgctttcctttgaccctaaaccaattcagggtgattggaatggtgctggtgctcacacaaattacagtaccaagttgatgagaaacgatggtggctatgaaatcatcaaaaaagcaattgctaagttggaaaagaggcacaaagagcacattgctgcttacggagaaggcaatgaacgtcgtttgaccggacgacacgagacggctgacatgaacacctttttatggggtgttgcaaaccgtggtgcttctattagggtagggagagacactgaaaaggcagggaagggatactttgaagataggaggcctgcctctaacatggacccttatgtggtcacttccatgattgctgagacaactattctttggaaaccataagcaacgtcaaaacaatcacatggtgccttccgcatagcattgttgtttagatggtcaatttgtttttctatgtttttgtgtgcattctagttgtgactacctcgcctgttgttaggtattgtttgttggtggtactcatgattaccaagcgaggaattgttgtttcattttcttaatgtacgttttaagtgttccaataatgtgtaatggccctcaagtattgttatttgctgcgaatttatattgtgaagcatctcatgatttctctttgagcaatcaagttcttattaactgta

SEQ ID NO: 10900 - DNA, 1407 bp, Glycine max
ttttttttttttttttttttctttttttaaattcgcagcaaataacaatacttgagggccattacacattattggaacacttaaaacgtacattaagaaaatgaaacaacaattcctcgcttggtaatcatgagtaccaccaacaaacaatacctaacaacaggcgaggtagtcacaactagaatgcacacaaaaacataaaaaaacaaattgaccatctaaacaacaatgctatgcggaaggcaccatgtgattgttttgacgttgcttatggtttccaaagaatagttgtctcagcaatcatggaagtgaccacataagggtccatgttaaaggcaggcctcctatcttcaaagtatcccttccctgccttttcagtgtctctccctaccctaataaaagcaccacggtttgcaacaccccataaaaaggtgttcatgtcagccatctcgtgtcgtccggtcaaacgacgttcattgccttctccgtaagcagcaatgtgctctttgtgcctcttttccaacttagcaattgcttttttgatgatttcatagccaccatcgtttctcatcaacttggtactgtaatttgtgtgagcaccagcaccattccaatcaccctgaattggtttagggtcaaaggaaagcaccactccagcaatctcggtgatcctctccaaaatgtaacgagcaacccacaactcgtcagcagcagagatgccaaccgatggaccaacttggaattcccactgaccgggcatcacttctccattgattccacttatgttaattcccgcataaatacatgctttgtaatgtgagtcaacaatatcacgcccaaaagccttgttagcaccagttccacaatagtatggtccctggggcccaggaaacccaccaagaggccatccaagaggccattggacatctttctgcaataatgtatattcctgctcaagaccataccagggttcttcagcagcaacatccggattactgaatatctttgcagctttatttctcttgttggtaggaatgggttccccagcaggagtgtaagcatcacacataaccaggatattgttacccctcctgaatggatcccgaaaaattgcttgtggatataagatcacttcactatcttgtccaggagcttgaccagtgctggaaccatcatagttccacttgggaagcttggaagggtcattaaccagtcccgagagagtccttgctttgctcctcatatccatgccagatccaccaacccatatgtactcggcgatcaccttatcggtgatgtcggagaggttaaggttgataagatcggagagtaacgacatcttcaagaaaccaaaaagttcagcggagactctttagagagaaacaaatttctttctcttccttgctt

SEQ ID NO: 10901 - DNA, 1503 bp, Glycine max
gcagtggaacaaagcaaggaagagaaagaaatttgtttctctctaaagagtctccgctgaactttttggtttcttgaagatgtcgttactctccgatcttatcaaccttaacctctccgacatcaccgataaggtgatcgccgagtacatatgggttggtggatctggcatggatatgaggagcaaagcaaggactctctcgggactggttaatgacccttccaagcttcccaagtggaactatgatggttccagcactggtcaagctcctggacaagatagtgaagtgatcttatatccacaagcaatttttcgggatccattcaggaggggtaacaatatcctgttaaacttgtttccatggtgtagtcatttcatatctttcaattgtaatttatttcaggttatgtgtgatgcttacactcctgctggggaacccattcctaccaacaagagaaataaagctgcaaagatattcagtaatccggatgttgctgctgaagaaccctggtatggtcttgagcaggaatatacattattgcagaaagatgtccaatggcctcttggatggcctcttggtgggtttcctgggccccagggaccatactattgtggaactggtgctaacaaggcttttgggcgtgatattgttgactcacattacaaagcatgtatttatgcgggaattaacataagtggaatcaatggagaagtgatgcccggtcagtgggaattccaagttggtccatcggttggcatctctgctgctgacgagttgtgggttgctcgttacattttggagaggatcaccgagattgctggagtggtgctttcctttgaccctaaaccaattcagggtgattggaatggtgctggtgctcacacaaattacagtaccaagttgatgagaaacgatggtggctatgaaatcatcaaaaaagcaattgctaagttggaaaagaggcacaaagagcacattgctgcttacggagaaggcaatgaacgtcgtttgaccggacgacacgagacggctgacatgaacacctttttatggggtgttgcaaaccgtggtgcttctattagggtagggagagacactgaaaaggcagggaagggatactttgaagataggaggcctgcctctaacatggacccttatgtggtcacttccatgattgctgagacaactattctttggaaaccataagcaacgtcaaaacaatcacatggtgccttccgcatagcattgttgtttagatggtcaatttgtttttctatgtttttgtgtgcattctagttgtgactacctcgcctgttgttaggtattgtttgttggtggtactcatgattaccaagcgaggaattgttgtttcattttcttaatgtacgttttaagtgttccaataatgtgtaatggccctcaagtattgttatttgctgcgaatttatattgtgaagcatctcatgatttctctttgagcaatcaagttcttattaactgta

SEQ ID NO: 10902 - DNA, 1495 bp, Hevea brasiliensis
actcggtactccaaaaagctttcacgccctccccccagctagacacctctgcatacagaggcaggaagaagaggaagaagaagagaagagttgccaattattactgtgtggacatgtcgcttctctcagatctcatcaaccttaacctctcagacaccactgacaagatcattgccgagtacatatggatcggcggatctggcatggacatgaggagcaaagcaaggactctttctggtcctgttagtgatccttcaaagctccccaagtggaactatgatggttccagcacaggacaggctcctggagaagacagcgaagtcatcctatatccccaggctattttcaaggatccatttaggaggggcaacaatatacttgtgatgtgtgatgcttacacccctgctggtgagccaattccaacaaacaagagacacgctgctgctaagatcttcagccatccagatgttgttgctgaagagccctggtacggcattgagcaagaatacaccttgctgcagagagatgttaaatggcctattgggtggcctcttggtggttaccctggtcctcaggggccatactactgtagtattggtgctgacaaatcctttgggcgagacgttgttgattcacactacaagtcctgtctatatgctggcatcaacattagtggtattaatggagaagtcatgccaggccagtgggaatttcaagtgggacctgcagttggaatctctgctggagatgaattatgggttgcgcgctacattttggagaggattacagagattgctggagttgtcctttcttttgatcccaagccaattcagggtgactggaatggtgctggagctcacacaaactatagtacaaagtcaatgaggcatgatgggggctatgaggtcatcaagaaagcaattgagaagttggggctgaggcacaaagaacacattgctgcatatggtgaaggcaatgaacgcagactgactggacgacatgaaacggctgacatcaacactttcttatggggcgttgctaaccgtggagcatcgattcgcgttggccgagacacagagaagcaaggaaagggatatttcgaggacaggaggcctgcatcaaacatggatccatatgttgtgacttctatgattgcagaaaccacaatcctgtggaaaccataagcaagttgatgctcccaaccactaaaaatttgaaacattgttgtttttagcctgtgtctgtgggagtgtagaaagaactgtgtttcagtgggaacttgttctccatgtggtttcaacttcctctttgattccaaattttcctgctgtttcgccagttcgcccttgtgtgggaggtgtggcaaggttgggttattgcttccttgcatatgcagtcattctctgttatgcattttaataatataaaacgctttaatacaataacattattattgggcagatttttctaaaaaaaaaaaaaaaaaaaaaaaaaa

SEQ ID NO: 10903 - DNA, 2848 bp, Gossypium herbaceum
ttgccgcagagtattgagaaaaatcgctttgtttcactcccttatttgctaatatgtcgcttcttacagatcttgttaaccttaatctctccgactgcactgacaaaatcattgctgaatacatatggtcggtctcgcataatatactcactccccttcacctttcaagcaaaaaaaatcacttcaaatatctcattaatatgcttaacttaatgttaccgtcaatgagtgtttctctttttggtttctagtttcttttgttcatcctctttttcaagaatgttccagtttctaagttaataactgtgtcttttcctaaatatatttgtaacttaaaagagttcaaaatattagcttttgatcatctaaaagatggttttgttttggtaacttttgttatcgtttcagctttctctggaaactattgctttatttcttatatatttattttatgtttgttgaataggatcggtggatctgggatggacctcagaagcaaagcaagggtaatttactttttggctcttcttttggaagtttttggttttcattactttctaataatatatcaagtttttctttttttttttttttggttatttaaagacactttctggtcctgtaagtgacccttcaaagctacccaaatggaattatgacggttccagcacaggtcaagcccctggtgaagatagtgaagtcatcctatagtatgttttttgcttctttggctttctcttatacttactcctatttattgattttattatttttatcatcaagtcctcaagctatcttcaaagacccattcaggaggggcaacaatattcttgtaagtttctgtttcatctttgggcaaaaaaaaatgaaatttttggagtgatgatttgcatatatcatggaattgattttctttgaactctaatgattgagtcaggttatgtgcgatgcttacacaccagctggtgagcccatccccacaaacaagagatgcaacgctgccaagatatttagccatcccgatgttgctgctgaagagccctggtagtcctatttccaatgataggttaaactattttccagctgtgtgagttaatgttgatttgctttgaaacaggtatggaattgagcaagagtacaccctgttgcagaaagatgttaagtggccaattggatggcctcttggtggctaccctggacctcaggtactcttttctttctttcattcaaagcaatgttcagaaatctcccctgaaagtcaaactggtggaatgatgtatgttgaacttagacgacttttagttgttgattcaatccatcgtgcttcaaaggttatttttagaggatttatgtaagtttacagacgtcaagttggtaaagattccccttcagaaacgacatacaaatttacttcaaatgtcaccatgtggacggatgatattactagcacgtgattgctcttttttacttgccttgaacatgtatgttttaagaaagataaaaatcttgggtatgattttgttttttgggttattttgttgacagggtccttactattgcggtgttggtgtggacaaagcctatgggcgtgacattgtggattctcattacaaagcatgtttatatgctgggattaatatcagtggcatcaatggagaagtgatgcccggacaggtagaatgattgcatagtactctgctatgtttctcagttattgagtatgtttaagcttaatctgtcttcatctttttaacagtgggaatttcaagttggtccggcagttggcatttctgccggagatgagttgtgggttgcacgttacattttggaggtaatctagcatgcttgagttaagattactcaaactcgggtccttggtcatcacgtccagacgagtattggacacaaatacttgaagaaaaatgaaaaatcagagtaacatagttatcaagaggtttgcttcaactcttttaagttaatttgatctatgtttgtgaattacagaggattacagagattgccggagtggtgctttcctttgatcctaagccaattcaggttagacttgttggttccattagcttttcttttgctccatatcaacaagcgatcttagtcttacagttttttttttttttttaatgttgtttgatcccagggagactggaatggtgccggcgctcacacaaattacaggtaccatttgaatctactttgagaagttaatggaagaaactgattcattaagtactttttattattgttatttcctaattgtgaagttcatatgatgttttagtaagttaatggaagaaactgattcattaagtactttttattattgttatttcctaattgtgaagttcatatgatgttttagtacgaagtccatgagaagtgatggaggctacgaggttatcaagaaagcaattgcaaagcttgggctaaggcacaaagaacacattgctgcctatggagaaggcaacgagcgccgtctcaccggccggcatgagactgccgacatcaacactttcttatgggtaaaaaaatgaaacaacctttgacatcttctatataacatcataatatctgatttctctggatcgtttacatccaatagggtgttgcaaatcgtggggcatcaattcgtgttgggcgagacacagagaaagccggaaaagggtatttcgaagacaggaggccagcatcgaacatggatccatacgttgtcacatccatgattgcagaaaccaccatcctgtggaaaccatgaggggaagcccatgtttgggatgctgtttccatggtagaaagaaaggaaagagccaaagtgtttgttttgtcccct

SEQ ID NO: 10904 - DNA, 2764 bp, Gossypium hirsutum
ttgccgcagagtattgagaaaaatcgctttgtttcactcccttatttgctaatatgtcgcttcttacagatcttgttaaccttaatctctccgactgcactgacaaaatcattgctgaatacatatggtcggtctcgcataatatactcactccccttcacctttcaagcaaaaaaaatcacttcaaatatctcattaatatgcttaacttaatgttaccgtcaatgagtgtttctctttttggtttctagtttcttttgttcatcctctttttcaagaatgttccagtttctaagttaataactgtgtcttttcctaaatatatttgtaacttaaaagagttcaaaatattagcttttgatcatctaaaagatggttttgttttggtaacttttgttatcgtttcagctttctctggaaactattgctttatttcttatatatttattttatgtttgttgaataggatcggtggatctgggatggacctcagaagcaaagcaagggtaattgattttttggctcttcttttggaagtttttggttttcattactttctaataatatatcaagtttttcttcttctttttttggttatttaaagacactttctggtcctgtaagtgacccttcaaagctacccaaatggaattatgacggttccagcacaggtcaagcccctggtgaagatagtgaagtcatcctatagtatgttttttgcttctttggctttctcttatacttctcctatttattgattttattatttttatcatcaagtcctcaagctatcttcaaagacccattcaggaggggaaacaatattcttgtaagtttctgtttcatctttgggcaaaaaaaaaatgaaatttttggagtgatgatttgcatatatcatggaattgattttctttgaactctaatgattgagtcaggttatgtgcgatgcttacacaccagctggtgagcccatccccacaaacaagagatgcaacgctgccaagatatttagccatcccgatgttgctgctgaagagccctggtagtcctatttccaatgatacgttaaactattttccagctgtgtgagttaatgttgatttgctttgaaacaggtatggaattgagcaagagtacaccctgttgcagaaagatgttaagtggccaattggatggcctcttggtggctaccctggacctcaggtactcttttctttctttcattcaaagcaatgttcagaaatctcccctgaaagtcaaactggtggaatgatgtatgttgaacttagacgacttttagttgttgattcaatccatcgtgcttcaaaggttatttttagaggatttatgtaagtttacagatgtcaagttggtaaagattccccttcagaaacgacatacaaatttacttcaaatgtcaccatgtggacggatgatattactagcacgtgattgctcttttttacttgccttgaacatgtatgttttaagaaagataaaaatcttgggtatgattttgttttttgggttattttgttgacagggtccttactattgcggtgttggtgtggacaaagcctatgggcgtgacattgtggattctcattacaaagcatgtttatatgctgggattaatatcagtggcatcaatggagaagtgatgcccggacaggtagaatgattgcatagtactctgctatgtttctcagttattgagtatgtttaagcttaatctgtcttcatctttttaacagtgggaatttcaagttggtccggcagttggcatttctgccggagatgagttgtgggttgcacgttacattttggaggtaatctagcatgcttgagttaagattactcaaactcgggtccttggtcatcacgtccagacgagtattagacacaaatacttgaagaaaaatgaaaaatcagagtaacatagttatcaagaggtttgcttcaactcttttaagttaatttgatctatgtttgtgaattacagaggattacagagattgctggagtggtgctttcctttgatcctaagccaattcaggttagacttgttggttccattagcttttcttttgctccatatcaacaagcgatcttagtcttacagttttttttttttttaaatgttgtttgatcccagggagactggaatggtgccggcgctcacacaaattacaggtaccatttgaatctactttgagaagttaatggaagaaactgattcattaagtactttttattattgttatttcctaatagtgaagttcatatgatgttttagtacgaagtccatgagaagtgatggaggctacgaggttatcaagaaagcaattgcaaagcttgggctaaggcacaaagaacacattgctgcctatggagaaggcaacgagcgccgtctcaccggccggcatgagactgccgacatcaacactttcttatgggtaaaaaaatgaaacaacctttgacatcttctatataacatcataatatctgatttctctggatcgtttacatccaatagggtgttgcaaatcgtggggcatcaattcgtgttgggcgagacatagagaaagccggaaaagggtatttcgaagacaggaggccagcatcgaacatggatccatacgttgtcacatccatgattgcagaaaccaccatcctgtggaaaccatgaggggaagcccatgtttgggatgctgtttccatggtagaaagaaaggaaagagccaaagtgtttgttttgtcccct

SEQ ID NO: 10905 - DNA, 2769 bp, Glycine max; identical to SEQ ID NO: 10594

SEQ ID NO: 10906 - DNA, 1363 bp, Glycine max; identical to SEQ ID NO: 10858

SEQ ID NO: 10907 - DNA, 2963 bp, Glycine max; identical to SEQ ID NO: 10589

SEQ ID NO: 10908 - DNA, 3797 bp, Glycine max; identical to SEQ ID NO: 10600

SEQ ID NO: 10909 - DNA, 2694 bp, Vitis vinifera; identical to SEQ ID NO: 10598

SEQ ID NO: 10910 - DNA, 2708 bp, Zinnia violacea; identical to SEQ ID NO: 10626

SEQ ID NO: 10911 - DNA, 3794 bp, Glycine max; identical to SEQ ID NO: 10602

SEQ ID NO: 10912 - DNA, 2868 bp, Vitis vinifera; identical to SEQ ID NO: 10590

SEQ ID NO: 10913 - DNA, 2700 bp, Glycine max; identical to SEQ ID NO: 10591

SEQ ID NO: 10914 - DNA, 2709 bp, Glycine max; identical to SEQ ID NO: 10592

SEQ ID NO: 10915 - DNA, 3066 bp, Nicotiana sylvestris; identical to SEQ ID NO: 10593

SEQ ID NO: 10916 - DNA, 2769 bp, Glycine max; identical to SEQ ID NO: 10594

SEQ ID NO: 10917 - DNA, 3227 bp, Glycine max; identical to SEQ ID NO: 10595

SEQ ID NO: 10918 - DNA, 2663 bp, Malus x domestica; identical to SEQ ID NO: 10596

SEQ ID NO: 10919 - DNA, 3108 bp, Medicago truncatula; identical to SEQ ID NO: 10587

SEQ ID NO: 10920 - DNA, 2718 bp, Glycine max; identical to SEQ ID NO: 10583

SEQ ID NO: 10921 - DNA, 3046 bp, Glycine max; identical to SEQ ID NO: 10584

SEQ ID NO: 10922 - DNA, 2828 bp, Vitis vinifera; identical to SEQ ID NO: 10588

SEQ ID NO: 10923 - DNA, 2727 bp, Glycine max; identical to SEQ ID NO: 10585

SEQ ID NO: 10924 - DNA, 2879 bp, Vitis vinifera; identical to SEQ ID NO: 10606

SEQ ID NO: 10925 - DNA, 2856 bp, Malus x domestica; identical to SEQ ID NO: 10586

SEQ ID NO: 10926 - DNA, 2694 bp, Vitis vinifera; identical to SEQ ID NO: 10598

SEQ ID NO: 10927 - DNA, 3035 bp, Glycine max; identical to SEQ ID NO: 10599

SEQ ID NO: 10928 - DNA, 3797 bp, Glycine max; identical to SEQ ID NO: 10600

SEQ ID NO: 10929 - DNA, 2857 bp, Malus x domestica; identical to SEQ ID NO: 10601

SEQ ID NO: 10930 - DNA, 3794 bp, Glycine max; identical to SEQ ID NO: 10602

SEQ ID NO: 10931 - DNA, 2568 bp, Populus trichocarpa; identical to SEQ ID NO: 10603

SEQ ID NO: 10932 - DNA, 3061 bp, Gossypium barbadense; identical to SEQ ID NO: 10604

SEQ ID NO: 10933 - DNA, 2682 bp, Medicago truncatula; identical to SEQ ID NO: 10608

SEQ ID NO: 10934 - DNA, 3048 bp, Glycine max; identical to SEQ ID NO: 10609

SEQ ID NO: 10935 - DNA, 2810 bp, Glycine max; identical to SEQ ID NO: 10610

SEQ ID NO: 10936 - DNA, 3060 bp, Malus x domestica; identical to SEQ ID NO: 10611

SEQ ID NO: 10937 - DNA, 2978 bp, Malus x domestica; identical to SEQ ID NO: 10612

SEQ ID NO: 10938 - DNA, 2736 bp, Vitis vinifera; identical to SEQ ID NO: 10613

SEQ ID NO: 10939 - DNA, 3080 bp, Citrus trifoliata; identical to SEQ ID NO: 10614

SEQ ID NO: 10940 - DNA, 692 bp, Antirrhinum majus; identical to SEQ ID NO: 10597
  misc_feature (351)..(351): n is a, c, g, or t

SEQ ID NO: 10941 - DNA, 3046 bp, Glycine max; identical to SEQ ID NO: 10584

SEQ ID NO: 10942 - DNA, 2963 bp, Glycine max; identical to SEQ ID NO: 10589

SEQ ID NO: 10943 - DNA, 2520 bp, Medicago truncatula; identical to SEQ ID NO: 10582

SEQ ID NO: 10944 - DNA, 3108 bp, Medicago truncatula; identical to SEQ ID NO: 10587

SEQ ID NO: 10945 - DNA, 3227 bp, Glycine max; identical to SEQ ID NO: 10595

SEQ ID NO: 10946 - DNA, 2724 bp, Medicago truncatula; identical to SEQ ID NO: 10618

SEQ ID NO: 10947 - DNA, 3048 bp, Glycine max; identical to SEQ ID NO: 10609

SEQ ID NO: 10948 - DNA, 2682 bp, Medicago truncatula; identical to SEQ ID NO: 10608

SEQ ID NO: 10949 - DNA, 2727 bp, Glycine max; identical to SEQ ID NO: 10585

SEQ ID NO: 10950 - DNA, 2769 bp, Glycine max; identical to SEQ ID NO: 10594

SEQ ID NO: 10951 - DNA, 1483 bp, Glycine max
atggcaatttgggggctattgttaggagcagaatcaaaaacacatgtcggagatgcagaggttctgaaggagctgaagcaaggtttggagcctggttcggtgaagccaggctcgtgcgtgagctcctgggacttcaccttggacccatgcgacaaccttttcggcgacaagttcacgtgtggcttcagatgcgacgtcgtcgtttcggggctgagtcgagtcacggaactcgccttagaccaagctggttactctggctccctctccttcacttggaaccttccttatctacaaactctcgatctctccaacaactacttctccggtcaaattccatattccttctcaaatctcactcgtctgagccgactcagtctctcgtccaactcgttctccggcgagataccctcttctctcggcacactctccaacctccaagagctttacctcgacaacaacaacctgcgaggaacaatcccacaaagtttcgacaacctggccaaccttaaaagactcgaactccagtcaaacaaactcaacacccgccttccaaacctggggtccctaagaaaccttaaatttctctacctaagcgacaactccgtcactggaacattgccggcttctctccctgtttccttggttcagatttcactcaggaacaacaacttaagcggtgtcttagttggtgaaagtttcaagagcttgacgaggttgcaggtggtggatttcagctccaaccaattgagtagtgctgttccctctgttttcttccagcttccgtcgttgcagcagttgacactgtccttcaacgaattcacgaatctcgaagcgccttataagggaacggaatctcagagcgggcttgtagcggttgatctgagcaacaacaggcttaaggggtttttgccgtcgttcatggcggtgatgccgaagctttcgtcgttatcgttggagaacaacgagttcacggggagaataccgacccagtttggggtgaaaacggtgtttcccgaaaagggggtgtcttcgttcgggaggcttctgttaggtgggaattacttgctgggagggatacctcgacccttgttagcgctgaaacgcgattctgcgaacgtgagtttggttgataactgcttatacaggtgccctcatagtttctttttctgccagggtggccaacagaagtccttggcacagtgtaatagatttagccctgcctccactccttaacctctttaactttcacttctagattctctctgtttcaactcgtgtattgtatagttcttttctttgttgatttatggtgagagatcttgtcttaaatgcaacacaatcatcacaaggtttgcctcaacgctaagatccactgccagattttgtctctcctagacgttggatttgcaaccacgtgaccccttatcaagatgacattccatttttttttaggttaaattactatttggttactttaatttat

SEQ ID NO: 10952 - DNA, 1347 bp, Glycine max
atggggactctctgtttccctctatttgcgatcatcgcaattttttggggagtattattaggagcagcatcaaaaacacatgttggagatgcagaggttctgaaggagctgaagcaaggtctggacccagcttcggtgaagccaggctcgtgtgtgagttcctgggacttcaccgtggacccatgcgacaaccttttcggtgagaaattcacgtgcggcttcagatgtgacgtcgtcgtttcggggctgagtcgagtcacggaactcacattagaccaagctggttactctggctccctctcctccttcacttggaaccttccttatctacaaactctcgatctctccaacaactacttctccggtcaaattccatattccttctcaaacctcactcgtctgagccgactcagtctctcgttcaactcgttctccggcgagataccctcttccctaggcacactctccgacctccaagagctttatctcgacaacaacaacctgcgaggagcaatcccagaaagtttcaaccacctggccaaccttaaaagactcgaactccagtctaacaaactcaacacccaccttccaaacttggagtccctaagaaatctcaaattcctctacctcagcgacaatttcatcgccggagcgttgtcggcgtcgctccctgtttccttggttcagatttcaatcaggaacaacaacttaagcggtgtcttacttggtgaaagttttaagagcttgaggaggttgcaggtggtggatttcagctccaaccaattgagtggctctgttccctctgttttcttcgagcttccatcgttgcagcaattgacactatccttcaacaaattcacgaatctcgaggcaccttttaagggagtggaatcgcagagtggacttatagcggttgatctgagcaacaacaggcttcggggttttttgccgtcgttcatggcggtgatgcctaagctttcgtcgttgtcgttggagaataacgaattcacgggaagaataccgacccagttcggtgtgaaaacggtctttcccgaaaagggagtgtcttcgttcgggaggcttctgttgggtgggaattacttgctgggagggatacctcgacccttgttagcgctgaaacgcgattctgcgaacgtgagtttggttggtaactgcttatacaggtgccctcatagtttctttttctgccagggtggtcaacagaaatccttggcacagtgtaatagatttagccctccctcaacttaacttcgtacacgaaacctctttgattttcacttctagattctctctttttttaaaattttttttgttgatttatggtta

SEQ ID NO: 10953 - DNA, 2963 bp, Glycine max; identical to SEQ ID NO: 10589

SEQ ID NO: 10954 - DNA, 3797 bp, Glycine max; identical to SEQ ID NO: 10600

SEQ ID NO: 10955 - DNA, 2694 bp, Vitis vinifera; identical to SEQ ID NO: 10598

SEQ ID NO: 10956 - DNA, 2708 bp, Zinnia violacea; identical to SEQ ID NO: 10626

SEQ ID NO: 10957 - DNA, 3794 bp, Glycine max; identical to SEQ ID NO: 10602

SEQ ID NO: 10958 - DNA, 2672 bp, Glycine max
atttccacgtctctttcattttcacaaacacacacactttcttcctttctttcttctgtttaattttatttttaattttcttgcacgcaccgaaaccgccccttttcaaaggccaaaggctctctctattctctcactctttctttcctctctctgtttaatggttagggtttcgtagggccgtcatcggaatgttccagaaggcccttccttctctctttgccctttccaattccgttatacgacggcgtttcgtgccaaccatgcgttgaattgtttttttttttttctttttccttcagtggcggcagttctggtatggaaatgtatgatgtttctgaaactagaaatgcagatgcttatttgattgaaggcactgatttaaacttacatctgacaagcccaaatattcaacaatttcaagccatgtttaatgatggagcccctgaatttgttgctgatcagaacttgtattaccctgctgccaccaattatgggtattactgtacaggatttgaatcacccggagaatgggaggaccaccataggatttttggtgtagatggtcctgatattcagtacacaggtgcacaaaacgaaagttttccatatgtatattatacacctagctatggatttgcacagtctccatacaatccatacaatccttatattcctggtgcaatgataggagttgatggttcatttggaggagcagagcaatattactccctccccaattatcaaaacactatttcttcacctgcttatattcctgttgttcaacctgacaatttccctaacagttctgttgactcatcgtttgataccagtgcttctgtcagcagacctgatggaaaaggtttaaaacataagttcaattcagcttctggttcctttactaggaactcttcaaaatcattatcaaatcccacaagttccttggccaggatatcagaaggtccgagagataatactggggtgaagaaagatttgacaagtggcaggggttttcttaatatggcttcctcacctgccagaagcattgatgcctcgacccatgctgtagatatttccaatggaaatgttttgtcccatagtaatcaattaaaaatagcttcccctctgagtagtggattttctgattatggatctaatgctaatggacagtctgtggttgctaaacttcgaccaaaggttcatgtaggtaaaggactgagtgaagtaaatggaagttctgatgttttaggtgagcaaaatcggggcccgagaattagtaattataagtcaaaatttccactggctgtcaaagcctatgcaaataaaggagatgacaatacacaagagaatatcatcatttctactgatcaatataacagggaggatttccctgtcaattatgaaaatgcaaagttttttgttataaaatcgtacagtgaagatgatgtgcacaaaagcattaaatataatgtgtggtcatcaacacctcatggaaacaagaagctgcagagtactcatgaagatgctaagagaatagcttctggaaattttggaagctgccctatctttcttttcttttctgttaatgcaagtggtcaattttgtggggttgcagagatgattggacctgttgacttcaataaggacatggacttttggcagcaagataaatggagtgggagcttccctgtaaagtggcacatcataaaagatgtgccaaatgcaaattttaggcacattatactagagaacaatgagaacaaacctgtcactaatagcagagacacacaagagataatgtatagtaaaggtttggaaatgctgaaaatattcaaaaaccataatttgaagacatctttgcttgatgactttatgtattatgaaaatcgtcagaagatcatgcaggaagaaaaggccaagttgctaattagaagttttaaaaatccgttagtgttacccacattagaaccacctcgtaagttgaattttgtcattgacatccctccagttggtgatgagaaaaatgcaaagatggatgacgaggttgatagcctaaaacagatttcaagtgctggacatattgttagtagttctgagatcaccagcactacatctgtggatgaaaaggctgagaaaggttcagttgataaagaagatattgcttctgtccttaagattggttcagttactattaccccaaaacaggtggagactaaaccatctggcattagtgttgctaataaggaaccgcttgatgttatcacagtaggctcaatgcaaatcagagttaatggatttgccgagtcatccggttttttgaagattgggactattccccttgatccaagaacactacagctggacggaggttctcgtgttaaaaatggatcttaaaatttgcatataaatgtcaaggcacgttttggatctttaggaaaagatggatttaatgcctgcctgattgtgccactgttgggaagttgggtttctattcaatcttcttttactgcttttttgtttgctactgattgatacaaagggtcatactgatgtcatggatattttgagcggtgttgattcaaaatacttttaatgaaagtgtaaccctccttttgtatttcggtcgtcagcaataaatatacaaaggttgtttctttgttgcagattttcaa

SEQ ID NO: 10959 - DNA, 2491 bp, Glycine max
atgaaaacaattgttgtgccatgcatcgtgctgggtttcgtaggggtgttatcggaatgttccagaagacccttccttcactctttgccctctccaattccgtcatacgacggcgtttcgtgccaaccatgcattgaattgttttctttttcttctttttccttcagtggtagcagttctggtatggaaatgtatgatgtttctcaaactagaaatgcagatgcttatttgattgaaggcactgatttaaactcacatctaacaagcccaaatattcaacaatttcaagccatgtttaatgatggagcccctgaatttgttgttgatcagaacttgtattatcctgctgccaccaattatgggtattactgtacaggatttgaatcacccggagaatgggaggaccaccataggatttttggtgtagatggtcctgatattcagtacacaggtgcacaaaacgaaagttttccatatatatattatacacctagctatggatttgcacagtctccatacaatccatacaatccttatattcctggtgcaatgataggagttgatggttcatttggaggggcagagcaatattactccctccccaattatcaaaaccctatttcttcacatgcttatattcctcttgttcaaccagacaatttccctaatagttctgttgactcattgtttgataccagagcttctgtcagcagacctgatggaaaaggtttaaaacctaagttcaattcagcttctgtttcctttactaggaactcttcaaaatcattatcaaatcccacaagttccttacccaggatatcagaaggtccgagagattatactggggtgaagaaagatatgacaagtggcaggggttttcttaatatggcttcgtcacctgccagaagcattgatgcctcaacccatcctgtagatactatttccaatggaaatgttttgtcccatcataatcaattaaaaatagcttcctctctgagtagtggattttctgattatggatctaatgctaatggacagtctgtggttgctaaacttcgaccaaaggttcacattggtaaaggactgagtgatgtaaatggaagttctgatgttttaggtgagcaaaatcggggcccgagaattagtaattgtaagtcaaaatttccgctggctgtcaaagcctatacaaacataggagatggcaatacacaagagaatatcatcatttctactgatcaatataacagggaggatttccctgtcaactatgaaaatgcaaagttttttgttataaaatcatacagtgaagatgatgtgcacaaaagtattaaatataatgtgtggtcatcaacacctcatggaaacaagaagctgcagagtgctcatgaagatgctaagagaatagcttctggaaaatttggaagctgcccaatctttcttttcttttctgttaatgcaagtggtcaattttgtggggttgctgagatgattggacctgttgacttcaataaggacatggacttttggcagcaagataaatggagtgggagcttccctgtaaagtggtacatcataaaagatgtgtcaaatgcaaattttaggcacattatactagagaacaatgagaacaaacctgttactaatagcagagacacacaagagataatgtatagtaaaggtttggaaatgcttaaaatattcaaaaaccatcatttgaagacatctttgcttgatgactttatatattatgaaaatcgtcagaagatcatgctggaagaaaagaccaagttgctaatcagaagttttgaaaatccattaatgttacccacattagaaccacctcggaagttgaattttgtcgttgacatccctccagtcagtgttgagaagaaggcaaagatggatgatgagtttgatagcctaaaacagacttcaagtgctggacatattgttagtagttctgaggtcacaagcaccgcatctgtggatgaaaaggctgagaaaggttcagttgagaaagaagatattgcttctgtccttaagattggttcagttactattaccccaaaacaggtggagactaaaccatctggcattagtgttgctaataaggaaccgcttgatgttatcacagtaggctcaatgcaagtcaaagttaatggatttgccgagtcttcgggtcttttgaagattgggagtatcccacttgatccaagaacactacagctggacggaggtactcgtgttaaaaatggatcttaaagttttcttataaatgtcgaggcacgttttggatctttatgaaaagatggatcaatgcatgcctgattgtgccactgttgggaagttgggtttctattcaatcttttttttttactgcttttttgtttgctactgattgatataaagggtcatactgatgtcatggatctttcgagcggtgttgattcaaaatgcttttaatgaaagtgtaacctctctagtgtgaata

SEQ ID NO: 10960 - DNA, 2291 bp, Medicago truncatula
ctatatcacacacacactctctctctttctcgattcaatttttcattttcatttcgattgtctctcacacacaacaccgaaaccgcctttttcaaaggttatagggtctttctcttctctgttttgattttttagggtttcgtagaagctccattagaatgttccagaactctctctaatctctatatgagacttctcttcacaacactggcttaattttttctttcccttttcaaagattgaaggtgctgatttatactcacaattaacaagcctacattttgaatttttaaccattcaaagacatgtttaacgaaggcgctcctgagtttgttgttgatcagagcatgtattaccctgctcccaccaattacgggttttattgtacaggatttgaatcacctggtgaatgggaggaccaccatagaatttttggtgtagatggtcctgatattcagtacacgggtgcacaagatgaaagttttccttatgtatattacacacctaactatggatttgcacagtccccatacaatccatacaatccttatattccaggtgctatgattggagttgatggttcatttggaggagaacagcagtattactccctccccaattatcaaaaccccatttcttcgccaacttacattcctcttgttcaaccagacaattttcatcatagttctgttgactcattatatgataacagtgcttctgtcaatagacttgatggaagaggttcgaaacataagttcaattcagcttctgctgcttttactaggaactcttcaaaaccatcatcaaatcagacaagttccttcctcagggtacccgaggggccaagagctaatgctttggcaaagaaagattcgacaaatggaagtgttcctaacagtggttttcttaattttgcttcatcaccttcccatctggctagaagcgctgatgtctcgttccagtctgtagatactttttccaatggaaatgttttgccccatcgtaatcaattcaaagtagctgccccgttgagtaacgggttttctgactatggatctaatgctaatgggcagtctgcaattgctaaacttcgaccaaaggttcatgttgctcccattgatgtaaatagaagcggtgtattattgggtgagcaaaatcggggccctagaattagtaggccaaaacatcatctgcctatcaaagcctatacagccaagtcaggagatgctaacacacaagagaacatcatttatactgatcaatataacagggaggacttccctattgacaatgaaattgctaagttttttgttataaaatcctacagtgaggatgacgttcacaaaagcattaaatataacgtgtggtcatcaacacctcatggaaacaagaaactgcagagtgcttatgaagatgctaggagaaaagctactggaaaatctggaggctgtcctatatttcttttcttttcggttaatgccagcggtcaattttgtggagttgctgagatggttggtcctgttgacttcaataaggatatggacttctggcagcaagataaatggagtgggagcttccctgtaaagtggcacatcataaaagatgtaccaaatggaaattttaggcacataatactagagaacaatgagttcaagcctgtaaccaacagccgagacacacaagagataatgtatagaaagggtctggaaatgctgaagatattcaaaaattatactttgaagacatctttgcttgatgactttatttactatgaaaaccgacagaaggtcatgcaggaggagaaaactaagttcctaatgaagggttttgtaagtataccagtgttggcgccacctcgaaagctggataatgtttttgaaattcatcctgcaagtgatgagaaaaattcaaagacagatgaacttggtagcgtaaaacatacttcagtttcaactgcggcacataatgttaatagttctgatgtcaccagcactacatctgtggatgaaaaggttgagaatgatgcggttgacaagcaagatatttcttctgttctgaagattggttcagtcaccattaccccaagacaggtagagacgaaaccatccaacacagaaccaattgatgttgtcacagtcggatcaatgcaagtcagagttaatggattttctgagtcttctggtgttttaaaggttgggagtattccacttgatccaagatctctacaggcaggcaaaggaaccacttacatcaaaacttgacctcatccttaagttttgctggggatgtct

SEQ ID NO: 10961 - DNA, 2358 bp, Glycine max; identical to SEQ ID NO: 10686

SEQ ID NO: 10962 - DNA, 2304 bp, Vitis vinifera; identical to SEQ ID NO: 10687

SEQ ID NO: 10963 - DNA, 2038 bp, Glycine max
aataaggcacgagtcccattattttcttcgtctattttggtgaaaaccataagtgggtatcctgaaaacactagattttcgattcgtttggtaagcggatttttaggtttgattattacgtttttctgttcttgttggatatggaggtttcggtgattggaagctctcaagcgaatctgggagcgtcggaattggcatctagggaagttggattttgcaatcttaagaacaatttaagggctttgaatgatagagttagttttggtaggaataatatacggtgggagaaggctgggattagcttcactttgagggctcttcagactgaacccgttagagaggagaagaagccttctgggattggaacaagatccaaaatggcaaatggtttaagattatttgtggggcttcccctagatgcagtttcttatgcctgcaattcaataaaccatgctagagcaatttcagctggcctaaaagctttgaagctcttaggagttgaaggtgttgagctccctatttggtggggaattgttgagaaagatgccatgggacaatatgactggtcaggctatcttgctattgctgagatggtccagaaagtgggtctcaagcttcatgtgtctctttgctttcatgggtctaagaaaccaaatatccccctacctaaatgggtatctcagattggtgaatctcaacccagtattttcttcacagataggtcaggacagcattataaagaatgcctgtccatggcagttgataatcttcctgttcttgatgggaagactccagtccaagtgtaccagagtttctgtgagagcttcaagtcttcattctctccattcatgggctctacaatcacgagcatttccatgggtttaggaccagatggtgagctacgttatccatctcaccactggctgccgagtaatggtaaaactcaaggtgctggggaattccagtgttatgaccaaaacatgctcagctttctcaagcaacatgctgaagcatctggaaatcctctgtgggggcttggtggtcctcatgatgcacctatctatgaccagcccccatacaatggcttcttcaatgatggggcttcttgggagtctacttatggggacttcttcctctcttggtattccaatcagctcatagctcatggagactgcctcctttcattagcatcttcaacttttggtgactctggagtggcgatctatggaaaaatccctcttatgcactcttggtatggaactcgatcccatccttcagagctaacagcagggttctataacacagttaacagggatggctatggaccagttgcacagatgtttgctcggaactcgtgcaaaattatattacctggcatggacctttcggacgcgaaccaaccaaaggaaaaccattctagccctgagttgctacttgcacaaattatggaagcttgcaaaaagcatgaggttcaggtttcaggtcaaaattcgtctgaatctggtgttccaggggggtttgaacaaattaagaagaatttatctggagataatgtattggacttgttcacatatcatagaatgggagcatcattcttctctccagagcattttcctttgttcactgagtttgtccggagccttaagcaaccggaactgcattcagatgatctacctgctgaggaggaagtaggtgctgaatccgccgtggttatgagccgtgattcaactgtgagcatgcaagcagcctaatggttgtaaatttgtaatctatgataatcatgtatataacaattagttattattatactacccttgcatcagtgcatgggatgagattgaggacaggttattttgtaagcataatatgaggatcccttttccttgtttattctaagcagagaccttatagttattccttataatgtagccaggtgggtggcagattgcctttttgtcatttgtgctcatgtggtatacatttctggtcaatattacttagcttaataagcaccagttttaaaaaaaaaaaaaaaaaa

SEQ ID NO: 10964 - DNA, 26 bp, Artificial sequence
  Single strand DNA oligonucleotide
tggcaggattctgtattaacggtgga

SEQ ID NO: 10965 - DNA, 21 bp, Artificial sequence
  Single strand DNA oligonucleotide
gcgtacaaggagccaagcatg

SEQ ID NO: 10966 - DNA, 24 bp, Artificial sequence
  Single strand DNA oligonucleotide
ggcgttcaataaagctgtgggaag

SEQ ID NO: 10967 - DNA, 23 bp, Artificial sequence
  Single strand DNA oligonucleotide
gcgctcaagaaagctgtgggaaa

SEQ ID NO: 10968 - DNA, 26 bp, Artificial sequence
  Single strand DNA oligonucleotide
ggcagaagaggtacaaggagatgaga

SEQ ID NO: 10969 - DNA, 24 bp, Artificial sequence
  Single strand DNA oligonucleotide
ggctttggactgaagggagctcta

SEQ ID NO: 10970 - DNA, 27 bp, Artificial sequence
  Single strand DNA oligonucleotide
tttggcttgacagaagatagagagcac

SEQ ID NO: 10971 - DNA, 24 bp, Artificial sequence
  Single strand DNA oligonucleotide
ggctttggattgaagggagctctt

SEQ ID NO: 10972 - DNA, 23 bp, Artificial sequence
  Single strand DNA oligonucleotide
gctttggattgaagggagctcct

SEQ ID NO: 10973 - DNA, 20 bp, Artificial sequence
  Single strand DNA oligonucleotide
caccggtggaggagtgagag

SEQ ID NO: 10974 - DNA, 23 bp, Artificial sequence
  Single strand DNA oligonucleotide
ggcggtggtggaaagatcaagat

SEQ ID NO: 10975 - DNA, 24 bp, Artificial sequence
  Single strand DNA oligonucleotide
cactcgaccaagggggtcgagtga

SEQ ID NO: 10976 - DNA, 23 bp, Artificial sequence
  Single strand DNA oligonucleotide
atggtggtactcggccaggtggt

SEQ ID NO: 10977 - DNA, 22 bp, Artificial sequence
  Single strand DNA oligonucleotide
gccgccttgcatcaactgaatc

SEQ ID NO: 10978 - DNA, 22 bp, Artificial sequence
  Single strand DNA oligonucleotide
gcatcgaaggagatggaggacg

SEQ ID NO: 10979 - DNA, 19 bp, Artificial sequence
  Single strand DNA oligonucleotide
actcagcctgggggtcgag

SEQ ID NO: 10980 - DNA, 23 bp, Artificial sequence
  Single strand DNA oligonucleotide
ggcacttgggtggtgctgattat

SEQ ID NO: 10981 - DNA, 25 bp, Artificial sequence
  Single strand DNA oligonucleotide
ggcaagaaggaggaacaacctgttg

SEQ ID NO: 10982 - DNA, 24 bp, Artificial sequence
  Single strand DNA oligonucleotide
tggcggtggatacttcttgatcgg

SEQ ID NO: 10983 - DNA, 24 bp, Artificial sequence
  Single strand DNA oligonucleotide
ggcttagctgaagaagcagaggag

SEQ ID NO: 10984 - DNA, 21 bp, Artificial sequence
  Single strand DNA oligonucleotide
tgcagttcctggaggtggagg

SEQ ID NO: 10985 - DNA, 21 bp, Artificial sequence
  Single strand DNA oligonucleotide
cgtgggaggactccaagtgtg

SEQ ID NO: 10986 - DNA, 22 bp, Artificial sequence
  Single strand DNA oligonucleotide
gccttgtggagaggaagcaaga

SEQ ID NO: 10987 - DNA, 22 bp, Artificial sequence
  Single strand DNA oligonucleotide
gcggtggtgaagaagcatggtt

SEQ ID NO: 10988 - DNA, 23 bp, Artificial sequence
  Single strand DNA oligonucleotide
gctgaggcgtatcaggaggtagt

SEQ ID NO: 10989 - DNA, 24 bp, Artificial sequence
  Single strand DNA oligonucleotide
ggcgaggtttgcgatgagaaagag

SEQ ID NO: 10990 - DNA, 23 bp, Artificial sequence
  Single strand DNA oligonucleotide
gctcatcggagaaacagaggagc

SEQ ID NO: 10991 - DNA, 21 bp, Artificial sequence
  Single strand DNA oligonucleotide
ggaagaggcagtgcatgggta

SEQ ID NO: 10992 - DNA, 25 bp, Artificial sequence
  Single strand DNA oligonucleotide
ggctttcttgtggaggaagcaagat

SEQ ID NO: 10993 - DNA, 24 bp, Artificial sequence
  Single strand DNA oligonucleotide
gcattgagtgcagcgttgatgaac

SEQ ID NO: 10994 - DNA, 29 bp, Artificial sequence
  Single strand DNA oligonucleotide
catttggctaatctgcatcctgaggttta

SEQ ID NO: 10995 - DNA, 22 bp, Artificial sequence
  Single strand DNA oligonucleotide
cgcgtatgaggagccatgcata

SEQ ID NO: 10996 - DNA, 22 bp, Artificial sequence
  Single strand DNA oligonucleotide
tggaggcagcggttcatcgatc

SEQ ID NO: 10997 - DNA, 27 bp, Artificial sequence
  Single strand DNA oligonucleotide
ggcttgtagagaaagagaagagagcac

SEQ ID NO: 10998 - DNA, 24 bp, Artificial sequence
  Single strand DNA oligonucleotide
tggagtgggagtgggagtagggtg

SEQ ID NO: 10999 - DNA, 23 bp, Artificial sequence
  Single strand DNA oligonucleotide
gcttgagccgcgtcaatatctcc

SEQ ID NO: 11000 - DNA, 26 bp, Artificial sequence
  Single strand DNA oligonucleotide
gccgacaacaacaacaagaagaagag

SEQ ID NO: 11001 - DNA, 21 bp, Artificial sequence
  Single strand DNA oligonucleotide
tggtgtgcagggggtggaata

SEQ ID NO: 11002 - DNA, 26 bp, Artificial sequence
  Single strand DNA oligonucleotide
tggctctcattccatacatcgtctga

SEQ ID NO: 11003 - DNA, 21 bp, Artificial sequence
  Single strand DNA oligonucleotide
cgagtccgaggaaggaactcc

SEQ ID NO: 11004 - DNA, 26 bp, Artificial sequence
  Single strand DNA oligonucleotide
tttggcacagaagatagagagcacag

SEQ ID NO: 11005 - DNA, 25 bp, Artificial sequence
  Single strand DNA oligonucleotide
tggctgacagaagactagagagcac

SEQ ID NO: 11006 - DNA, 25 bp, Artificial sequence
  Single strand DNA oligonucleotide
tggctttggattgaagggagctcta

SEQ ID NO: 11007 - DNA, 23 bp, Artificial sequence
  Single strand DNA oligonucleotide
gcagctgcttagctatggatccc

SEQ ID NO: 11008 - DNA, 24 bp, Artificial sequence
  Single strand DNA oligonucleotide
ggctcaaagggagttgtaggggaa

SEQ ID NO: 11009 - DNA, 26 bp, Artificial sequence
  Single strand DNA oligonucleotide
gcaagaaagctgtgggagaatatggc

SEQ ID NO: 11010 - DNA, 24 bp, Artificial sequence
  Single strand DNA oligonucleotide
aagtgatgacgtggtagacggagt

SEQ ID NO: 11011 - DNA, 22 bp, Artificial sequence
  Single strand DNA oligonucleotide
tacgcaggagagatgacgctgt

SEQ ID NO: 11012 - DNA, 21 bp, Artificial sequence
  Single strand DNA oligonucleotide
agtggcgtagatccccacaac

SEQ ID NO: 11013 - DNA, 20 bp, Artificial sequence
  Single strand DNA oligonucleotide
acgggtcgctctcacctagg

SEQ ID NO: 11014 - DNA, 24 bp, Artificial sequence
  Single strand DNA oligonucleotide
tcttcccaattccgcccattccta

SEQ ID NO: 11015 - DNA, 24 bp, Artificial sequence
  Single strand DNA oligonucleotide
gctatggggggattgggaaggaat

SEQ ID NO: 11016 - DNA, 20 bp, Artificial sequence
  Single strand DNA oligonucleotide
tcggcaagttggccttggct

SEQ ID NO: 11017 - DNA, 24 bp, Artificial sequence
  Single strand DNA oligonucleotide
ggctcttccctacacctcccatac

SEQ ID NO: 11018 - DNA, 29 bp, Artificial sequence
  Single strand DNA oligonucleotide
catttggcttgacagaagatagagagcat

SEQ ID NO: 11019 - DNA, 22 bp, Artificial sequence
  Single strand DNA oligonucleotide
cggaatgggctgtttgggaaca

SEQ ID NO: 11020 - DNA, 23 bp, Artificial sequence
  Single strand DNA oligonucleotide
gctcaaagggaggtgtggagtag

SEQ ID NO: 11021 - DNA, 23 bp, Artificial sequence
  Single strand DNA oligonucleotide
gcattggattgaagggagctcct

SEQ ID NO: 11022 - DNA, 24 bp, Artificial sequence
  Single strand DNA oligonucleotide
ggccttggattgaagggagctcta

SEQ ID NO: 11023 - DNA, 24 bp, Artificial sequence
  Single strand DNA oligonucleotide
ggctcgataaacctctgcatccag

SEQ ID NO: 11024 - DNA, 20 bp, Artificial sequence
  Single strand DNA oligonucleotide
caacgaggaggccgggacca

SEQ ID NO: 11025 - DNA, 23 bp, Artificial sequence
  Single strand DNA oligonucleotide
gctggaaagttgggagattgggg

SEQ ID NO: 11026 - DNA, 21 bp, Artificial sequence
  Single strand DNA oligonucleotide
gagaggaggacggagtggggc

SEQ ID NO: 11027 - DNA, 26 bp, Artificial sequence
  Single strand DNA oligonucleotide
gctgagaacaataggcatgggaggta

SEQ ID NO: 11028 - DNA, 26 bp, Artificial sequence
  Single strand DNA oligonucleotide
gctatggatggaggtgtaacccgatg

SEQ ID NO: 11029 - DNA, 25 bp, Artificial sequence
  Single strand DNA oligonucleotide
cgtgtttggtttagggatgaggtgg

SEQ ID NO: 11030 - DNA, 26 bp, Artificial sequence
  Single strand DNA oligonucleotide
gcaatgttattgtagcgtggtggtgt

SEQ ID NO: 11031 - DNA, 24 bp, Artificial sequence
  Single strand DNA oligonucleotide
ggctttccttgggaaggtggtttc

SEQ ID NO: 11032 - DNA, 20 bp, Artificial sequence
  Single strand DNA oligonucleotide
gcggcgaggggatgcgagcg

SEQ ID NO: 11033 - DNA, 22 bp, Artificial sequence
  Single strand DNA oligonucleotide
ttggcctcgtcgaagaaggaga

SEQ ID NO: 11034 - DNA, 24 bp, Artificial sequence
  Single strand DNA oligonucleotide
ggctggctatattttgggacggag

SEQ ID NO: 11035 - DNA, 21 bp, Artificial sequence
  Single strand DNA oligonucleotide
gctggaggatgcgacggtgct

SEQ ID NO: 11036 - DNA, 22 bp, Artificial sequence
  Single strand DNA oligonucleotide
ccctgtgacgttggtgaaggtg

SEQ ID NO: 11037 - DNA, 22 bp, Artificial sequence
  Single strand DNA oligonucleotide
tggactgtttgggggagcttct

SEQ ID NO: 11038 - DNA, 22 bp, Artificial sequence
  Single strand DNA oligonucleotide
ggtttgccggagttggaggaga

SEQ ID NO: 11039 - DNA, 23 bp, Artificial sequence
  Single strand DNA oligonucleotide
cgcgccgacgatgacggtggagt

SEQ ID NO: 11040 - DNA, 25 bp, Artificial sequence
  Single strand DNA oligonucleotide
gcagggattttggaaggaggtgaca

SEQ ID NO: 11041 - DNA, 23 bp, Artificial sequence
  Single strand DNA oligonucleotide
ggtggaggtggagctgtgccaaa

SEQ ID NO: 11042 - DNA, 21 bp, Artificial sequence
  Single strand DNA oligonucleotide
gagagcaggatgcagccaagg

SEQ ID NO: 11043 - DNA, 20 bp, Artificial sequence
  Single strand DNA oligonucleotide
ccatcggtgttggaggtggc

SEQ ID NO: 11044 - DNA, 21 bp, Artificial sequence
  Single strand DNA oligonucleotide
aaaccgtgcaaaggaggtccc

SEQ ID NO: 11045 - DNA, 21 bp, Artificial sequence
  Single strand DNA oligonucleotide
acgcggaggaggtggtgttct

SEQ ID NO: 11046 - DNA, 24 bp, Artificial sequence
  Single strand DNA oligonucleotide
gcgtcttataacctgaaacggggg

SEQ ID NO: 11047 - DNA, 20 bp, Artificial sequence
  Single strand DNA oligonucleotide
tggcgctagaaggagggcct

SEQ ID NO: 11048 - DNA, 23 bp, Artificial sequence
  Single strand DNA oligonucleotide
gcttccggtggtgaggaagatag

SEQ ID NO: 11049 - DNA, 23 bp, Artificial sequence
  Single strand DNA oligonucleotide
gctcggaccaggcatcattcctt

SEQ ID NO: 11050 - DNA, 21 bp, Artificial sequence
  Single strand DNA oligonucleotide
gagctgtccaggctgtgaggg

SEQ ID NO: 11051 - DNA, 24 bp, Artificial sequence
  Single strand DNA oligonucleotide
gcgtagcttagcgaggtgttggta

SEQ ID NO: 11052 - DNA, 23 bp, Artificial sequence
  Single strand DNA oligonucleotide
gccttggattgaagggagctcca

SEQ ID NO: 11053 - DNA, 26 bp, Artificial sequence
  Single strand DNA oligonucleotide
tttggccagaagatagagagcacatc

SEQ ID NO: 11054 - DNA, 25 bp, Artificial sequence
  Single strand DNA oligonucleotide
ttggccagaagatagagagcacaac

SEQ ID NO: 11055 - DNA, 21 bp, Artificial sequence
  Single strand DNA oligonucleotide
ccggaccaggcttcatcccag

SEQ ID NO: 11056 - DNA, 21 bp, Artificial sequence
  Single strand DNA oligonucleotide
tcggaccaggctccattcctt

SEQ ID NO: 11057 - DNA, 23 bp, Artificial sequence
  Single strand DNA oligonucleotide
gccattgacagggaaactcacca

SEQ ID NO: 11058 - DNA, 23 bp, Artificial sequence
  Single strand DNA oligonucleotide
ttggcggtgattgaacggagggt

SEQ ID NO: 11059 - DNA, 20 bp, Artificial sequence
  Single strand DNA oligonucleotide
tggtgcacctggtggtggag

SEQ ID NO: 11060 - DNA, 23 bp, Artificial sequence
  Single strand DNA oligonucleotide
tcctttggggagatggagagctt

SEQ ID NO: 11061 - DNA, 25 bp, Artificial sequence
  Single strand DNA oligonucleotide
tggcttggattgaagggagctctaa

SEQ ID NO: 11062 - DNA, 23 bp, Artificial sequence
  Single strand DNA oligonucleotide
ggctttggaaagcaagtgaggtg

SEQ ID NO: 11063 - DNA, 20 bp, Artificial sequence
  Single strand DNA oligonucleotide
ttggggagctggactctgga

SEQ ID NO: 11064 - DNA, 21 bp, Artificial sequence
  Single strand DNA oligonucleotide
gttgggcttgctgctggagga

SEQ ID NO: 11065 - DNA, 23 bp, Artificial sequence
  Single strand DNA oligonucleotide
gccatctaggtggtggtccagtg

SEQ ID NO: 11066 - DNA, 20 bp, Artificial sequence
  Single strand DNA oligonucleotide
tgggaacgtggctgtggcta

SEQ ID NO: 11067 - DNA, 24 bp, Artificial sequence
  Single strand DNA oligonucleotide
tggccagaagatagagagcactga

SEQ ID NO: 11068 - DNA, 21 bp, Artificial sequence
  Single strand DNA oligonucleotide
cctgcaaacctaagggagcgg

SEQ ID NO: 11069 - DNA, 24 bp, Artificial sequence
  Single strand DNA oligonucleotide
aagatggagaagcagggcacgtgc

SEQ ID NO: 11070 - DNA, 22 bp, Artificial sequence
  Single strand DNA oligonucleotide
gccaacttagagttgggggtgg

SEQ ID NO: 11071 - DNA, 23 bp, Artificial sequence
  Single strand DNA oligonucleotide
cttgtcgcaggagagatggcgct

SEQ ID NO: 11072 - DNA, 24 bp, Artificial sequence
  Single strand DNA oligonucleotide
gccaaggctctgataccatgtcaa

SEQ ID NO: 11073 - DNA, 23 bp, Artificial sequence
  Single strand DNA oligonucleotide
ggccaaggctctgataccatgtt

SEQ ID NO: 11074 - DNA, 24 bp, Artificial sequence
  Single strand DNA oligonucleotide
ccttggtgaatggttgggaggaat

SEQ ID NO: 11075 - DNA, 22 bp, Artificial sequence
  Single strand DNA oligonucleotide
cccaacttggaggtgggtgtgg

SEQ ID NO: 11076 - DNA, 23 bp, Artificial sequence
  Single strand DNA oligonucleotide
gcgaaagtgtggagaaggttgcc

SEQ ID NO: 11077 - DNA, 21 bp, Artificial sequence
  Single strand DNA oligonucleotide
ggcagagcatggatggagcta

SEQ ID NO: 11078 - DNA, 23 bp, Artificial sequence
  Single strand DNA oligonucleotide
ggcgtaatctgcatcctgaggtt

SEQ ID NO: 11079 - DNA, 21 bp, Artificial sequence
  Single strand DNA oligonucleotide
ggaggggctgcaagacccaag

SEQ ID NO: 11080 - DNA, 23 bp, Artificial sequence
  Single strand DNA oligonucleotide
gtcgacctggcgagtcaaccggg

SEQ ID NO: 11081 - DNA, 24 bp, Artificial sequence
  Single strand DNA oligonucleotide
ggctttggattgaagggagctctg

SEQ ID NO: 11082 - DNA, 26 bp, Artificial sequence
  Single strand DNA oligonucleotide
gctggaaaaaggaggtgcattcttgt

SEQ ID NO: 11083 - DNA, 25 bp, Artificial sequence
  Single strand DNA oligonucleotide
tggcctgacagaagatagagagcac

SEQ ID NO: 11084 - DNA, 22 bp, Artificial sequence
  Single strand DNA oligonucleotide
cggttgggctgtatgatggcga

SEQ ID NO: 11085 - DNA, 25 bp, Artificial sequence
  Single strand DNA oligonucleotide
tggctaatctgcatcctgaggtcta

SEQ ID NO: 11086 - DNA, 22 bp, Artificial sequence
  Single strand DNA oligonucleotide
gcttggcattctgtccacctcc

SEQ ID NO: 11087 - DNA, 23 bp, Artificial sequence
  Single strand DNA oligonucleotide
ggctgaagctgccacatgatctg

SEQ ID NO: 11088 - DNA, 24 bp, Artificial sequence
  Single strand DNA oligonucleotide
ggcttccacagctttcttgaactg

SEQ ID NO: 11089 - DNA, 21 bp, Artificial sequence
  Single strand DNA oligonucleotide
tgtgttctcaggtcgcccccg

SEQ ID NO: 11090 - DNA, 24 bp, Artificial sequence
  Single strand DNA oligonucleotide
tggctcttccttgttcctcccatt

SEQ ID NO: 11091 - DNA, 1572 bp, Artificial sequence
  miR resistant mutant
atgagtagcatgacaagtgggggtgatacccggaagatatccaaaggtcgttggtcatcatcattagatgaaaaagttggagttggaggtaacgtgggaggagaaggtcctctgaagaaaggcccatggactgcagcagaggatgcaattttggtagaatatgtcaaaaagcacggacaaggcaattggaatgcagtacaaaagcattcaggacttgcccgttgtgggaaaagctgccgtctacgatgggcaaatcatttgagaccagatctaaagaaaggtgcatttactgccgaggaagagaaccgaatccttgaactccatgctaagatgggaaacaaatgggctcgaatggctgcagagttgccaggacgtacggataatgagatcaagaactactggaacacaagaatcaaaagaatgcaacgagcaggcttaccaatctaccctgaagaattgtgccaacggatacttaatggcaatcaagaaagtcaaaatgttggcaccatgacaaatgaagcatgccatcatgatgatctgtcacaaacaaacaattttgatataccagatgtagaattcaaaaatttcaaattccgtcatggtctaccacatgtaccatcgatttttgatatgcctgaaagcagcttgtttgatcaaagctctgactcatcccatagttataacttcttgttcccaaccatgcgtcctacaaaacgccctcgggagtcagaaatgctatacgatagttttggcagttgttcaattaatgctgccccactatttgatcagtatggcaattatacgtttgagaaaatttctgaccatcctgggttgtctcttccatgtgatcccgttcttaacaccactgatcagtttcatggtgataaccttaccggcagccatgccgcattaaatggcaatgcctctgcttctgtgcccatatttggggccatgaagctagaattaccaagcttacagtacccagaaactcaacatggtagctggggcccgcctatgtccccacttccttcactggagtctgttgatacattgattcagtctcctacacttgagcctattctatcagatcccatttctccacaaagcagtggtttgctagaagcgatagtctacaactcgaaaagcttgaaaggctcaaacaatgatttattattgcaagagacaattgctacagccaatgaagtagctaatatttcaaccttgaatcattcctttcagacagaatgggatgaactaggcgatccaaattcccccttaggtcaatctgctgcttcagtcctgactgactatactcctgtacgaatgtgctctgtggatgggtatcaatcaactgaaaccagtcaggatcatgatgataagcatgaagcacctaccacccagttcccagatagttccagtaagaaaaaaatattgaaacaggtggattacacacagccagatgctttacttgacttgggttggtttgggaataatactaagtatgaaagcgatcaatttgttcagcaagatgctttgggtgcactttttggtgacaattgtcagcatcagcca

SEQ ID NO: 11092 - DNA, 1572 bp, Artificial sequence
  miR resistant mutant
atgagtagcatgacaagtgggggtgatacccggaagatatccaaaggtcgttggtcatcatcattagatgaaaaagttggagttggaggtaacgtgggaggagaaggtcctctgaagaaaggcccatggactgcagcagaggatgcaattttggtagaatatgtcaaaaagcacggacaaggcaattggaatgcagtacaaaagcattcaggacttgcccgttgtgggaaaagctgccgtctacgatgggcaaatcatttgagaccagatctaaagaaaggtgcatttactgccgaggaagagaaccgaatccttgaactccatgctaagatgggaaacaaatgggctcgaatggctgcagagttgccaggacgtacggataatgagatcaagaactactggaacacaagaatcaaaagaatgcaacgagcaggcttaccaatctaccctgaagaattgtgccaacggatacttaatggcaatcaagaaagtcaaaatgttggcaccatgacaaatgaagcatgccatcatgatgatctgtcacaaacaaacaattttgatataccagatgtagaattcaaaaatttcaaattccgtcatggtctaccacatgtaccatcgatttttgatatgcctgaaagcagcttgtttgatcaaagctctgactcatcccatagttataacttcttgttcccaaccatgcgtcctacaaaacgccctcgggagtcagaaatgctatacgatagttttggcagttgttcaattaatgctgccccactatttgatcagtatggcaattatacgtttgagaaaatttctgaccatcctgggttgtctcttccatgtgatcccgttcttaacaccactgatcagtttcatggtgataaccttaccggcagccatgccgcattaaatggcaatgcctctgcttctgtgcccatatttggggccatgaagttggaattaccaagcttacagtacccagaaactcaacatggtagctggggcccgcctatgtccccacttccttcactggagtctgttgatacattgattcagtctcctacacttgagcctattctatcagatcccatttctccacaaagcagtggtttgctagaagcgatagtctacaactcgaaaagcttgaaaggctcaaacaatgatttattattgcaagagacaattgctacagccaatgaagtagctaatatttcaaccttgaatcattcctttcagacagaatgggatgaactaggcgatccaaattcccccttaggtcaatctgctgcttcagtcctgactgactatactcctgtacgaatgtgctctgtggatgggtatcaatcaactgaaaccagtcaggatcatgatgataagcatgaagcacctaccacccagttcccagatagttccagtaagaaaaaaatattgaaacaggtggattacacacagccagatgctttacttgacttgggttggtttgggaataatactaagtatgaaagcgatcaatttgttcagcaagatgctttgggtgcactttttggtgacaattgtcagcatcagcca

SEQ ID NO: 11093 - DNA, 1785 bp, Artificial sequence
  miR resistant mutant
atggagaaagcgattgcgcgtgaacttgttcaacattttgccattggaacagggttttcagttttcactgttccattaagtttccgagctcaattcagcttccgattcgccgcgcgcaaaacgacttcgtttttggattttggcgtcgcgtcctattcagaagctatatactataagatgagacgaatgaagaaagatattgaagatgaggtgcttcccaatgatatgagtggggcacagttgaatgatgagagttatgaaggaagtgctggcattgttctgaagaaggggccatggacatcaactgaagatgatattttggtggattatgtcaagaagcatggggaggggaactggaatgctgttcagaagcacaccgggctgtttcgttgcggaaaaagttgtcggctgcggtgggccaatcacctaaggccaaatttaaagaaaggggcgtttgccgcagaagaggagcggctgattgctgaacttcatgccaaaatgggaaacaaatgggcacgcatggcagctcatttgcctggtcggacagataatgagataaagaactactggaacacccggatcaaaaggcgtcaacgggctgggttgccactttatcctccagaagtgagtttgcatgctttgcaagagagtcagcatagccaaagcactggtggacttaatggtggcgataaaatgcatcctgatttcttgcagaaaaacagttatgagatacatgatgctatatttgacagtctaaaggataatcagggaatcttaccttatgtgcatgagctttctgatatttctgtttatggcaataagctaaaaggtcttgattcttctcagtattgtagttttgtgccaccaacatcacctaagcgtaagcgtcttaaagagtcaacaataccatttattgattcctgtgctatgaaaaaaaaggatttatatccatttgatcaaattcaagacaataattctgataagattgcacaatcatttggaatgcaagcaccccttgatcctggtctctcctcgcacagttcaatgtgttacagccattcactttcaaatggcaactcctctacttctaagccttatgaggctatgaagctagaattaccaagcttacagtacccagaactcgatttaggtagctggggttcatctcctccaccttctttgctcgagtcagttgatgatttccttcagtctcctacagcaattagtacactggagtcagattgttcttctccacaaaatagtggccttctggatgctttactttatcaggcaaagactatgagcagttcaaagaaccattgttctgataagagttcaaattcttctactgcaacccctggtgacagagctgacagctctattttgaatgtgtacgagacagaatgggaagattatgctgaccctgtatctccctttggtgccacttcaatattgaatgagtgcccagctcttagagccaatgcaaattcattgaacggacagctgccagttcagacctttactggcaaccttccgaaattagaatctgttgaccaggtttggactcctaacaatgaaaatctaaccttgtccctgttgaatattactcgtccagacttcttgcttgcttcagattggtatgacctaggttctggacattgcaagaaccaaaccatcacaactgatgctgcaacggcctttcttggagatgatttagccactgacctcaagcatatgactgctggaatttctaaaactatgtttgaaaatccattccagcccctc

SEQ ID NO: 11094 - DNA, 1785 bp, Artificial sequence
  miR resistant mutant
atggagaaagcgattgcgcgtgaacttgttcaacattttgccattggaacagggttttcagttttcactgttccattaagtttccgagctcaattcagcttccgattcgccgcgcgcaaaacgacttcgtttttggattttggcgtcgcgtcctattcagaagctatatactataagatgagacgaatgaagaaagatattgaagatgaggtgcttcccaatgatatgagtggggcacagttgaatgatgagagttatgaaggaagtgctggcattgttctgaagaaggggccatggacatcaactgaagatgatattttggtggattatgtcaagaagcatggggaggggaactggaatgctgttcagaagcacaccgggctgtttcgttgcggaaaaagttgtcggctgcggtgggccaatcacctaaggccaaatttaaagaaaggggcgtttgccgcagaagaggagcggctgattgctgaacttcatgccaaaatgggaaacaaatgggcacgcatggcagctcatttgcctggtcggacagataatgagataaagaactactggaacacccggatcaaaaggcgtcaacgggctgggttgccactttatcctccagaagtgagtttgcatgctttgcaagagagtcagcatagccaaagcactggtggacttaatggtggcgataaaatgcatcctgatttcttgcagaaaaacagttatgagatacatgatgctatatttgacagtctaaaggataatcagggaatcttaccttatgtgcatgagctttctgatatttctgtttatggcaataagctaaaaggtcttgattcttctcagtattgtagttttgtgccaccaacatcacctaagcgtaagcgtcttaaagagtcaacaataccatttattgattcctgtgctatgaaaaaaaaggatttatatccatttgatcaaattcaagacaataattctgataagattgcacaatcatttggaatgcaagcaccccttgatcctggtctctcctcgcacagttcaatgtgttacagccattcactttcaaatggcaactcctctacttctaagccttatgaggctatgaagttggaattaccaagcttacagtacccagaactcgatttaggtagctggggttcatctcctccaccttctttgctcgagtcagttgatgatttccttcagtctcctacagcaattagtacactggagtcagattgttcttctccacaaaatagtggccttctggatgctttactttatcaggcaaagactatgagcagttcaaagaaccattgttctgataagagttcaaattcttctactgcaacccctggtgacagagctgacagctctattttgaatgtgtacgagacagaatgggaagattatgctgaccctgtatctccctttggtgccacttcaatattgaatgagtgcccagctcttagagccaatgcaaattcattgaacggacagctgccagttcagacctttactggcaaccttccgaaattagaatctgttgaccaggtttggactcctaacaatgaaaatctaaccttgtccctgttgaatattactcgtccagacttcttgcttgcttcagattggtatgacctaggttctggacattgcaagaaccaaaccatcacaactgatgctgcaacggcctttcttggagatgatttagccactgacctcaagcatatgactgctggaatttctaaaactatgtttgaaaatccattccagcccctc

SEQ ID NO: 11095 - DNA, 1476 bp, Artificial sequence
  miR resistant mutant
atgagtagtgtgactagtgggggtgataatcgaaaaatatccaaaggtcgtcggtcatcatcattagaggaagaagctggagttggaggtaacataagaggagaaagtcctctgaagaaaggcccatggactgcagcagaggatgcaattttggtagaatatgccaaaaaacacggacaaggcaattggaatgcagtacataaatattcaggacttgcccgttgtgggaaaagctgccgtctacgatgggcaaatcatttgagaccagatctaaaaaaaggtgaatttactgcagaagaagagaatcgaatccttgaactacatgctaagatgggaaacaaatgggctcgaatggctgcagagttgcctggacgtacggataatgagatcaagaactactggaacacaagaatcaaaagaatgcaacgagcaggcttaccaatctaccctgaagaattgtgccaacggatacttaattgcaatcaagaaagtcaaaatattagcatcctgtcaaatgaagcctcccagcatggtgatctgtcacaaacagactttgatataccagacgtggaattcaaaattttcaaatttcgtcatggtctatcacatggacagtcaatatttgatatgcctgaaagtagcttgtttgatcaaagttcagactcatcccatagttataacttgttcccaactatgcgtcctacaaaacgccctcgggagtcagaaatgctatatgatagttttgaaagttgtacaattaatgctgccccactatttgatcagtatgacaattatacttctgaaaaaatttctgaccatcctaggttgtctcttccacgtgatcccgttcttaacaccaatgatcagtttaatggtgataaccttaccggcagccatgccgcattaaatggcaatgcctcttcttctgtgcccatgtttagggccatgaagctagaattaccaagcttacagtaccctgaaactcaacatggtagctggggcacgcctacgtccccgcttccttcactcgagtctgttgatacattgattcagtctcctgttgttgagcctattctattagatcccatttctccgcagagcagtggtttgctggaagcgatagtccacaactcgaaaagcttgaaaggctcaaacaatgatttattattacaagaaacaattggtacaaccaatgaagtagctaagagttcaaccttgaatcattcctttcagacaaaatggtatgaactaggggagccaaattccccctttgatcatgatgataagcatgaagcactcaccacccaatttccagacagttccaggaagaaaaaaaatatattgaaacagatggattatacacagccagatgctttacttgacttaggttggtttgggaatagcaccgagtatggaagtgatcaatctgttctgcaagatgctttaagtgcacttcttggtgaagattgtcagcgc

SEQ ID NO: 11096 - DNA, 1476 bp, Artificial sequence
  miR resistant mutant
atgagtagtgtgactagtgggggtgataatcgaaaaatatccaaaggtcgtcggtcatcatcattagaggaagaagctggagttggaggtaacataagaggagaaagtcctctgaagaaaggcccatggactgcagcagaggatgcaattttggtagaatatgccaaaaaacacggacaaggcaattggaatgcagtacataaatattcaggacttgcccgttgtgggaaaagctgccgtctacgatgggcaaatcatttgagaccagatctaaaaaaaggtgaatttactgcagaagaagagaatcgaatccttgaactacatgctaagatgggaaacaaatgggctcgaatggctgcagagttgcctggacgtacggataatgagatcaagaactactggaacacaagaatcaaaagaatgcaacgagcaggcttaccaatctaccctgaagaattgtgccaacggatacttaattgcaatcaagaaagtcaaaatattagcatcctgtcaaatgaagcctcccagcatggtgatctgtcacaaacagactttgatataccagacgtggaattcaaaattttcaaatttcgtcatggtctatcacatggacagtcaatatttgatatgcctgaaagtagcttgtttgatcaaagttcagactcatcccatagttataacttgttcccaactatgcgtcctacaaaacgccctcgggagtcagaaatgctatatgatagttttgaaagttgtacaattaatgctgccccactatttgatcagtatgacaattatacttctgaaaaaatttctgaccatcctaggttgtctcttccacgtgatcccgttcttaacaccaatgatcagtttaatggtgataaccttaccggcagccatgccgcattaaatggcaatgcctcttcttctgtgcccatgtttagggccatgaagttggaattaccaagcttacagtaccctgaaactcaacatggtagctggggcacgcctacgtccccgcttccttcactcgagtctgttgatacattgattcagtctcctgttgttgagcctattctattagatcccatttctccgcagagcagtggtttgctggaagcgatagtccacaactcgaaaagcttgaaaggctcaaacaatgatttattattacaagaaacaattggtacaaccaatgaagtagctaagagttcaaccttgaatcattcctttcagacaaaatggtatgaactaggggagccaaattccccctttgatcatgatgataagcatgaagcactcaccacccaatttccagacagttccaggaagaaaaaaaatatattgaaacagatggattatacacagccagatgctttacttgacttaggttggtttgggaatagcaccgagtatggaagtgatcaatctgttctgcaagatgctttaagtgcacttcttggtgaagattgtcagcgc

SEQ ID NO: 11097 - DNA, 1530 bp, Artificial sequence
  miR resistant mutant
atgagtcaaatgacaaatgaggtcgacaacaatgtgcattatgatgatcagactgggtcacagttaaatgatgatggtaatggagtaggtgttgttctgaagaaagggccatggacagctgctgaagatgctcttctggtgaactatgtccagaagcatggagaggggaactggaatgctgttcagaattactcaggcctgtctcgttgcggaaaaagctgtagactgcgatgggccaatcacctaaggccaaatttaaagaaaggagcatttaccgcagaagaggagcggatgattgctgaactccacgccaaaatgggaaacaaatgggcacgcatggcagcgcacttgcctggtcgtacagataatgaaataaaaaattactggaacacccggatgaagaggcggcgacgggctggcttgccactttatcctcctgaagtacttttgcaagcatttcaagagagaaagcatggccaaggtactggtgaaattagcgatggtgatggagggcatcgtgatttcttgaagaaaaacaattacgagatacatgatgcaatatttgacagtctgaaggaaaatcaaggaatcttaccttttttgcctgaccttcctgctatttctgctaatagctttcttccaaatggtcttggttctcctccatattgtaatttattgccatcaacattgccaaaccatgatcatcttcaagagtcaacaatgtcttttattggttccagtgaattgaacagcaatcgattttatccatttgaccatattaaggataatacttctgataagatttcagaatcatttggattgtattctccccttgatcgtggtgtctcacatggttcaatttgttacagccattcactatcgaatggcaattcctctacttctaagccgacttctgaggctgtgaagagcgaattaccaagcttacagataccagaaaccgaattcggtagttggggtacctctcccccacctccattgaacgagtctcttgatgttttcattcattctcctcaaccacctaatgcactagactcgggttcttcttcaccacttaatagtggcttgcttgatgcattactttatcaagcaaacactcttggttgttcaaagaataattcttctgacaagagttcaaattcttcaattgcaactcctggcgacagagctgagtgttctgctttgaacatgtacgagacagaatgggaggattatgctgaccctttatctccctttggagcaacttcaatcctgaatgagcatcctgttgttagcaccaatggaaactcatgggatgaatgggaactttttcagacctttagtggcaacaatgagagattgcagtcaattgaccaagtttggacccctaagagtgaaaatcaatccatgtctctgttgaatttcactctgccagatgtcttgataacttcagattggcacgagctgtattctgaccacgacagcacgaaccaagccatcatgactgaagctagtgatgatatcagtggacag

SEQ ID NO: 11098 - DNA, 1530 bp, Artificial sequence
  miR resistant mutant
atgagtcaaatgacaaatgaggtcgacaacaatgtgcattatgatgatcagactgggtcacagttaaatgatgatggtaatggagtaggtgttgttctgaagaaagggccatggacagctgctgaagatgctcttctggtgaactatgtccagaagcatggagaggggaactggaatgctgttcagaattactcaggcctgtctcgttgcggaaaaagctgtagactgcgatgggccaatcacctaaggccaaatttaaagaaaggagcatttaccgcagaagaggagcggatgattgctgaactccacgccaaaatgggaaacaaatgggcacgcatggcagcgcacttgcctggtcgtacagataatgaaataaaaaattactggaacacccggatgaagaggcggcgacgggctggcttgccactttatcctcctgaagtacttttgcaagcatttcaagagagaaagcatggccaaggtactggtgaaattagcgatggtgatggagggcatcgtgatttcttgaagaaaaacaattacgagatacatgatgcaatatttgacagtctgaaggaaaatcaaggaatcttaccttttttgcctgaccttcctgctatttctgctaatagctttcttccaaatggtcttggttctcctccatattgtaatttattgccatcaacattgccaaaccatgatcatcttcaagagtcaacaatgtcttttattggttccagtgaattgaacagcaatcgattttatccatttgaccatattaaggataatacttctgataagatttcagaatcatttggattgtattctccccttgatcgtggtgtctcacatggttcaatttgttacagccattcactatcgaatggcaattcctctacttctaagccgacttctgaggctgtgaagtcagaattaccatcattacagataccagaaaccgaattcggtagttggggtacctctcccccacctccattgaacgagtctcttgatgttttcattcattctcctcaaccacctaatgcactagactcgggttcttcttcaccacttaatagtggcttgcttgatgcattactttatcaagcaaacactcttggttgttcaaagaataattcttctgacaagagttcaaattcttcaattgcaactcctggcgacagagctgagtgttctgctttgaacatgtacgagacagaatgggaggattatgctgaccctttatctccctttggagcaacttcaatcctgaatgagcatcctgttgttagcaccaatggaaactcatgggatgaatgggaactttttcagacctttagtggcaacaatgagagattgcagtcaattgaccaagtttggacccctaagagtgaaaatcaatccatgtctctgttgaatttcactctgccagatgtcttgataacttcagattggcacgagctgtattctgaccacgacagcacgaaccaagccatcatgactgaagctagtgatgatatcagtggacag

SEQ ID NO: 11099 - DNA, 1530 bp, Artificial sequence
  miR resistant mutant
atgagtcaaatgacaaatgagattaactacaatgtgcactgcaatgatcaaactgggtcacagttaaatgatgagggcaatggagtaggtatggttctgaagaaagggccatggacagctgctgaagatgttcttttggtgaactatgtccagaagcatggagaggggaactggaatgctgttcagaagtactcaggcctgtctcgttgtggaaaaagttgtagactgcgatgggccaatcacctaaggccaaatttaaagaaaggagcatttaccgcagaagaggaacggatgattgctgaactccacgccaaaatgggaaacaaatgggcacgcatggcggcgcacttgcatggtcgtacagataacgaaataaaaaattactggaacactcggatgaagaggcggcaacgggctggcttgccactttatcctcccgaggtacttttgcaagcatttcaagagagaaagcatggccaaggtactggtgaaattagtaatggtgatggagggcatcatgatttcttgaagaaaaacaattatgagatacatgatgcaatatttgacagtctgaaggaaaatcaaggaatcttaccttttttgcctgaccttcctgctatttctgctaatagctttctgccaaattgtcttggttctcctccatattgtaattttttgccatcaacattacctaaccatgatcattttcaagagtcaaccatgtcttttattggttccagtgaattgaacagcaatgagttttatccatttgaccgtattaaggataataattctgataagatttcagaatcatttggattgtattctccccttgatcgtggtgcctcctcacatggctcaatttgttacagccattcactatcgaatggcaattcctctacttctaagctgatttctgaggctgcaaagagcgaattaccaagcttacagataccagaaaccgaatttggttgttggggtacctctcccccacctccattgaatgagtctcttgatgttttcattcattctcctcaaccacctaatgcactagactcaggttcttcaccacttaatagtggcttgcttgatgcattactttatcaagcaaatactcttggttgttcaaagaataattcttctgacaagagtttaaattcttcaattgcaactcctggtgacagagctgagagttctgctttgaacatgtatgagacagaatgggaggattatgctgaccctttatctccctttggagcaacttcaatcctgaatgagcatcctgttgttagcaccaatggaaactcatgggatgattgggaactttttcagacctttagtggcaacaatgagagattgcagtcagttgaccaggtttgggcccctaagagtggaaatcaatccatgtctctgttgaatctcactctgccagatgtcttgataacttcagattggcacgaactgtattctgaccacgatagcatgaaccaagctgtcatgactgaagctagtgatgatatcagtggacag

SEQ ID NO: 11100 - DNA, 1530 bp, Artificial sequence
  miR resistant mutant
atgagtcaaatgacaaatgagattaactacaatgtgcactgcaatgatcaaactgggtcacagttaaatgatgagggcaatggagtaggtatggttctgaagaaagggccatggacagctgctgaagatgttcttttggtgaactatgtccagaagcatggagaggggaactggaatgctgttcagaagtactcaggcctgtctcgttgtggaaaaagttgtagactgcgatgggccaatcacctaaggccaaatttaaagaaaggagcatttaccgcagaagaggaacggatgattgctgaactccacgccaaaatgggaaacaaatgggcacgcatggcggcgcacttgcatggtcgtacagataacgaaataaaaaattactggaacactcggatgaagaggcggcaacgggctggcttgccactttatcctcccgaggtacttttgcaagcatttcaagagagaaagcatggccaaggtactggtgaaattagtaatggtgatggagggcatcatgatttcttgaagaaaaacaattatgagatacatgatgcaatatttgacagtctgaaggaaaatcaaggaatcttaccttttttgcctgaccttcctgctatttctgctaatagctttctgccaaattgtcttggttctcctccatattgtaattttttgccatcaacattacctaaccatgatcattttcaagagtcaaccatgtcttttattggttccagtgaattgaacagcaatgagttttatccatttgaccgtattaaggataataattctgataagatttcagaatcatttggattgtattctccccttgatcgtggtgcctcctcacatggctcaatttgttacagccattcactatcgaatggcaattcctctacttctaagctgatttctgaggctgcaaagtcagaattaccatcattacagataccagaaaccgaatttggttgttggggtacctctcccccacctccattgaatgagtctcttgatgttttcattcattctcctcaaccacctaatgcactagactcaggttcttcaccacttaatagtggcttgcttgatgcattactttatcaagcaaatactcttggttgttcaaagaataattcttctgacaagagtttaaattcttcaattgcaactcctggtgacagagctgagagttctgctttgaacatgtatgagacagaatgggaggattatgctgaccctttatctccctttggagcaacttcaatcctgaatgagcatcctgttgttagcaccaatggaaactcatgggatgattgggaactttttcagacctttagtggcaacaatgagagattgcagtcagttgaccaggtttgggcccctaagagtggaaatcaatccatgtctctgttgaatctcactctgccagatgtcttgataacttcagattggcacgaactgtattctgaccacgatagcatgaaccaagctgtcatgactgaagctagtgatgatatcagtggacag

SEQ ID NO: 11101 - DNA, 1659 bp, Artificial sequence
  miR resistant mutant
atgagacaaatgaagatagatattgaagatgaggtgcttcccaatgatatgagtgggacacaattgaatgatgagagttatgaaggaggtgctggcattgttctgaagaaagggccatggacatcaactgaagatgatattttggtggattatgtcaagaagcatggggaggggaactggaatgctgttcagaagcacaccgggttgttacgttgcggaaaaagttgtcggctgcggtgggctaatcacctaaggccgaatttaaagaaaggggcgtttaccgcagaagaggagcgggtgattgctgaacttcatgccaaaatgggaaacaaatgggcacgcatggcagcgcatttgcctggtcgcacagataatgagataaagaactactggaacacccggatcaaaaggtgtcaaagggctgggttgccactttatcctccagaagtgagtttgcaagctttgcaagagagccagcatagccaaagctctggtggacttaatggtggcgaaaaaatgcatcctgatttcttgcagaaaaacagttttgagatacatgatggtatatttgacagtctgaaggataatcagggaatcttaccttatgtgcacgagctttctgatatttctgtttatggcaatatgctaaaaggtcttgattcttctcagtattgtagttttgtgccaccaacattacctaagtgtaagcgtcttaaagagtcaacaataccatttatcgattcctgtgatatgaaaaaatatgatttatattcatttgatcaaattcgagacaataattctaataagattgcacaatcatttggaatgcaagcaccccttgatcctggtccctcctcgcacagctcaatgtgttacagccattcactttcaaatggcaattcctctacttctaagccttatgaggctgtgaagctagaattaccaagcttacagtacccagaactcgatttaggtagctggggttcatcccccccaccttctttgctcgagtcagttgatgatttccttcagtctcctacaccaatcagtacactggagtcagattgttcttctccacaaaatagtggcctgctggatgctttactttatcaggcaaagactatgagcagttcaaagaaccattgttctgacaagagttcaaattcttctactgcaacccctggtgacagagctgacagctctgctttgaatgtgtacgagacagaatgggaagattatgctgatcctgtatctccctttggtgcaacttcaatattgaatgagtgcactggtcttagagccaatatgaattcattgaacgaacagctaccagttcagaccattactggcgaccttccaaatttagagtctgttgaccaggtttggacccctgacagtgaaaatcaaaccttgtccctgttgaataatacttgtccggacttcttgcttacttcagattggtatgacctaggttctgggcatggcaagaaccaggctatcagtactgatgctgcaacggcctttcttggagatgatttagccactgaccataaatatatgactgaaacactcgccaagtcaagtcaggtgtgggggtttggttgttgtgcaacggcagtgaataaaatgcttgctgtatttcagctgttcatccttggt

SEQ ID NO: 11102 - DNA, 1659 bp, Artificial sequence
  miR resistant mutant
atgagacaaatgaagatagatattgaagatgaggtgcttcccaatgatatgagtgggacacaattgaatgatgagagttatgaaggaggtgctggcattgttctgaagaaagggccatggacatcaactgaagatgatattttggtggattatgtcaagaagcatggggaggggaactggaatgctgttcagaagcacaccgggttgttacgttgcggaaaaagttgtcggctgcggtgggctaatcacctaaggccgaatttaaagaaaggggcgtttaccgcagaagaggagcgggtgattgctgaacttcatgccaaaatgggaaacaaatgggcacgcatggcagcgcatttgcctggtcgcacagataatgagataaagaactactggaacacccggatcaaaaggtgtcaaagggctgggttgccactttatcctccagaagtgagtttgcaagctttgcaagagagccagcatagccaaagctctggtggacttaatggtggcgaaaaaatgcatcctgatttcttgcagaaaaacagttttgagatacatgatggtatatttgacagtctgaaggataatcagggaatcttaccttatgtgcacgagctttctgatatttctgtttatggcaatatgctaaaaggtcttgattcttctcagtattgtagttttgtgccaccaacattacctaagtgtaagcgtcttaaagagtcaacaataccatttatcgattcctgtgatatgaaaaaatatgatttatattcatttgatcaaattcgagacaataattctaataagattgcacaatcatttggaatgcaagcaccccttgatcctggtccctcctcgcacagctcaatgtgttacagccattcactttcaaatggcaattcctctacttctaagccttatgaggctgtgaagttggaattaccaagcttacagtacccagaactcgatttaggtagctggggttcatcccccccaccttctttgctcgagtcagttgatgatttccttcagtctcctacaccaatcagtacactggagtcagattgttcttctccacaaaatagtggcctgctggatgctttactttatcaggcaaagactatgagcagttcaaagaaccattgttctgacaagagttcaaattcttctactgcaacccctggtgacagagctgacagctctgctttgaatgtgtacgagacagaatgggaagattatgctgatcctgtatctccctttggtgcaacttcaatattgaatgagtgcactggtcttagagccaatatgaattcattgaacgaacagctaccagttcagaccattactggcgaccttccaaatttagagtctgttgaccaggtttggacccctgacagtgaaaatcaaaccttgtccctgttgaataatacttgtccggacttcttgcttacttcagattggtatgacctaggttctgggcatggcaagaaccaggctatcagtactgatgctgcaacggcctttcttggagatgatttagccactgaccataaatatatgactgaaacactcgccaagtcaagtcaggtgtgggggtttggttgttgtgcaacggcagtgaataaaatgcttgctgtatttcagctgttcatccttggt

SEQ ID NO: 11103 - DNA, 2094 bp, Artificial sequence
  miR resistant mutant
atgccctttgcttctgcttccatggcaaaaaggagtgaagagctaggattaagcttaatgaacactgattctgctaaccatgacaggattcctggtggttgccacccgaatgatacaaccgcccctctgcctctggtttcaccatctcctttcccccactggaatttgcatgaaacatctcaacattataacaatgaaccagctggagttaattcaatgattgattcctctcagttcagaagttatcagaatttccagatggaccataattactcacacagagcagaagaacataatttccttccatgcagaccagattctcgttttccatgtccagaaggatacatagggtggccatatcaatatgacaggcacaataatctagcaatcccttccaatgtgcgaaacgcaagttttaacttgaacaattttgagaagcctgacaatggtgggatgtgtgtgaccccaatttacggttcggctagcaggctacaaatggtcaaccctactggaacagcaatgagtgctaatattggtcagccttcactagatatgaattcgggaatggctctgtgtaatccaaatcaaggttgtgtagaaccattgcttacaataggaaaacatgatgaaagatatatgaccatgggttctggaagtaataacaaagagtccaaatccagtgctgtaacaccaaaattcaatgtgactggtaattctgagagggcatttcttcctccaatcaattcatatcacaatcatctgggtagcagaagttccttaaaccctggttttgacatgaatgacaccttttctgcttttcagaatgacagtggattcatatctgatttagctccttcaggcaatcatgaagctctgtttgattctatacctggtttacggttggggccatcatatgcttttcaatggccagctgctggtgagcaaaaccgttatttagggcagttcaacagggatttaggtcttgcaggtgtgaaagacacaagtatggaatttacagatgtaggtctcacaaatggccttgaaagatgcatggatctaaattcattgccaattgttggcagtcaaactatgccttttgaaagtcgacagagctgggcgaatagacagctagttccctcttcaagtggagtagtaactgataatttgcctactgagatgttacctaaaaataatgataagttctcatcacagtttttttctagtcctcctttagctgtggccactagaagcaccagagggcaagatctttcaagtaatcctggtcaatcacaggcaggtggttctattcagcaatcaaactctcttcttcgaccacaatctacttctgatgtaggaatacaatccggaatgggatatatgactgctcaagtttcaaggccatccaacatgtcatctctaaagagagctgcttcccaaccactgtcatccactgtccagaatcaacacaggaagactctaccaactcagttcatacatccatcaattccaaattggaacagattggctccatcagtcccaaatacatcccgagcaatgtctcccttgatccgcccagcccaatctctcacagcccaagctcctcctcactctgttgttcctccatcattcccgacgacttggactaaatctgttcttcaagccccaaacacaacccgggcaattcatcccaaaatgcacacagctacatttcttgcacctaatgacaagagaatctcttctttccaccacccctcatcccatacttcacctcgtacaaaccaatctaaccatcaaatgttggctcaggctttggctcaccaacgtttgaaggctccaattataccatctgctccccgcattgcttccaattacattaaatttaaagatcaaacagcagaaccaagtggttataaatgccttttgtgcaagagggatctctcctacgcaccagaagggcctatttcccagccacctgttccgcctgctactgctgttctaccatgtggccacacctttcatgattactgtttggagcgaataacccctgatgaccaatccaaatatcctccatgcattccttgtgctcttctcgag

SEQ ID NO: 11104 - DNA, 2094 bp, Artificial sequence
  miR resistant mutant
atgccctttgcttctgcttccatggcaaaaaggagtgaagagctaggattaagcttaatgaacactgattctgctaaccatgacaggattcctggtggttgccacccgaatgatacaaccgcccctctgcctctggtttcaccatctcctttcccccactggaatttgcatgaaacatctcaacattataacaatgaaccagctggagttaattcaatgattgattcctctcagttcagaagttatcagaatttccagatggaccataattactcacacagagcagaagaacataatttccttccatgcagaccagattctcgttttccatgtccagaaggatacatagggtggccatatcaatatgacaggcacaataatctagcaatcccttccaatgtgaggaacgcaagttttaacttgaacaattttgagaagcctgacaatggtgggatgtgtgtgaccccaatttacggttcggctagcaggctacaaatggtcaaccctactggaacagcaatgagtgctaatattggtcagccttcactagatatgaattcgggaatggctctgtgtaatccaaatcaaggttgtgtagaaccattgcttacaataggaaaacatgatgaaagatatatgaccatgggttctggaagtaataacaaagagtccaaatccagtgctgtaacaccaaaattcaatgtgactggtaattctgagagggcatttcttcctccaatcaattcatatcacaatcatctgggtagcagaagttccttaaaccctggttttgacatgaatgacaccttttctgcttttcagaatgacagtggattcatatctgatttagctccttcaggcaatcatgaagctctgtttgattctatacctggtttacggttggggccatcatatgcttttcaatggccagctgctggtgagcaaaaccgttatttagggcagttcaacagggatttaggtcttgcaggtgtgaaagacacaagtatggaatttacagatgtaggtctcacaaatggccttgaaagatgcatggatctaaattcattgccaattgttggcagtcaaactatgccttttgaaagtcgacagagctgggcgaatagacagctagttccctcttcaagtggagtagtaactgataatttgcctactgagatgttacctaaaaataatgataagttctcatcacagtttttttctagtcctcctttagctgtggccactagaagcaccagagggcaagatctttcaagtaatcctggtcaatcacaggcaggtggttctattcagcaatcaaactctcttcttcgaccacaatctacttctgatgtaggaatacaatccggaatgggatatatgactgctcaagtttcaaggccatccaacatgtcatctctaaagagagctgcttcccaaccactgtcatccactgtccagaatcaacacaggaagactctaccaactcagttcatacatccatcaattccaaattggaacagattggctccatcagtcccaaatacatcccgagcaatgtctcccttgatccgcccagcccaatctctcacagcccaagctcctcctcactctgttgttcctccatcattcccgacgacttggactaaatctgttcttcaagccccaaacacaacccgggcaattcatcccaaaatgcacacagctacatttcttgcacctaatgacaagagaatctcttctttccaccacccctcatcccatacttcacctcgtacaaaccaatctaaccatcaaatgttggctcaggctttggctcaccaacgtttgaaggctccaattataccatctgctccccgcattgcttccaattacattaaatttaaagatcaaacagcagaaccaagtggttataaatgccttttgtgcaagagggatctctcctacgcaccagaagggcctatttcccagccacctgttccgcctgctactgctgttctaccatgtggccacacctttcatgattactgtttggagcgaataacccctgatgaccaatccaaatatcctccatgcattccttgtgctcttctcgag

SEQ ID NO: 11105 - DNA, 1086 bp, Artificial sequence
  miR resistant mutant
atgaatacaaaatcgctccaaatcctggtgcactcaccggacctcggcataagtttacagagtaccaccaaccacgaaaccctttccgatctcaaaaactctcttttccctcaatcacaccaatccttctacttcaccttcaatggcaaacccctccccgacaaaacccctctttcccaattcccccctctctccaccctctctctccgctcccgcctccttggcggcggcggagacggcggcgccaccggagccgagtcccgcgactgctacctcaacatgtacgccgacaagaagcccgacaaggtggaccccaatgaacagcgtctctccaagtggcacaattgcgccctctccaacgaacccttgagagagccctgcgtgatcgataaattggggaatatcttcaacaaggaagcgctggtggaagcgttgttggggaagaagcttcccaaggaatttgggcacatcaagggtttgaaggatatgattaatgttcagctttctgcgattcctggagcggatgatggggcaaagtttcagtgccctgttgcggggcttgaattcaacgggaagtataggtttttcgcgctgaggaattgtgggcatgttttgagtgcgaaggctctgagggaggttaagtcttcgtcgtgtttggtttgtcacaaggagtatgctgacgtggataaggttgtgctcaatgggagtgatgaggaggttgcggttttgagggagaggatggaggaggagaaagctaagattagggagaagaagagtaagaaggttaagaataatggtaatgatgacggtgtgagtttggaagggactaggttgagtggtactaagcatggtgttgatggtaagggtgtagagaaagcttcggctaaggtggaacgaaatgggaaggttggtaatggtaatgttggtgtgaatggtggtgctgctgctgctgccaagcgtttcaaggctgttgatctggccccggcgaatgctacaaaggatgtgtatgcttccatcttcacttcgtcgaggaagtctgagtttaaagaaacttatagctgtaggtctcttcctcttggaagaaac

SEQ ID NO: 11106 - DNA, 1086 bp, Artificial sequence
  miR resistant mutant
atgaatacaaaatcgctccaaatcctggtgcactcaccggacctcggaataagtttacagagtaccaccaaccacgaaaccctttccgatctcaaaaactctcttttccctcaatcacaccaatccttctacttcaccttcaatggcaaacccctccccgacaaaacccctctttcccaattcccccctctctccaccctctctctccgctcccgcctccttggcggcggcggagacggcggcgccaccggagccgagtcccgcgactgctacctcaacatgtacgccgacaagaagcccgacaaggtggaccccaatgaacagcgtctctccaagtggcacaattgcgccctctccaacgaacccttgagagagccctgcgtgatcgataaattggggaatatcttcaacaaggaagcgctggtggaagcgttgttggggaagaagcttcccaaggaatttgggcacatcaagggtttgaaggatatgattaatgttcagctttctgcgattcctggagcggatgatggggcaaagtttcagtgccctgttgcggggcttgaattcaacgggaagtataggtttttcgcgctgaggaattgtgggcatgttttgagtgcgaaggctctgagggaggttaagtcttcgtcgtgtttggtttgtcacaaggagtatgctgacgtggataaggttgtgctcaatgggagtgatgaggaggttgcggttttgagggagaggatggaggaggagaaagctaagattagggagaagaagagtaagaaggttaagaataatggtaatgatgacggtgtgagtttggaagggactaggttgagtggtactaagcatggtgttgatggtaagggtgtagagaaagcttcggctaaggtggaacgaaatgggaaggttggtaatggtaatgttggtgtgaatggtggtgctgctgctgctgccaagcgtttcaaggctgttgatctggccccggcgaatgctacaaaggatgtgtatgcttccatcttcacttcgtcgaggaagtctgagtttaaagaaacttatagctgtaggtctcttcctcttggaagaaac

SEQ ID NO: 11107 - DNA, 1404 bp, Artificial sequence
  miR resistant mutant
atggaggaggaggatgagattcttcaagcacgggcgtgtaagttgccaagaagaagaggcagtgatggggagagcacgaacagcaggttccacagcagcagctggcaccaccacaactcttcgaggatcataagggtgtctcgagcatctggtggcaaagacaggcacagcaaggttatgacttcaaaagggttgagagatagaagggttaggctttctgtgaacactgccattcagttctatgaccttcaagatcgcttgggttatgaccaacctagtaaagctgtggagtggcttatcaaatctgcttctgatgccatttctgaacttccttctttgaacaatttccctgacactccccaaagtgatgatcatgagaagagggaaaacaccgctgatgttgctgttggggtagtagatggtgagaatggcaatggccagaacttgagtttggctaaatctgcttgtagtagcaattctgagactagcaaaggttctggcttgtccctctcaaggtctgatattcgtgtgaaggctagagagagggcaagggagagaacaacaaaggaaaaggagaaagagaaagagaaaaatgatgagtctcatcgtcatcatcacaatgttgttgttgttcctcatcacaaccacaatgtgaacctcgtttcacaaacagcttctttcacggagctactcactggcagtgatcccaacaaagggtgtgatgaggctaataacaacatgatgttcaacaaagcagcaggtagactgcaatggtgttcatcaacaacacctatggactactttctggggctttcctcttctagaacaacgacacacaatcacaatcaccttcatcatcatcaatattcttcttcttcttctagtgggttctcattggcacaaatccaactaggacattctcttcctgaggcaatgaatcatgtttcagcattcaacaacaatgtgagtggtgataaccacaaccactcatcatcagatcctcatctgcagcagcaacacttgtcattgataccggatcatcttatgtcagctgtggttacttcttctgctgcttcttctcatcatcatcatcatcatcagcccagcgggaacgattacaatctgaactccaccatgtcttcgggcctcgctggttacaatcgaggaacattacaaagtaactctccgtctctgctgcctcactcgcagaggttttcgcctatagacggatccactgtacctttcttcattggagctgcttcttctgctgctgcagttgctgctcctgccatggagaacaacaacaacaacaaccatcaccagcatcagttctcttctgtttttgatggcagccgcttgcaactttactatggccattctgaccagaaggggaaagccaagaac

SEQ ID NO: 11108 - DNA, 1404 bp, Artificial sequence
  miR resistant mutant
atggaggaggaggatgagattcttcaagcacgggcgtgtaagttgccaagaagaagaggcagtgatggggagagcacgaacagcaggttccacagcagcagctggcaccaccacaactcttcgaggatcataagggtgtctcgagcatctggtggcaaagacaggcacagcaaggttatgacttcaaaagggttgagagatagaagggttaggctttctgtgaacactgccattcagttctatgaccttcaagatcgcttgggttatgaccaacctagtaaagctgtggagtggcttatcaaatctgcttctgatgccatttctgaacttccttctttgaacaatttccctgacactccccaaagtgatgatcatgagaagagggaaaacaccgctgatgttgctgttggggtagtagatggtgagaatggcaatggccagaacttgagtttggctaaatctgcttgtagtagcaattctgagactagcaaaggttctggcttgtccctctcaaggtctgatattcgtgtgaaggctagagagagggcaagggagagaacaacaaaggaaaaggagaaagagaaagagaaaaatgatgagtctcatcgtcatcatcacaatgttgttgttgttcctcatcacaaccacaatgtgaacctcgtttcacaaacagcttctttcacggagctactcactggcagtgatcccaacaaagggtgtgatgaggctaataacaacatgatgttcaacaaagcagcaggtagactgcaatggtgttcatcaacaacacctatggactactttctggggctttcctcttctagaacaacgacacacaatcacaatcaccttcatcatcatcaatattcttcttcttcttctagtgggttctcattggcacaaatccaactaggacattctcttcctgaggcaatgaatcatgtttcagcattcaacaacaatgtgagtggtgataaccacaaccactcatcatcagatcctcatctgcagcagcaacacttgtcattgataccggatcatcttatgtcagctgtggttacttcttctgctgcttcttctcatcatcatcatcatcatcagcccagcgggaacgattacaatctgaactccaccatgtcttcgggcctcgctggttacaataggggaacattacaaagtaactctccgtctctgctgcctcactcgcagaggttttcgcctatagacggatccactgtacctttcttcattggagctgcttcttctgctgctgcagttgctgctcctgccatggagaacaacaacaacaacaaccatcaccagcatcagttctcttctgtttttgatggcagccgcttgcaactttactatggccattctgaccagaaggggaaagccaagaac

SEQ ID NO: 11109 - DNA, 1434 bp, Artificial sequence
  miR resistant mutant
atggaggaggaggatgagattcaagcacagaaggtgagaagaagaagaggcagtgatggagagagcacgaacaggttccacagcagctggcaccaccaccaccaccactcttcgaggatcataagggtgtctcgtgcatctggtggcaaagacaggcacagcaaagtgatgacttcaaaagggttgagagatagaagggttaggctttccgtgaccactgccattcagttctatgaccttcaagatcgcttgggttatgaccaacctagtaaagctgtggaatggcttatcaaatctgcttctgattccatttctgaacttccttctttgaacaatttccctgacacccccaaaagtgatgatcatgagaagagagcaaacactgatgttgctgctggggcagtagatggtgagaattatgaaaatgagaatggcaataacaataaccagagtcagaacatgtctttgtctaaatctggttgtagtagcacttctgagacaagcaaaggttctggcttgtccctctcaaggtctgatattcgtgtgaaggctagagagagggcaagggagagaacaacaaaggaaaaggagaaagagaaaaatgagtctcatcatcatcacagcaatgttgttgttcctcatcatcgtcatcatcatcatcataaccccgtttcacaaacagcttctttcactgagcttctcactggtgggattcccaaagggtgtgatgatgaggagcctaataacatgatgatgttcaacaaagaagctgcagcagcatcatctggtagacagcaatggtgttcatcatcatcagcagcagcagcagcacctatggactactttctggggccttcctcttctagaacaacaacaacaccaccacacaatcaccatcaccatcatcatcaatattcttcttctggtgggttctcattggcacaaatccaactaggacattctcttcctgaggcaatgaatcacaatgtttcagcattcaacaataatgtgagtggtgagaaccaaaaccactcatcatcagatcctcatctgcaacagcagcaacacttctcattcataccggatcatcttatgtcagctgtggttacttcttcttctcatcatcaacctagcgggagcgactacaatctgaacttcaccatgtcttcgggcctcgctggttacaatcgaggaacattacaaagtaactctccgtctcttttgcctcacttgcagaggttttcgcctctagacggatccactgtacctttcttcattggagctgctccttctgctgcagttgctgctcctgccatggagaacaacaccaccaccaccaacaaccatcaccaccatcagttctcatctggtttcgatggcagccgcttgcaactctactatgggcattctgaccagaaggggaaagccaaaaac

SEQ ID NO: 11110 - DNA, 1434 bp, Artificial sequence
  miR resistant mutant
atggaggaggaggatgagattcaagcacagaaggtgagaagaagaagaggcagtgatggagagagcacgaacaggttccacagcagctggcaccaccaccaccaccactcttcgaggatcataagggtgtctcgtgcatctggtggcaaagacaggcacagcaaagtgatgacttcaaaagggttgagagatagaagggttaggctttccgtgaccactgccattcagttctatgaccttcaagatcgcttgggttatgaccaacctagtaaagctgtggaatggcttatcaaatctgcttctgattccatttctgaacttccttctttgaacaatttccctgacacccccaaaagtgatgatcatgagaagagagcaaacactgatgttgctgctggggcagtagatggtgagaattatgaaaatgagaatggcaataacaataaccagagtcagaacatgtctttgtctaaatctggttgtagtagcacttctgagacaagcaaaggttctggcttgtccctctcaaggtctgatattcgtgtgaaggctagagagagggcaagggagagaacaacaaaggaaaaggagaaagagaaaaatgagtctcatcatcatcacagcaatgttgttgttcctcatcatcgtcatcatcatcatcataaccccgtttcacaaacagcttctttcactgagcttctcactggtgggattcccaaagggtgtgatgatgaggagcctaataacatgatgatgttcaacaaagaagctgcagcagcatcatctggtagacagcaatggtgttcatcatcatcagcagcagcagcagcacctatggactactttctggggccttcctcttctagaacaacaacaacaccaccacacaatcaccatcaccatcatcatcaatattcttcttctggtgggttctcattggcacaaatccaactaggacattctcttcctgaggcaatgaatcacaatgtttcagcattcaacaataatgtgagtggtgagaaccaaaaccactcatcatcagatcctcatctgcaacagcagcaacacttctcattcataccggatcatcttatgtcagctgtggttacttcttcttctcatcatcaacctagcgggagcgactacaatctgaacttcaccatgtcttcgggcctcgctggttacaataggggaacattacaaagtaactctccgtctcttttgcctcacttgcagaggttttcgcctctagacggatccactgtacctttcttcattggagctgctccttctgctgcagttgctgctcctgccatggagaacaacaccaccaccaccaacaaccatcaccaccatcagttctcatctggtttcgatggcagccgcttgcaactctactatgggcattctgaccagaaggggaaagccaaaaac

SEQ ID NO: 11111 - DNA, 1533 bp, Artificial sequence
  miR resistant mutant
atggaggaggatgagattcaagcatgtaagttccctagagttggaaatggtaggagtagtgaccaataccaagaggaggaagaagagggtgacctaagaagaaaaggtgttggtggtggtggtggaagtgatgctagcacaaaccacttccaccaaagtagttggcactactcttctagaatcataagggtgtctcgagcatctggtggcaaagacaggcacagcaaagtgatgacctcaaaagggttaagagacagaagggttaggctctctgtgaccacagctattcagttctatgaccttcaagatcgcttgggttacgaccaacctagcaaagctgtggagtggctaatcaaagctgcttcagaagctatctctgagcttccttctctcaacaaccctttccctgatacccctaagcagcctagtgatgagaaaaggcctaccagtggtggtggtcaacaacaacaacaacaaggctttgatgatgcagatggagacacaaattaccaacaaaaccaaagccagaatctttctctctccaagtctgcttgtagcagcacttccgagacaagcaagggctcaggcttgtccctctcaaggtctgagatccgtgtgaaccgtgtgaaggcaagggagagggcaagggagagagcagcaaaagagaaggagaaggagaaagagaaagagagtgattttaacattgcacaccaccatcaccaccacaatgtgaacaacatgtctcacactgcttccttcactgagcttctcactggtgggattgggagcacggtaacagttaaccccaacacaacaacaacaacaacaacaacagcaacaagtcctaatggatcatcggttcatcagatccatgagggtcatgatcatgaggctaatctattcaacaagggaagtcaacaacagcaacagcaacaacatcaccattggtctcaaacagtgacacctatggactacttcagcgcaggcctcttggtaggaccttcatcatctgcaagtactcaacaacaccaatcttcaggacagttccaactgggacatggacatgcacatgcacatgctctttcaatctcaccatttagtggagaaaaccactcggagcaaatgcagcatttttccttcatgccagaccatctcaacaacatgccatcttctgctgcttctgcttctcaacacagcgagggtgacaataacaactacaacctcaacttcagcatctcttcgtcgggccttgctggttacaatcgaggaacattacaaagtaactctccgtcttcctcgtttttgcctctccttcagaggtttcaacctttagtcgacggatcctccaatctacctttctttataggagctgctcctccttcttctgctcctccaaccatggacaacaacaacagcaacaacagcaacaaccatcaccaccttcagttctcacccatctttgatggccgcttgcaactttgctatggcgatggaacaaggcagcattctgatcacaaggggaagggaaagaac

SEQ ID NO: 11112 - DNA, 1533 bp, Artificial sequence
  miR resistant mutant
atggaggaggatgagattcaagcatgtaagttccctagagttggaaatggtaggagtagtgaccaataccaagaggaggaagaagagggtgacctaagaagaaaaggtgttggtggtggtggtggaagtgatgctagcacaaaccacttccaccaaagtagttggcactactcttctagaatcataagggtgtctcgagcatctggtggcaaagacaggcacagcaaagtgatgacctcaaaagggttaagagacagaagggttaggctctctgtgaccacagctattcagttctatgaccttcaagatcgcttgggttacgaccaacctagcaaagctgtggagtggctaatcaaagctgcttcagaagctatctctgagcttccttctctcaacaaccctttccctgatacccctaagcagcctagtgatgagaaaaggcctaccagtggtggtggtcaacaacaacaacaacaaggctttgatgatgcagatggagacacaaattaccaacaaaaccaaagccagaatctttctctctccaagtctgcttgtagcagcacttccgagacaagcaagggctcaggcttgtccctctcaaggtctgagatccgtgtgaaccgtgtgaaggcaagggagagggcaagggagagagcagcaaaagagaaggagaaggagaaagagaaagagagtgattttaacattgcacaccaccatcaccaccacaatgtgaacaacatgtctcacactgcttccttcactgagcttctcactggtgggattgggagcacggtaacagttaaccccaacacaacaacaacaacaacaacaacagcaacaagtcctaatggatcatcggttcatcagatccatgagggtcatgatcatgaggctaatctattcaacaagggaagtcaacaacagcaacagcaacaacatcaccattggtctcaaacagtgacacctatggactacttcagcgcaggcctcttggtaggaccttcatcatctgcaagtactcaacaacaccaatcttcaggacagttccaactgggacatggacatgcacatgcacatgctctttcaatctcaccatttagtggagaaaaccactcggagcaaatgcagcatttttccttcatgccagaccatctcaacaacatgccatcttctgctgcttctgcttctcaacacagcgagggtgacaataacaactacaacctcaacttcagcatctcttcgtcgggccttgctggttacaataggggaacattacaaagtaactctccgtcttcctcgtttttgcctctccttcagaggtttcaacctttagtcgacggatcctccaatctacctttctttataggagctgctcctccttcttctgctcctccaaccatggacaacaacaacagcaacaacagcaacaaccatcaccaccttcagttctcacccatctttgatggccgcttgcaactttgctatggcgatggaacaaggcagcattctgatcacaaggggaagggaaagaac

SEQ ID NO: 11113 - DNA, 1596 bp, Artificial sequence
  miR resistant mutant
atggaggaggatgagattcaagcatgtaagttcccaagagttggaaatggtaggagtagtgaccaataccaagaggaggaagaagagggtggtgacctaagacttagaaaaggtgttggtgttggtggtggtggtggaggtggaggaagtgatgctagcacaaaccacttccaccaaagtagttggcaccattcttctagaatcataagggtgtctcgagcatctggtggcaaagacaggcacagcaaagtgatgacctcaaaagggttaagagacagaagggttaggctctctgtgaccacagctattcagttctatgaccttcaagatcgcttgggttacgaccaacctagcaaagctgttgagtggttaatcaaagctgcttcagaagctatctctgagcttccttctctcaacaaccctttccctgatacccctaagcaactaagtgataagaaaaggcctactagtggtggtggtcaacaacaacaacaaatacaacaaggccactttgatgatgctgatggagacacaagttacccccaaaaccaaagccagaacctttctctctccaagtctgcttgcagcagcacttccgagacaagcaagggctcaggcttgtccctctcaaggtctgagattcgtgtgaaccgtgttaaggcaagggagagggctagggagagagctgctaaagaaaaagagaaggagaaggagaaggagaaggagaaggagaaagagagtgaatctagcattgcacatcaccaccatcatcaccatgtgaacaacaacaaccacatgtctcacacagcttccttcactgagcttctcactggtgggattgggagcactgtaacagttaaccccaacaccaccaccaccaccaccacaacaacaacaagtcctaatgggtcatcagttcatcagatccatgatggtcatgatcatgagactaatctattcaacaagggaaggcaacaacaacaacagcatcattggtctcaaacagtgacacctatggactacttcagcacaggcctcttggtaggaccttcttcatcatctgcaagaactcaacaacaccaacaccaatcttcttcagcacatttccaactgggacatgcacatgcccttccaatctctccattcagtggagaaaaccactcagagcagctgcagcatttttccttcatgccagaccacctcaacaacataccagctcatcatgtggttacatcttcttctgcttctcatcaacccaacgggggtgacaacaactacaacctcaacttcagtatctctacatcgacgggccttgctggttacaacaatcgaggaacattacaaagtaactctccgtcttcctcgtttttgcctcatcacctccagaggtttcaacctttagacggatcgtccaacctacctttctttataggagctgctgctccttcttctgctcctccaaccatggacaacaacaacaataataacagcaacaaccatcaccaccttcagttctcacctgtctttgatggccgcttgcaactctgctatggcgatggaacaaggcattctgaccacaaggggaagggaaagaac

SEQ ID NO: 11114 - DNA, 1596 bp, Artificial sequence
  miR resistant mutant
atggaggaggatgagattcaagcatgtaagttcccaagagttggaaatggtaggagtagtgaccaataccaagaggaggaagaagagggtggtgacctaagacttagaaaaggtgttggtgttggtggtggtggtggaggtggaggaagtgatgctagcacaaaccacttccaccaaagtagttggcaccattcttctagaatcataagggtgtctcgagcatctggtggcaaagacaggcacagcaaagtgatgacctcaaaagggttaagagacagaagggttaggctctctgtgaccacagctattcagttctatgaccttcaagatcgcttgggttacgaccaacctagcaaagctgttgagtggttaatcaaagctgcttcagaagctatctctgagcttccttctctcaacaaccctttccctgatacccctaagcaactaagtgataagaaaaggcctactagtggtggtggtcaacaacaacaacaaatacaacaaggccactttgatgatgctgatggagacacaagttacccccaaaaccaaagccagaacctttctctctccaagtctgcttgcagcagcacttccgagacaagcaagggctcaggcttgtccctctcaaggtctgagattcgtgtgaaccgtgttaaggcaagggagagggctagggagagagctgctaaagaaaaagagaaggagaaggagaaggagaaggagaaggagaaagagagtgaatctagcattgcacatcaccaccatcatcaccatgtgaacaacaacaaccacatgtctcacacagcttccttcactgagcttctcactggtgggattgggagcactgtaacagttaaccccaacaccaccaccaccaccaccacaacaacaacaagtcctaatgggtcatcagttcatcagatccatgatggtcatgatcatgagactaatctattcaacaagggaaggcaacaacaacaacagcatcattggtctcaaacagtgacacctatggactacttcagcacaggcctcttggtaggaccttcttcatcatctgcaagaactcaacaacaccaacaccaatcttcttcagcacatttccaactgggacatgcacatgcccttccaatctctccattcagtggagaaaaccactcagagcagctgcagcatttttccttcatgccagaccacctcaacaacataccagctcatcatgtggttacatcttcttctgcttctcatcaacccaacgggggtgacaacaactacaacctcaacttcagtatctctacatcgacgggccttgctggttacaacaataggggaacattacaaagtaactctccgtcttcctcgtttttgcctcatcacctccagaggtttcaacctttagacggatcgtccaacctacctttctttataggagctgctgctccttcttctgctcctccaaccatggacaacaacaacaataataacagcaacaaccatcaccaccttcagttctcacctgtctttgatggccgcttgcaactctgctatggcgatggaacaaggcattctgaccacaaggggaagggaaagaac

SEQ ID NO: 11115 - DNA, 1578 bp, Artificial sequence
  miR resistant mutant
atgatcgttaagaagggcttcctcaccaccgtggcgcaaaaatgcaacaccctaacccaactcaagcagctccacgcccacatcctccgatgccgcatcaacgacacgccttacgccctcgccccgcttctctccgtcctagccacctccaacgacgcgtcgttcttctcctacgctcgctccatcttccgccacctcactaaccgcaacaccttcatgcacaacaccatgatccgcggctacctccaatgccggtcacccctccacgccgtgtcctgctacttgtccatgctccaaaacggcgttgccgttaacaactacacgttcccacctttaatcaaagcctgcattgcgcttttaccaagcagcccaagcaatattgttggtcgtttggtgcacggtcatgtcgttaagttcggtctccgcaacgacccttacgtggtgagcgcgtttattgagttttactccgtttctcgcgaggtggacaccgcgagagtgttgtttgatgaaacgtcatataaagatgtggttttgggaactgcgatggttgacggttatggcaaaatggggaatgtgaagagtgcaagagaggtgtttgataaaatgcctgagagaaacgctgtgtcgtggagtgccatgatggcggcatattctcgtgtcagtgacttcaaggaagtgctggctttgtttacagagatgcagaacgagggaactgagccaaacgagtctatactcgttacggtacttactgcgtgtgcgcaccttggcgcactcacgcagggactgtgggtgcattcctatgcaagacgattccatcttgagtcgaatccgattctggccacggctttggtggacatgtattcgaaatgtggatgtgtggaatctgctttatctgtttttgattgcattgtcgacaaggacgctggcgcgtggaatgctatgatttcaggcgaggcattgaatggcgatgcagggaaatcgttgcagttgtttcgccaaatggctgcttccaggaccaagccgaacgagactacgtttgtggctgtcctcactgcttgtactcatgcaaagatggttcagcagggcctttggttgtttgaagaaatgagtagcgtgtatggagttgtgccacgaatggagcattatgcatgtgttattgaccttttgtcgagagctgggatggtggaggaggctgagaaatttatggaggagaagatgggtggactcacagctggtgatgctaacgtgtggggtgctcttctgaatgcgtgtagaatacataagaatattcatgttgggaatagggtgtggaaaaagctggttgatatgggggtcactgactgtggtactcatgttcttacttacaatatatatagagaagctgggtgggatgtggaggcaaacaaagttaggagtaggattgaagaagtagggatgaaaaagaagcccggatgcagcataatagaggtggataatgaagttgaagagtttcttgcaggcgatcattctcatccacaagcacaggaaatgtgcaaattgctcgattccattctcaagatggggactttagagcacttc

SEQ ID NO: 11116 - DNA, 1578 bp, Artificial sequence
  miR resistant mutant
atgatcgttaagaagggcttcctcaccaccgtggcgcaaaaatgcaacaccctaacccaactcaagcagctccacgcccacatcctccgatgccgcatcaacgacacgccttacgccctcgccccgcttctctccgtcctagccacctccaacgacgcgtcgttcttctcctacgctcgctccatcttccgccacctcactaaccgcaacaccttcatgcacaacaccatgatccgcggctacctccaatgccggtcacccctccacgccgtgtcctgctacttgtccatgctccaaaacggcgttgccgttaacaactacacgttcccacctttaatcaaagcctgcattgcgcttcttccaagcagcccaagcaatattgttggtcgtttggtgcacggtcatgtcgttaagttcggtctccgcaacgacccttacgtggtgagcgcgtttattgagttttactccgtttctcgcgaggtggacaccgcgagagtgttgtttgatgaaacgtcatataaagatgtggttttgggaactgcgatggttgacggttatggcaaaatggggaatgtgaagagtgcaagagaggtgtttgataaaatgcctgagagaaacgctgtgtcgtggagtgccatgatggcggcatattctcgtgtcagtgacttcaaggaagtgctggctttgtttacagagatgcagaacgagggaactgagccaaacgagtctatactcgttacggtacttactgcgtgtgcgcaccttggcgcactcacgcagggactgtgggtgcattcctatgcaagacgattccatcttgagtcgaatccgattctggccacggctttggtggacatgtattcgaaatgtggatgtgtggaatctgctttatctgtttttgattgcattgtcgacaaggacgctggcgcgtggaatgctatgatttcaggcgaggcattgaatggcgatgcagggaaatcgttgcagttgtttcgccaaatggctgcttccaggaccaagccgaacgagactacgtttgtggctgtcctcactgcttgtactcatgcaaagatggttcagcagggcctttggttgtttgaagaaatgagtagcgtgtatggagttgtgccacgaatggagcattatgcatgtgttattgaccttttgtcgagagctgggatggtggaggaggctgagaaatttatggaggagaagatgggtggactcacagctggtgatgctaacgtgtggggtgctcttctgaatgcgtgtagaatacataagaatattcatgttgggaatagggtgtggaaaaagctggttgatatgggggtcactgactgtggtactcatgttcttacttacaatatatatagagaagctgggtgggatgtggaggcaaacaaagttaggagtaggattgaagaagtagggatgaaaaagaagcccggatgcagcataatagaggtggataatgaagttgaagagtttcttgcaggcgatcattctcatccacaagcacaggaaatgtgcaaattgctcgattccattctcaagatggggactttagagcacttc

SEQ ID NO: 11117 - DNA, 1920 bp, Artificial sequence
  miR resistant mutant
atgaagttgcagttctctattgttgcacttgttctattaggctccacactgtccttctgtggcctgatagtagctgacttgaactctgaccaacatgctctcttggagtttgcttcaagtgtcccacatgccccaaggctcaactggaagaatgactctgcttcaatttgcacctcatgggttggtgtgacatgcaactccaacggcacacgtgtcgtaggcctccatcttccagggatgggattaaccgggaccattccagagaacagcataggaaaactagatgctcttagggtcctgagtcttcattctaatggacttataggaagtcttccttctaatgtactctccattccttcactccaatttgcataccttcagcacaatagcttctctggcctaattccttctccagtgacccctaaactcatgacattggacatttcttttaactccttttctggcaccatcccaccagcttttcagaaccttagaagactcacttggttgtatctccaaaacaattccatatctggggctattcctgacttcaaccttccaagtctcaagcatttgaacttgagctataataacttgaatggctcaattccaaactccataaaggcattcccttacacttcttttgttgggaacgctctcttatgcgggccacctctcaatcattgctctacaatctccccaagccccagcccaagtacagattacgagccactcactccaccagccacccaaaaccaaaatgctacacaccataaggaaaactttggcctagttactatacttgctctagtcattggggtcattgccttcatctctttaatagttgtagtgttctgtttgaagaagaagaaaaacagcaaaagcagtggcatactgaaaggaaaggcttcttgtgctggaaagactgaggtttcaaagagttttgggagtggagtgcaaggggctgaaaagaacaagctatttttctttgaaggttcctctcacagctttgaccttgaggatttgctgaaggcttcagctgaagttcttggaaaaggaagttatggaacagcatacaaggctgttttggaggagggaacaacagtggtagttaaaaggttgaaggaagttgtggtaggaaagaaggagtttgagcagcagttgcagattgtggggagaattggaaaccaccccaatgtgatgccactaagggcttattactattccaaagatgagaaacttctggtttacaactacatgccaggtggcagcttgtttttcttgttgcatggaaacaggggagcaggaagaagcccactagactgggactccagagtgaaaattttgctaggagctgccaggggaatagctttcatccactcagaggggggtccaaagttctcacatggcaacatcaagtcaaccaatgtgctcataacccaagaactggacggctgcatctccgatgtgggattgccgcctctaatgaacactccagcaaccatgtcaagagccaatggctacagagctccagaagccacagactcaaagaagatcagtcacaagtctgatgtctacggctttggcgtgctgctgcttgaaatgctgacagggaagacccctttgaggtaccctggctatgaagatgtggttgatcttccaaggtgggtgaggtctgttgtgagagaggagtggactgctgaagtgtttgatgaggagcttctgagagggcaatatgttgaagaggagatggtgcagatgcttcagattgcactggcatgtgtggctaaggggtctgataataggcctagaatggatgaagttgttagaatgttggaggagattaagcatcctgagttgaagaaccaccacaggcaatcctctcatgaatctgactctaatgtgcagacaccaacacca

SEQ ID NO: 11118 - DNA, 1920 bp, Artificial sequence
  miR resistant mutant
atgaagttgcagttctctattgttgcacttgttctattaggctccacactgtccttctgtggcctgatagtagctgacttgaactctgaccaacatgctctcttggagtttgcttcaagtgtcccacatgccccaaggctcaactggaagaatgactctgcttcaatttgcacctcatgggttggtgtgacatgcaactccaacggcacacgtgtcgtaggcctccatcttccagggatgggattaaccgggaccattccagagaacagcataggaaaactagatgctcttagggtcctgagtcttcattctaatggacttataggaagtcttccttctaatgtactctccattccttcactccaatttgcataccttcagcacaatagcttctctggcctaattccttctccagtgacccctaaactcatgacattggacatttcttttaactccttttctggcaccatcccaccagcttttcagaaccttagaagactcacttggttgtatctccaaaacaattccatatctggggctattcctgacttcaaccttccaagtctcaagcatttgaacttgagctataataacttgaatggctcaattccaaactccataaaggcattcccttacacttcttttgttgggaacgctctcttatgcgggccacctctcaatcattgctctacaatctccccatctccctctccaagtacagattacgagccactcactccaccagccacccaaaaccaaaatgctacacaccataaggaaaactttggcctagttactatacttgctctagtcattggggtcattgccttcatctctttaatagttgtagtgttctgtttgaagaagaagaaaaacagcaaaagcagtggcatactgaaaggaaaggcttcttgtgctggaaagactgaggtttcaaagagttttgggagtggagtgcaaggggctgaaaagaacaagctatttttctttgaaggttcctctcacagctttgaccttgaggatttgctgaaggcttcagctgaagttcttggaaaaggaagttatggaacagcatacaaggctgttttggaggagggaacaacagtggtagttaaaaggttgaaggaagttgtggtaggaaagaaggagtttgagcagcagttgcagattgtggggagaattggaaaccaccccaatgtgatgccactaagggcttattactattccaaagatgagaaacttctggtttacaactacatgccaggtggcagcttgtttttcttgttgcatggaaacaggggagcaggaagaagcccactagactgggactccagagtgaaaattttgctaggagctgccaggggaatagctttcatccactcagaggggggtccaaagttctcacatggcaacatcaagtcaaccaatgtgctcataacccaagaactggacggctgcatctccgatgtgggattgccgcctctaatgaacactccagcaaccatgtcaagagccaatggctacagagctccagaagccacagactcaaagaagatcagtcacaagtctgatgtctacggctttggcgtgctgctgcttgaaatgctgacagggaagacccctttgaggtaccctggctatgaagatgtggttgatcttccaaggtgggtgaggtctgttgtgagagaggagtggactgctgaagtgtttgatgaggagcttctgagagggcaatatgttgaagaggagatggtgcagatgcttcagattgcactggcatgtgtggctaaggggtctgataataggcctagaatggatgaagttgttagaatgttggaggagattaagcatcctgagttgaagaaccaccacaggcaatcctctcatgaatctgactctaatgtgcagacaccaacacca

SEQ ID NO: 11119 - DNA, 1470 bp, Artificial sequence
  miR resistant mutant
atgagagaacaagaggattggaggattacgacagcgctgttaacgttgttgttggtgtttgtttcttcttttccggcgttgagctacggagttgttcctcctcgtactctgctcaataagctgtctcagggcagttatctcaccactcaggagcaatggttcaatcaaaccctcgatcacttctctccctatgatcaccatcaattccgtcaacgttacttcgagtttctagactatttccggattcctgatggaccaattttcttggtaatcggtggtgaaggtccatgtaatgggataacaaatgactatattggtgtactggcaaagaagtttggagcagctatggttactcttgaacatcgctactatggaaagagttccccatttaattctttggagacagaaaatttgaaatatctttcatccaagcaggcactctttgatttggctgtttttcgtcagtattatcaggattccttaaatgcaaagcttaatagaacaaaaactgaaaacccctggttcgtttttggtggctcatatgctggagcactcagtgcatggttccgtctcaagtttccccatttaacatgtggaagtctggcaagttctgcagttgttcttgctgtttataacttcacagaatatgatcaacagattggtgagtcagcaggtgctgaatgtaaagcagtattacaagaaactactcaactcattgagcacaaacttgcaaccaatggaaaggaactaaaggcatcttttaatgcagatgatctcgaaaaagatggagactttatgtatttaattgctgatgctgctgctgtagcatttcaatatggtaatcctgataaagtatgcaagcctatggttgaagcaaagaatgctggagaggacttggtggatgcttatgccaaatacgtcaaagagtactacattggaacctttggtgttaatgtgcagacttatgaccaggagtacttgaagaaaactgctatcaatgaagacagttctactcgattatggtggtttcaagtttgcactgaagttgcattctttcaggtggctccatcaaatgatagtatacgctcctcagaaattgatgcaaaataccatatggacctttgcaaaaatatctttggagagggcatctttcctgatgttgatgcaactaatttatactacggaggcacaaaaattgctggttcgaaaatagtatttgcaaatggctcacaggatccttggcgtcatgcgtccaaacaaacttcatctcctgatctgccttcctacaccatcacatgtagcaattgtgcccattgtactgattttcgaggatgcccacagagcccactagtacttgaaggtaatgagaagaactgctcctcacctgatgcagttcacaaagtaaggcaacagattacagaacatatggacttgtggctatctgagtgccaagaaggcagcagttatata

SEQ ID NO: 11120 - DNA, 1470 bp, Artificial sequence
  miR resistant mutant
atgagagaacaagaggattggaggattacgacagcgctgttaacgttgttgttggtgtttgtttcttcttttccggcgttgagctacggagttgttcctcctcgtactctgctcaataagctgtctcagggcagttatctcaccactcaggagcaatggttcaatcaaaccctcgatcacttctctccctatgatcaccatcaattccgtcaacgttacttcgagtttctagactatttccggattcctgatggaccaattttcttggtaatcggtggtgaaggtccatgtaatgggataacaaatgactatattggtgtactggcaaagaagtttggagcagctatggttactcttgaacatcgctactatggaaagagttccccatttaattctttggagacagaaaatttgaaatatctttcatccaagcaggcactctttgatttggctgtttttcgtcagtattatcaggattccttaaatgcaaagcttaatagaacaaaaactgaaaacccctggttcgtttttggtggctcatatgctggagcactcagtgcatggttccgtctcaagtttccccatttaacatgtggaagtctggcaagttctgcagttgttcttgctgtttataacttcacagaatatgatcaacagattggtgagtcagcaggtgctgaatgtaaagcagtattacaagaaactactcaactcattgagcacaaacttgcaaccaatggaaaggaactaaaggcatcttttaatgcagatgatctcgaaaaagatggagactttatgtatttaattgctgatgctgctgctgtagcatttcaatatggtaatcctgataaagtatgcaagcctatggttgaagcaaagaatgctggagaggacttggtggatgcttatgccaaatacgtcaaagagtactacattggaacctttggtgttaatgtgcagacttatgaccaggagtacttgaagaaaactgctatcaatgaagacagttctactcgattatggtggtttcaagtttgcactgaagttgcattctttcaggtggctccatcaaatgatagtatacgctcctcagaaattgatgcaaaataccatatggacctttgcaaaaatatctttggagagggcatctttcctgatgttgatgcaactaatttatactacggaggcacaaaaattgctggttcgaaaatagtatttgcaaatggctcacaggatccttggcgtcatgcgtccaaacaaacttcatctcctgatctgccttcctacaccatcacatgtagcaattgtgcccattgtactgattttcgaggatgtccacagagcccactagtacttgaaggtaatgagaagaactgctcctcacctgatgcagttcacaaagtaaggcaacagattacagaacatatggacttgtggctatctgagtgccaagaaggcagcagttatata

SEQ ID NO: 11121 - DNA, 1365 bp, Artificial sequence
  miR resistant mutant
atgaaaccagcttgttcattgggaagattcctcagcactgatgtcatatggttcaatcaaactctcgatcacttttctccatatgatcaccgtcaattccggcaacgttactatgaattcctagactatttccgggctccggatggaccaattttcttggtgataggtggtgaagcaacatgcaatgggatagtaaatgactatattggtgtactggcaaagaagttcggagcagctgtggtttctcttgaacatcgctattatggagaaagtaccccatttgatactttctcgacggaaaatttgaaatatctttcatccaagcaggcactctttgatttggctgtttttcgccagtattatcaggattctttaaatgcaaagctgaatagatcaggagttgaaaatccatggttctttttcggtggctcatattctggagcactcagtgcatggttccgtcttaagtttccccatttaacatgcggaagtcttgccagttctgccgttgttcttgctgttcaagacttcgccgaattcgatcaacagattggtgagtcagctggtcctgagtgtaaagcagtattacaagaaactactcaactcgttgaaacaaagcttgcagacgatggaaaggcactgagatcaatttttaatgcagatgatcttgaaattgatggagacttcttgtactatctggctgatgctgctgttatagcgtttcagtatggaaatccagataagttatgcaagcctttggttgatgcaaagaacgctggcgaggatttggtggatgcatatgccaaatatgtcaaagagtactacgttggaacctttggtatcactccaaaaagttatgaccaggaatatttgaaaaaaactgcaatcaatgaagacagttctactcggttatggtggtttcaagtttgcactgaagttgcgtactttcaggtggctccctcaaatgatagcatacgttcctcaaaaattgacacaaaataccatttggacctttgcaaaaatatctttggagatggtgtctttcctgatgttgatgccactaatttatactatggaggcacaaaagttgctggttcaaaaataatatttacaaatggctcacaggatccatggcgtcatgcttcgaaacaaacttcatcccctgatttgccttcctaccttatcaagtgtaataattgtggccattgtactgatttgcgagggtgcccacagagcccactagtaattgaaggcaatgagaagaattgcagttcccctgatgcagttcacaaagtaaggcaaaaggttcaagaagatatggacttgtggctatctgagtgcatcgattcaggaagaagttctatg

SEQ ID NO: 11122 - DNA, 1365 bp, Artificial sequence
  miR resistant mutant
atgaaaccagcttgttcattgggaagattcctcagcactgatgtcatatggttcaatcaaactctcgatcacttttctccatatgatcaccgtcaattccggcaacgttactatgaattcctagactatttccgggctccggatggaccaattttcttggtgataggtggtgaagcaacatgcaatgggatagtaaatgactatattggtgtactggcaaagaagttcggagcagctgtggtttctcttgaacatcgctattatggagaaagtaccccatttgatactttctcgacggaaaatttgaaatatctttcatccaagcaggcactctttgatttggctgtttttcgccagtattatcaggattctttaaatgcaaagctgaatagatcaggagttgaaaatccatggttctttttcggtggctcatattctggagcactcagtgcatggttccgtcttaagtttccccatttaacatgcggaagtcttgccagttctgccgttgttcttgctgttcaagacttcgccgaattcgatcaacagattggtgagtcagctggtcctgagtgtaaagcagtattacaagaaactactcaactcgttgaaacaaagcttgcagacgatggaaaggcactgagatcaatttttaatgcagatgatcttgaaattgatggagacttcttgtactatctggctgatgctgctgttatagcgtttcagtatggaaatccagataagttatgcaagcctttggttgatgcaaagaacgctggcgaggatttggtggatgcatatgccaaatatgtcaaagagtactacgttggaacctttggtatcactccaaaaagttatgaccaggaatatttgaaaaaaactgcaatcaatgaagacagttctactcggttatggtggtttcaagtttgcactgaagttgcgtactttcaggtggctccctcaaatgatagcatacgttcctcaaaaattgacacaaaataccatttggacctttgcaaaaatatctttggagatggtgtctttcctgatgttgatgccactaatttatactatggaggcacaaaagttgctggttcaaaaataatatttacaaatggctcacaggatccatggcgtcatgcttcgaaacaaacttcatcccctgatttgccttcctaccttatcaagtgtaataattgtggccattgtactgatttgcgagggtgtccacagagcccactagtaattgaaggcaatgagaagaattgcagttcccctgatgcagttcacaaagtaaggcaaaaggttcaagaagatatggacttgtggctatctgagtgcatcgattcaggaagaagttctatg

SEQ ID NO: 11123 - DNA, 792 bp, Artificial sequence
  miR resistant mutant
atgtggaactttgcatcgaattgcattgctggaactgtgggactgaaaaatgattcaaagcctactcattctgcttcggaatgttctgatgatgaaaactctgttataggcagagaggaagggctggaatgcccaatatgctgggaatctttcaatattgttgaaaatgtgccctatgttttatggtgtggccacaccctttgtaaaaattgtatcctcggactgcagtgggctgttgtgaaatttccaacactgcctgttcaacttcccctttttatctcctgtccatggtgcaaccttctgtctttccgtttagtttaccggggaaaccttaaattccctcgcaaaaactactttcttctttggatggttgagagcatgaatggtgatagagggaaatcgcattcacctttctgtggtgacaaccaacagcatagcataaaagataatttaaccatgggaagccaagtaagccatggaaaccttcggagggggctagttcgccatccagagacatcgagttccaaccaatatcatggtaatactggtaatcacctcaatacagaaagatttcatgtttatcttcggaagtcactgatcttctttgtccagttgacggctaagttcccattggtcattatattccttttaattgtcttatatgcaataccagcaagtgcagccattttggccctgtatgtacttgttacaattctgtttgccctcccatcatttctcattttgtacttctcatatcctagtttggattggcttgtgagggaaattatcact

SEQ ID NO: 11124 - DNA, 792 bp, Artificial sequence
  miR resistant mutant
atgtggaactttgcatcgaattgcattgctggaactgtgggactgaaaaatgattcaaagcctactcattctgcttcggaatgttctgatgatgaaaactctgttataggcagagaggaagggctggaatgcccaatatgctgggaatctttcaatattgttgaaaatgtgccctatgttttatggtgtggccacaccctttgtaaaaattgtatcctcggactgcagtgggctgttgtgaaatttccaacactgcctgttcaacttcccctttttatctcctgtccatggtgcaaccttctgtctttccgtttagtttaccggggaaaccttaaattccctcgcaaaaactactttcttctttggatggttgagagcatgaatggtgatagagggaaatcgcattcacctttctgtggtgataaccaacagcatagcataaaagataatttaaccatgggaagccaagtaagccatggaaaccttcggagggggctagttcgccatccagagacatcgagttccaaccaatatcatggtaatactggtaatcacctcaatacagaaagatttcatgtttatcttcggaagtcactgatcttctttgtccagttgacggctaagttcccattggtcattatattccttttaattgtcttatatgcaataccagcaagtgcagccattttggccctgtatgtacttgttacaattctgtttgccctcccatcatttctcattttgtacttctcatatcctagtttggattggcttgtgagggaaattatcact

SEQ ID NO: 11125 - DNA, 852 bp, Artificial sequence
  miR resistant mutant
atggtagccattgaaaagaaaacccaaagctcactacatcttcgcagaaacagctttcccgccgcagctcaccctcttgtatcacaatttgaggagcaattgcaaagattgaggggttctgaagccacttcttcattgtcatcatcttcagtgtgccacaaacttaatgacatgctggatttgcatgactacactgataagttgcttcaattgccaatcgaacaacaagtcttagcacgagagtgcaacgataaatgtgttgatgacctactagaacagtctcttaggctcttagatatctgtaatacagccaaagagtgccttctgcaatcaaaggagagcatgtgcgacttagtttcagttatccgaagaaagaaaaacaatgaaattggattcacgattgaaggtgcaaaatacttggttgtgagaaagaagatgaagaagcaaattcgaaaggccctggaaaatttgaagcaaaaggacaaaaacacttcaccaatgctcagcttcttgaatgaagcagaagcaatcaccctgagctcattagaacaaatgctactgttcatctctggcccaaaaggacactcaaagcacagccgctggagcgccatcagtaaactaatgcagccaaaaagagtaatgtgtgactctcaagaatcaaacacaaatgaatttgaaaaggtggatgcagctttgcagtctctcatcagtctcaagccttcatctattgagaattttgaaagtcatatggaaaatttggagctgtgcattcaagatctagagataggagttgatcagctctcaagaaaattaattagaaacagggtttcccttcttaacatcttcaaccac

SEQ ID NO: 11126 - DNA, 852 bp, Artificial sequence
  miR resistant mutant
atggtagccattgaaaagaaaacccaaagctcactacatcttcgcagaaacagctttcccgccgcagctcaccctcttgtatcacaatttgaggagcaattgcaaagattgaggggttctgaagccacttcttcattgtcatcatcttcagtgtgccacaaacttaatgacatgctggatttgcatgactacactgataagttgcttcaattgccaatcgaacaacaagtcttagcacgagagtgcaacgataaatgtgttgatgacctactagaacagtctcttaggctcttagatatctgtaatacagccaaagagtgccttctgcaatcaaaggagagcatgtgcgacttagtttcagttatccgaagaaagaaaaacaatgaaattggattcacgattgaaggtgcaaaatacttggttgtgagaaagaagatgaagaagcaaattcgaaaggccctggaaaatttgaagcaaaaggacaaaaacacttcaccaatgctcagcttcttgaatgaagcagaagcaatcaccctgagctcattagaacaaatgctactgttcatctctggcccaaaaggacactcaaagcacagccgctggtcagccatcagtaaactaatgcagccaaaaagagtaatgtgtgactctcaagaatcaaacacaaatgaatttgaaaaggtggatgcagctttgcagtctctcatcagtctcaagccttcatctattgagaattttgaaagtcatatggaaaatttggagctgtgcattcaagatctagagataggagttgatcagctctcaagaaaattaattagaaacagggtttcccttcttaacatcttcaaccac

SEQ ID NO: 11127 - DNA, 1446 bp, Artificial sequence
  miR resistant mutant
atgggcgtttctcgttctcaaaagcctcatgttgtttgtgtgccattcccagcacaaggccacgtgaacccttttatgcaactaagcaaactccttctttgcaccggtttccacataacctttgtgaacaccgagttcaaccacaagcgtttggtgaagtctcttggacaagaatttgtcaagggacaacctcattttcgatttgagaccataccagatgggttgcctccatctgacaaagatgcaacacaaagcattgcagcattgtgtgatgcaactagaaaacattgttatgagccactcaaagagcttgtgaagaagctcaatgcttcacatgaagtgcctttggttacctctatcatctatgatgggctaatgggctttgcagggaaagtggcaagggatttggacatttctgaacaacaattttggacagcctcagcttgtggtttaatgggatacttgcaatttgatgagcttgtcgaaagaggcattattcccttccaagatgaaagtttcactactgatgggtcattggatacaaatctagactggatatctggaatgaaaaatatgcgaatcagagattgtccaagtttcgtgagaactaccactctagatgaaaccagttttatttgctttggtatagaagcaaaaacctgcatgaaatcatcttcaatcatcataaatacaatacaggagttggaaagtgaagttctcaatgcccttatggctcagaacccaaatatatataacattggtccacttcaattgttaggaaggcattttcctgataaagacaagggcttcaaggtgagtgggtcaaatctttggaaaaatgactcaaaatgtatccaatggctagaccaatgggaaccttcctcagtcatatatgtgaattatggaagtattactgtgatgtccgaggatcatttgaaagaatttgcttggggactagcaaatagcaatttaccatttttgtggataaaaaggccagatttggtaatgggtgagtccacacaattgccacaagacttcttagatgaggttaaagatagaggatacataacaagttggtgcccccaagagcaagtgctgtctcatccatcagttggggttttcctaactcattgtggctggaattctacactagaaggtataagtgggggtgtccctatgataggttggcctttctttgctgaacaacaaacaaattgcaggtacatatgcacaacttgggggataggaatggatattaaagatgatgtaaaaagggaggaggtgacaacacttgtgaaagaaatgataaccggagaaagggggaaggaaatgagacaaaagtgtctggagtggaaaaagaaagcaatagaagccactgatatgggaggatcatcatataatgatttccatcgattagtgaaggaggttcttcacaatgatgttgtt

SEQ ID NO: 11128 - DNA, 1446 bp, Artificial sequence
  miR resistant mutant
atgggcgtttctcgttctcaaaagcctcatgttgtttgtgtgccattcccagcacaaggccacgtgaacccttttatgcaactaagcaaactccttctttgcaccggtttccacataacctttgtgaacaccgagttcaaccacaagcgtttggtgaagtctcttggacaagaatttgtcaagggacaacctcattttcgatttgagaccataccagatgggttgcctccatctgacaaagatgcaacacaaagcattgcagcattgtgtgatgcaactagaaaacattgttatgagccactcaaagagcttgtgaagaagctcaatgcttcacatgaagtgcctttggttacctctatcatctatgatgggctaatgggctttgcagggaaagtggcaagggatttggacatttctgaacaacaattttggacagcctcagcttgtggtttaatgggatacttgcaatttgatgagcttgtcgaaagaggcattattcccttccaagatgaaagtttcactactgatgggtcattggatacaaatctagactggatatctggaatgaaaaatatgcgaatcagagattgtccaagtttcgtgagaactaccactctagatgaaaccagttttatttgctttggtatagaagcaaaaacctgcatgaaatcatcttcaatcataataaatacaatacaggagttggaaagtgaagttctcaatgcccttatggctcagaacccaaatatatataacattggtccacttcaattgttaggaaggcattttcctgataaagacaagggcttcaaggtgagtgggtcaaatctttggaaaaatgactcaaaatgtatccaatggctagaccaatgggaaccttcctcagtcatatatgtgaattatggaagtattactgtgatgtccgaggatcatttgaaagaatttgcttggggactagcaaatagcaatttaccatttttgtggataaaaaggccagatttggtaatgggtgagtccacacaattgccacaagacttcttagatgaggttaaagatagaggatacataacaagttggtgcccccaagagcaagtgctgtctcatccatcagttggggttttcctaactcattgtggctggaattctacactagaaggtataagtgggggtgtccctatgataggttggcctttctttgctgaacaacaaacaaattgcaggtacatatgcacaacttgggggataggaatggatattaaagatgatgtaaaaagggaggaggtgacaacacttgtgaaagaaatgataaccggagaaagggggaaggaaatgagacaaaagtgtctggagtggaaaaagaaagcaatagaagccactgatatgggaggatcatcatataatgatttccatcgattagtgaaggaggttcttcacaatgatgttgtt

SEQ ID NO: 11129 - DNA, 1758 bp, Artificial sequence
  miR resistant mutant
atgctaactcgtaaacgactcgtcgtttctctctctctcgccactctccttctcttctcatccctctctctctctctctgcgataaaaccccccctcaaaacgacaacaaaaaaaacaacaacgacgacgacgaagatctcagcttcctcgaggaatccgatgacgctgccaccacttctcaccaaggccattttccagatcccgacgagttcgacgaggacgacggcgacgacgaggacgacttcggcgacttcgctggcttcgaccactcgtcggaggaggcgttcaaggagcccgaggtggacgacaaggacgtcgtcgttttgaaggagcgcaacttcaccaccgtcgtcgagaacaaccgcttcgtcatggtcgagttctacgcgccctggtgcggccactgccaggccctcgcgccggagtacgccgccgccgccaccgagctcaagcccgacggcgtcgttctcgccaaggtcgacgccaccgtcgaaaacgaattggcgaacgagtacgacgttcagggtttccccaccgtcttcttcttcgtcgatggggtccacaagccctacactggccaaagaaccaaagacgctatagtgacatggattaagaagaagataggacctggtgtgtccaacattactacggtggaagaagctgaacgtgtattgaccgcgggaagcaaagttgttttgggcttccttaactctttggttggtgcagagagtgacgaactggctgcagcatcaaagcttgaggatgatgtcaatttttatcaaactgtggtagctgatgtggcgaagcttttccatattgatgcaagtgttaaacgccctgctttgatcttgctcaagaaagaggaggagaaattgaaccattttgatggccaatttgtaaaagctgaaatagctgattttgtaacctccaacaagcttcctttggttacaacttttactagagaaagtgccccggtaatctttgaaagtcaaatcaagaaacaattgttgctgtttgtgacttcaaatgatacagagaagtttgttccagtatttaaagaagcagcaaaaattttcaaggggaagctgatctttgttcatgtggaatcggataatgaagatgtaggaaagcctgttgcagattattttggtatcgcagggaatggtcccaaagtacttgcattcacaggaaatgatgatggaagaaaatttttgcttgatggagaggtgactattgacacaattacggcgtttgggaatgatttccttgaagacaagctaaaacctttcctcaagtcagatccagttcctgaaagcaatgatggtgatgtgaaaatagttgttggtaataactttgatgaaattgtcttggatgagtcaaaggatgttctgcttgagatttatgctccctggtgtggccactgccaagctctggaaccaacatacaacaagcttgctaaacatcttcgcagcattgagtctattgttatagccaagatggacggaacaacaaatgagcatcccagggccaaatctgatggattccccactcttctcttcttcccagcaggaaacaagagttctgaccctattcctgttgatgtggaccgtacagtgaaagacttttataagttcctcaggaaacatgcatcaatcccattccagctccagaaactagcctcaactactaaaaccgccagtgagagttctgatgtcaaggagagccagtcatcaacaacagaggtaaaggatgaatta

SEQ ID NO: 11130 - DNA, 1758 bp, Artificial sequence
  miR resistant mutant
atgctaactcgtaaacgactcgtcgtttctctctctctcgccactctccttctcttctcatccctctctctctctctctgcgataaaaccccccctcaaaacgacaacaaaaaaaacaacaacgacgacgacgaagatctcagcttcctcgaggaatccgatgacgctgccaccacttctcaccaaggccattttccagatcccgacgagttcgacgaggacgacggcgacgacgaggacgacttcggcgacttcgctggcttcgaccactcgtcggaggaggcgttcaaggagcccgaggtggacgacaaggacgtcgtcgttttgaaggagcgcaacttcaccaccgtcgtcgagaacaaccgcttcgtcatggtcgagttctacgcgccctggtgcggccactgccaggccctcgcgccggagtacgccgccgccgccaccgagctcaagcccgacggcgtcgttctcgccaaggtcgacgccaccgtcgaaaacgaattggcgaacgagtacgacgttcagggtttccccaccgtcttcttcttcgtcgatggggtccacaagccctacactggccaaagaaccaaagacgctatagtgacatggattaagaagaagataggacctggtgtgtccaacattactacggtggaagaagctgaacgtgtattgaccgcgggaagcaaagttgttttgggcttccttaactctttggttggtgcagagagtgacgaactggctgcagcatcaaagcttgaggatgatgtcaatttttatcaaactgtggtagctgatgtggcgaagcttttccatattgatgcaagtgttaaacgccctgctttgatcttgctcaagaaagaggaggagaaattgaaccattttgatggccaatttgtaaaagctgaaatagctgattttgtaacctccaacaagcttcctttggttacaacttttactagagaaagtgccccggtaatctttgaaagtcaaatcaagaaacaattgttgctgtttgtgacttcaaatgatacagagaagtttgttccagtatttaaagaagcagcaaaaattttcaaggggaagctgatctttgttcatgtggaatcggataatgaagatgtaggaaagcctgttgcagattattttggtatcgcagggaatggtcccaaagtacttgcattcacaggaaatgatgatggaagaaaatttttgcttgatggagaggtgactattgacacaattacggcgtttgggaatgatttccttgaagacaagctaaaacctttcctcaagtcagatccagttcctgaaagcaatgatggtgatgtgaaaatagttgttggtaataactttgatgaaattgtcttggatgagtcaaaggatgttctgcttgagatttatgctccctggtgtggccactgccaagctctggaaccaacatacaacaagcttgctaaacatcttcgcagcattgagtctattgttatagccaagatggacggaacaacaaatgagcatcccagggccaaatctgatggattccccactcttctcttcttcccagcaggaaacaagagttctgaccctattcctgttgatgtggaccgtacagtgaaagacttttataagttcctcaggaaacatgcatcaatcccattccagctccagaaactagcctcaactactaaaaccgccagtgagagttctgatgtcaaggagagccagagcagcacaacagaggtaaaggatgaatta

SEQ ID NO: 11131 - DNA, 1233 bp, Artificial sequence
  miR resistant mutant
atgggttgctcagcctcaagaaccatcaccatagtggccaacaacaataaccaagaggatccatctccttctgcttctcttgcttcttcttcttcttccttctcttcctcttctgcttcacacaaatccatcaatagcgcaagcagccccgccgcggcaccagttagaagaagaactctttctctcccaatgcctctcgttcatcatcctcccatcaaaaagggtgactcacaccaccttgtctctctcacctccaccacctatggctcccttctccccattgaccaaaaagactcaaactttacccaaaaaaaccaaccccacataaccaaaacctcaaaccaaactgacccagaacactcactctccccggactcagtcatcaacacttgggaactcatggatggcttagatgaagaacaagaacaagaacaagaaattgcaaatgccaagaagcttccttacgcttccattttggacaaaccaagttcatgcaggtacacagcatttgatggttctgcaaggaagaaacttctagattcctttgaatcaatgaaaacttcacaaacagcaatggaaaaggacttaaactcttcttcttctacatctcctgcaccaacaacgaagaagccactttggcagcacttatctgaggaagctttgcttgctaagttggatccaagtgtggcttggagttacagaagagcattatcatcaaggaatctagatagaaacattctatctagagatgttaggtcaatggggtctagcccttttttgtgccgtttgtctggcactgaggacagaatagtgctttattgcactagtttgagagggatccgaaagacctatgaggattgttgttcggttaggatgattctgaggggcttcagagttgcggttgatgagagggacatctcaatggattcgtcctataggaaggagttgaaggatttgcttggtggaaaagcagaagtgacattgcctcaggtctttatcagagggaggtatgtggggaatgctgaggacatgaagcatctgaatgagtctggggcaattgggtttcccactcaggatccaggctttgtgtgtgacaactgtggtgatgccaggtttgtgccatgccccaattgcagtggtagcaggaaggtgtttgagcatgaagatggagggttgagaaggtgccctgaatgcaatgagaatggcttgataagatgtccaggttgcggctca

SEQ ID NO: 11132 - DNA, 1233 bp, Artificial sequence
  miR resistant mutant
atgggttgctcagcctcaagaaccatcaccatagtggccaacaacaataaccaagaggatccatctccttctgcttctcttgcttcttcttcttcttccttctcttcctcttctgcttcacacaaatccatcaacagcgcaagcagccccgccgcggcaccagttagaagaagaactctttctctcccaatgcctctcgttcatcatcctcccatcaaaaagggtgactcacaccaccttgtctctctcacctccaccacctatggctcccttctccccattgaccaaaaagactcaaactttacccaaaaaaaccaaccccacataaccaaaacctcaaaccaaactgacccagaacactcactctccccggactcagtcatcaacacttgggaactcatggatggcttagatgaagaacaagaacaagaacaagaaattgcaaatgccaagaagcttccttacgcttccattttggacaaaccaagttcatgcaggtacacagcatttgatggttctgcaaggaagaaacttctagattcctttgaatcaatgaaaacttcacaaacagcaatggaaaaggacttaaactcttcttcttctacatctcctgcaccaacaacgaagaagccactttggcagcacttatctgaggaagctttgcttgctaagttggatccaagtgtggcttggagttacagaagagcattatcatcaaggaatctagatagaaacattctatctagagatgttaggtcaatggggtctagcccttttttgtgccgtttgtctggcactgaggacagaatagtgctttattgcactagtttgagagggatccgaaagacctatgaggattgttgttcggttaggatgattctgaggggcttcagagttgcggttgatgagagggacatctcaatggattcgtcctataggaaggagttgaaggatttgcttggtggaaaagcagaagtgacattgcctcaggtctttatcagagggaggtatgtggggaatgctgaggacatgaagcatctgaatgagtctggggcaattgggtttcccactcaggatccaggctttgtgtgtgacaactgtggtgatgccaggtttgtgccatgccccaattgcagtggtagcaggaaggtgtttgagcatgaagatggagggttgagaaggtgccctgaatgcaatgagaatggcttgataagatgtccaggttgcggctca

SEQ ID NO: 11133 - DNA, 582 bp, Artificial sequence
  miR resistant mutant
atgaagaagatactagtatcaatcaagttcctgttttgtttttctctgctctgtgttttgttctcttcacttcctttactccttcaatccttgaagccatccctcatgcaattcttcagctacttggttgaaaaaagctacatgttccttttctgcaatggcctccttcttgttttaatagccatcaactctgctccaataaacgcaagcagcccccccaccactgaacgtgctgctttttctgttcacatagaagagaatagcagccagttagaatccaaggaaccagacattgcagttgcagcagcaccaattgctgctgaggaaactgaattcccacaagaagaggaaaatgttttggagatagtagaacgagaaaatgtgctatcagatacccaagaagggggaaatgcccttgttaccattgatgaagatgtgcatgacactgaagagttaaataagaaatgtgaagattttattaaaaggatgaaagcaacgttctcttccactaacttggagctaagggctgtcgacagattttattttgataatcgatcatgtctcatgaatctccctttcttt

SEQ ID NO: 11134 - DNA, 582 bp, Artificial sequence
  miR resistant mutant
atgaagaagatactagtatcaatcaagttcctgttttgtttttctctgctctgtgttttgttctcttcacttcctttactccttcaatccttgaagccatccctcatgcaattcttcagctacttggttgaaaaaagctacatgttccttttctgcaatggcctccttcttgttttaatagccatcaactctgctccaatcaacgcaagcagcccccccaccactgaacgtgctgctttttctgttcacatagaagagaatagcagccagttagaatccaaggaaccagacattgcagttgcagcagcaccaattgctgctgaggaaactgaattcccacaagaagaggaaaatgttttggagatagtagaacgagaaaatgtgctatcagatacccaagaagggggaaatgcccttgttaccattgatgaagatgtgcatgacactgaagagttaaataagaaatgtgaagattttattaaaaggatgaaagcaacgttctcttccactaacttggagctaagggctgtcgacagattttattttgataatcgatcatgtctcatgaatctccctttcttt

SEQ ID NO: 11135 - DNA, 1320 bp, Artificial sequence
  miR resistant mutant
atgggttgctcagcctcaagaaccatcaccatagtggccaacaacaataaccaagaggatccatctccttctgcttctcttgcttcttcttcttcttccttctcttcctcttctgcttcacacaaatccatcaatagcgcaagcagccccgccgcggcaccagttagaagaagaactctttctctcccaatgcctctcgttcatcatcctcccatcaaaaagggtgactcacaccaccttgtctctctcacctccaccacctatggctcccttctccccattgaccaaaaagactcaaactttacccaaaaaaaccaaccccacataaccaaaacctcaaaccaaactgacccagaacactcactctccccggactcagtcatcaacacttgggaactcatggatggcttagatgaagaacaagaacaagaacaagaaattgcaaatgccaagaagcttccttacgcttccattttggacaaaccaagttcatgcaggtacacagcatttgatggttctgcaaggaagaaacttctagattcctttgaatcaatgaaaacttcacaaacagcaatggaaaaggacttaaactcttcttcttctacatctcctgcaccaacaacgaagaagccactttggcagcacttatctgaggaagctttgcttgctaagttggatccaagtgtggcttggagttacagaagagcattatcatcaaggaatctagatagaaacattctatctagagatgttaggtcaatggggtctagccctttgatctttcattcttcttcttcttgttcttcttcttctttttcatttggtaagaataataatattaataatagtttgtgccgtttgtctggcactgaggacagaatagtgctttattgcactagtttgagagggatccgaaagacctatgaggattgttgttcggttaggatgattctgaggggcttcagagttgcggttgatgagagggacatctcaatggattcgtcctataggaaggagttgaaggatttgcttggtggaaaagcagcagtgacattgcctcaggtctttatcagagggaggtatgtggggaatgctgaggaaatgaagcatctgaatgagtctggggaattggcaaggcttttggagggttttcccactcaggatccagggtttgtgtgtgacaactgtggtgatgccaggtttgtgccatgccccaattgcagtggtagcaggaaggtgtttgagcatgaagatggagggttgagaaggtgccctgaatgcaatgagaatggcttgataagatgtccaggttgcggctca

SEQ ID NO: 11136 - DNA, 1320 bp, Artificial sequence
  miR resistant mutant
atgggttgctcagcctcaagaaccatcaccatagtggccaacaacaataaccaagaggatccatctccttctgcttctcttgcttcttcttcttcttccttctcttcctcttctgcttcacacaaatccatcaacagcgcaagcagccccgccgcggcaccagttagaagaagaactctttctctcccaatgcctctcgttcatcatcctcccatcaaaaagggtgactcacaccaccttgtctctctcacctccaccacctatggctcccttctccccattgaccaaaaagactcaaactttacccaaaaaaaccaaccccacataaccaaaacctcaaaccaaactgacccagaacactcactctccccggactcagtcatcaacacttgggaactcatggatggcttagatgaagaacaagaacaagaacaagaaattgcaaatgccaagaagcttccttacgcttccattttggacaaaccaagttcatgcaggtacacagcatttgatggttctgcaaggaagaaacttctagattcctttgaatcaatgaaaacttcacaaacagcaatggaaaaggacttaaactcttcttcttctacatctcctgcaccaacaacgaagaagccactttggcagcacttatctgaggaagctttgcttgctaagttggatccaagtgtggcttggagttacagaagagcattatcatcaaggaatctagatagaaacattctatctagagatgttaggtcaatggggtctagccctttgatctttcattcttcttcttcttgttcttcttcttctttttcatttggtaagaataataatattaataatagtttgtgccgtttgtctggcactgaggacagaatagtgctttattgcactagtttgagagggatccgaaagacctatgaggattgttgttcggttaggatgattctgaggggcttcagagttgcggttgatgagagggacatctcaatggattcgtcctataggaaggagttgaaggatttgcttggtggaaaagcagcagtgacattgcctcaggtctttatcagagggaggtatgtggggaatgctgaggaaatgaagcatctgaatgagtctggggaattggcaaggcttttggagggttttcccactcaggatccagggtttgtgtgtgacaactgtggtgatgccaggtttgtgccatgccccaattgcagtggtagcaggaaggtgtttgagcatgaagatggagggttgagaaggtgccctgaatgcaatgagaatggcttgataagatgtccaggttgcggctca

SEQ ID NO: 11137 - DNA, 1113 bp, Artificial sequence
  miR resistant mutant
atggcgactcctgttgagcctccaaatgggatcagaactgaagggaagcattattattccatgtggcaaaccctgtttgagattgactcaaaatacgttcccatcaagccgattggtcgcggagcatatggaattgtgtgctcttctgtgaatagagagataaatgagaaggttgccatcaagaagatacagaatgcctttgaaaaccgggttgatgccctgaggactttgcgcgagttaaaattattaagacatttacaccatgagaatgtgattgctttgaaggacatcatgatgcctgttcacaggaatagtttcaaggatgtctatctggtttatgaactcatggacacggatttgcatcagattattaagtcttctcaagctttgtctaatgatcactgccagtatttcctctttcagttgctccggggcttgaaatatcttcactccgctaacattcttcatcgtgacttgaaacctgggaatcttctaatcaatgcaaattgtgacctaaaaatatgtgatttcgggctagctcgtactaattgcagcaagaaccagttcatgaccgagtatgttgtcactcggtggtatagggcaccagagctcctactctgctgtgacaactatgggacatctattgatgtttggtcagttggatgtatctttgcagagcttcttggccgaaaaccgattttccctggttcagagtgtctcaaccagctgaagttgattatcaatatccttggtagtcaaagggaggaggatattgaattcattgataacccaaaggcaaagaagtatatcaaatcacttccttattctcctggaacccccctttcgcaactttatcctaatgcgcatccattggcaattgatcttctggcaaagatgcttgttttcgatccaacaaagaggatcagtgtcactcaagcacttcaacacccttacatggcccctctgtatgatcctaactgtgaccctccagccgtcattccaattgatcttgacattgatgaggatctaggggaagagatgataagggacatgatgtggaaagaaatgcttcattaccatcctgaatctgctatggagagtgcagggttgtgc

SEQ ID NO: 11138 - DNA, 1113 bp, Artificial sequence
  miR resistant mutant
atggcgactcctgttgagcctccaaatgggatcagaactgaagggaagcattattattccatgtggcaaaccctgtttgagattgactcaaaatacgttcccatcaagccgattggtcgcggagcatatggaattgtgtgctcttctgtgaatagagagataaatgagaaggttgccatcaagaagatacagaatgcctttgaaaaccgggttgatgccctgaggactttgcgcgaattaaaattattaagacatttacaccatgagaatgtgattgctttgaaggacatcatgatgcctgttcacaggaatagtttcaaggatgtctatctggtttatgaactcatggacacggatttgcatcagattattaagtcttctcaagctttgtctaatgatcactgccagtatttcctctttcagttgctccggggcttgaaatatcttcactccgctaacattcttcatcgtgacttgaaacctgggaatcttctaatcaatgcaaattgtgacctaaaaatatgtgatttcgggctagctcgtactaattgcagcaagaaccagttcatgaccgagtatgttgtcactcggtggtatagggcaccagagctcctactctgctgtgacaactatgggacatctattgatgtttggtcagttggatgtatctttgcagagcttcttggccgaaaaccgattttccctggttcagagtgtctcaaccagctgaagttgattatcaatatccttggtagtcaaagggaggaggatattgaattcattgataacccaaaggcaaagaagtatatcaaatcacttccttattctcctggaacccccctttcgcaactttatcctaatgcgcatccattggcaattgatcttctggcaaagatgcttgttttcgatccaacaaagaggatcagtgtcactcaagcacttcaacacccttacatggcccctctgtatgatcctaactgtgaccctccagccgtcattccaattgatcttgacattgatgaggatctaggggaagagatgataagggacatgatgtggaaagaaatgcttcattaccatcctgaatctgctatggagagtgcagggttgtgc

SEQ ID NO: 11139 - DNA, 2130 bp, Artificial sequence
  miR resistant mutant
atgggaagcaactttctctctccaccagctaagcgctccgcacccgacccgtatccgtttcatccaaacggaccttcaaagcgctccaggcaatccaagcctccgcctccgctgtccgtgccgcccggccacgtggccttccgcctcctctgcaacgcctcccgaatcggcggcgtaatcggcaagtccggctccgtcatcaaaactctccagcaatccacgggcgccaagatccgaatcgaggatgcgccacaggagttgccggaccgcatcatcctggtaattgctgacgccgcactcagcggcaagattctgctgagaaacgaagaggtcattgaggtgtcgaaggcgcaggaagcgctgctgaaggtgttcgataggatccttcgaagtggcggcggagaccgaagcgtcgacgttggggacagggtgatgtcttgccggctcgtggcggacgcggcgcaggccggctctgtcatcggcaagggagggaaggtggtggagaggatcaagaaggaaaccgggtgtaaaattagggtattaactgatgatttgccactttgtgcctccgcttccgatgaaatcattgagatagaaggcagagtgtcatccgtaaagaaggcacttgttgcggtctcccaacgtcttcaagattgtcatcctgttgatagaacaaagatgatggggagcaaaccttatgaaatagttcagtatgaagctttagatgcacttcctcgtgcaacttcaactgcagctccacgtgtgactttaactgcagctccgcgtgggactttaactgctgtacaacatgagactgtagatcatcttttgctgaggagctctgcactgtctactttatccagttcctctaacagctatgccaccagaattcattcactgccaacagaagttaatagagtctcatccttggaaccaaaagcacttaagcaggaagtcaccttcagaatactttgttcaaatgatagagttggaggagttattggaaagggaggcaatattgttagagctcttcagagtgagacaggggctacaataagtattggtcctgcagtagctgagtgcgaggatcgattaattactattgctgcttcagagaatcctgagtcaagatattcccctgcacaaaaggctgctgtgcttgttttctccaggtccattgaggttggttttgagaaggggctagactctggattaaataaggggtcaattgttactgtacgtcttgtagtcccatcaagccaagttggttgtttgataggaaaaggtggagtaatagtttcagaaatgcgaaaggcaactggggctaacataagaataattgggactgatcaggtgccaaaatgtgcatcagataatgatcaagtcgtacagatatcaggagagttttcaagtgtgcaagatgcattatataatgcaatgggtagactgcgagataatctttttgtcagcacacagaatagtgctggaacaaggagcctttcttctctacgagttgataccagtccctatgggagacagcaggatgttgttcctcttggaagtcaactgcccccagccacttctcatagtctgagtagacatacttttgctcaaggcattgatcatcttggtctttctagaaatttagatcatccttcttcaccagggttatggactagaaatttagatagaccaagcagccccggattatggactagaaatttagatcgtccttcttcaccggggttatggactagaaatttagatcatcgtccttcttcaccagggttatgggcgccaccaacagtggctgggataaattccagaggcattaatgattttagtttgggattgacatctcgaaaaggcggcttagaacttgtgagtggaagtaaatctgctatcgtgactaatacgattgtagaaattgtggttcctgatgatactattgactgtgtatacggggaaaatggtagcaatttggctcgtctaagacagatatcgggtgccaatgttgttgtccatgagcctcgtcccggaacaagtgacaggattattgtcatatccggtacaccagatgaaacccaagcagcgcagagcctcctccaagcatttattcttagtggctca

SEQ ID NO: 11140 - DNA, 2130 bp, Artificial sequence
  miR resistant mutant
atgggaagcaactttctctctccaccagctaagcgctccgcacccgacccgtatccgtttcatccaaacggaccttcaaagcgctccaggcaatccaagcctccgcctccgctgtccgtgccgcccggccacgtggccttccgcctcctctgcaacgcctcccgaatcggcggcgtaatcggcaagtccggctccgtcatcaaaactctccagcaatccacgggcgccaagatccgaatcgaggatgcgccacaggagttgccggaccgcatcatcctggtaattgctgacgccgcactcagcggcaagattctgctgagaaacgaagaggtcattgaggtgtcgaaggcgcaggaagcgctgctgaaggtgttcgataggatccttcgaagtggcggcggagaccgaagcgtcgacgttggggacagggtgatgtcttgccggctcgtggcggacgcggcgcaggccggctctgtcatcggcaagggagggaaggtggtggagaggatcaagaaggaaaccgggtgtaaaattagggtattaactgatgatttgccactttgtgcctccgcttccgatgaaatcattgagatagaaggcagagtgtcatccgtaaagaaggcacttgttgcggtctcccaacgtcttcaagattgtcatcctgttgatagaacaaagatgatggggagcaaaccttatgaaatagttcagtatgaagctttagatgcacttcctcgtgcaacttcaactgcagctccacgtgtgactttaactgcagctccgcgtgggactttaactgctgtacaacatgagactgtagatcatcttttgctgaggagctctgcactgtctactttatccagttcctctaacagctatgccaccagaattcattcactgccaacagaagttaatagagtctcatccttggaaccaaaagcacttaagcaggaagtcaccttcagaatactttgttcaaatgatagagttggaggagttattggaaagggaggcaatattgttagagctcttcagagtgagacaggggctacaataagtattggtcctgcagtagctgagtgcgaggatcgattaattactattgctgcttcagagaatcctgagtcaagatattcccctgcacaaaaggctgctgtgcttgttttctccaggtccattgaggttggttttgagaaggggctagactctggattaaataaggggtcaattgttactgtacgtcttgtagtcccatcaagccaagttggttgtttgataggaaaaggtggagtaatagtttcagaaatgcgaaaggcaactggggctaacataagaataattgggactgatcaggtgccaaaatgtgcatcagataatgatcaagtcgtacagatatcaggagagttttcaagtgtgcaagatgcattatataatgcaatgggtagactgcgagataatctttttgtcagcacacagaatagtgctggaacaaggagcctttcttctctacgagttgataccagtccctatgggagacagcaggatgttgttcctcttggaagtcaactgcccccagccacttctcatagtctgagtagacatacttttgctcaaggcattgatcatcttggtctttctagaaatttagatcatccttcttcaccagggttatggactagaaatttagacagaccaagcagccccggattatggactagaaatttagatcgtccttcttcaccggggttatggactagaaatttagatcatcgtccttcttcaccagggttatgggcgccaccaacagtggctgggataaattccagaggcattaatgattttagtttgggattgacatctcgaaaaggcggcttagaacttgtgagtggaagtaaatctgctatcgtgactaatacgattgtagaaattgtggttcctgatgatactattgactgtgtatacggggaaaatggtagcaatttggctcgtctaagacagatatcgggtgccaatgttgttgtccatgagcctcgtcccggaacaagtgacaggattattgtcatatccggtacaccagatgaaacccaagcagcgcagagcctcctccaagcatttattcttagtggctca

SEQ ID NO: 11141 - DNA, 633 bp, Artificial sequence
  miR resistant mutant
atgaacgataacatgaccgccatggctgatcaatgcattcatgatccatccatagaaagactcatggatgcaaccatgtcatcatcatcagagggcatgatgatgttgagaccaaccaattcacacaactacacaacaagtggccacaatttaactccaaagggttgtgcattcaaaccaatccgaaggagatctagaacttctaagagcactccaattacccttctcaaagccaacacctccaatttcagggcattggtacaacaattcactgggtgtcctaccacaaccaccatgtcacttgcaatccataagggtcccattaccttaaatttccaacaagatggtaccaaacaacatattcatcacgatcagcatcacacaaaaataacaactagaggagcaatgccaccatttgccaccataagttctaaccaaaatcacgcaagcgtacccttccctaagcaacaattgatgcaagagcagcaaagtggatactttcttccaacttattcgggtaactcatataggccaattagctgcatggatgatggattgatctttgataatgattttagtttgcatgaactaactgtgaatgccatctccaatgatagcgatggtttatttatg

SEQ ID NO: 11142 - DNA, 633 bp, Artificial sequence
  miR resistant mutant
atgaacgataacatgaccgccatggctgatcaatgcattcatgatccatccatagaaagactcatggatgcaaccatgtcatcatcatcagagggcatgatgatgttgagaccaaccaattcacacaactacacaacaagtggccacaatttaactccaaagggttgtgcattcaaaccaatccgaaggagatctagaacttctaagagcactccaattacccttctcaaagccaacacctccaatttcagggcattggtacaacaattcactgggtgtcctaccacaaccaccatgtcacttgcaatccataagggtcccattaccttaaatttccaacaagatggtaccaaacaacatattcatcacgatcagcatcacacaaaaataacaactagaggagcaatgccaccatttgccaccataagttctaaccaaaaccacgcaagcgtacccttccctaagcaacaattgatgcaagagcagcaaagtggatactttcttccaacttattcgggtaactcatataggccaattagctgcatggatgatggattgatctttgataatgattttagtttgcatgaactaactgtgaatgccatctccaatgatagcgatggtttatttatg

SEQ ID NO: 11143 - DNA, 1041 bp, Artificial sequence
  miR resistant mutant
atgaagctaagtacattgtttttgtttttgtttcatctggctcatgctgctctgtctgacgaagctactttcattagagatggcctcaaatcctattcccagcttgatctccctcactcggtttttggttctgaaagtgtagccttcgattgccatggtaaaggaccatatgttggcgtgtctgatggtagaatcctcaagtggcacgagacaaagagagagtggattgactttgcagttacctcgccacacaggaacaagaaattatgtgatgggttaacaaatgacaagatggaatcaatgtgtggaagacccttgggcctcaaattcaacactttaacttgtgaactgtacattgccgatgcatactttgggcttctggtggtaggaccaggtggtggtgtggcaaagcagttagccacttctgcggaaggggtaccatttaggttcacaaatgccttggacatcgacaccaaaacaggtgaagtatatttcacagatagcagcatcatgttccaaagaagggtatacatatcaataattctgagcggggatagaactggaaggttactaaaatacgttccaagtacccaaagtgtacatgttttggtcaaaggtttagcattccctaacggcgtggcgcttagcaaggacaattccttcattatagtagcagaatcaaccacttttaaaattctcaagattcaagttagagactccaagaccaacaacaacaatatagaaccttttgcacaggttccacgctccccagataacataaagaggaacgccaaaggagaattttgggtagcgctgaacagtggcaggggattgattcagaaattggaaaatgaaatcgaaaccacacttccttggaatgcagatcctgtggcaattaaatttgatgaaaaggggagggccattgaggtattagatggagaatatggacgacaactggactctgttagtgaagtggaagaacatgaaggaagtttgtggataggctctgcggtgcaaccatacattggtcttataaaagct

SEQ ID NO: 11144 - DNA, 1041 bp, Artificial sequence
  miR resistant mutant
atgaagctatccacattgtttttgtttttgtttcatctggctcatgctgctctgtctgacgaagctactttcattagagatggcctcaaatcctattcccagcttgatctccctcactcggtttttggttctgaaagtgtagccttcgattgccatggtaaaggaccatatgttggcgtgtctgatggtagaatcctcaagtggcacgagacaaagagagagtggattgactttgcagttacctcgccacacaggaacaagaaattatgtgatgggttaacaaatgacaagatggaatcaatgtgtggaagacccttgggcctcaaattcaacactttaacttgtgaactgtacattgccgatgcatactttgggcttctggtggtaggaccaggtggtggtgtggcaaagcagttagccacttctgcggaaggggtaccatttaggttcacaaatgccttggacatcgacaccaaaacaggtgaagtatatttcacagatagcagcatcatgttccaaagaagggtatacatatcaataattctgagcggggatagaactggaaggttactaaaatacgttccaagtacccaaagtgtacatgttttggtcaaaggtttagcattccctaacggcgtggcgcttagcaaggacaattccttcattatagtagcagaatcaaccacttttaaaattctcaagattcaagttagagactccaagaccaacaacaacaatatagaaccttttgcacaggttccacgctccccagataacataaagaggaacgccaaaggagaattttgggtagcgctgaacagtggcaggggattgattcagaaattggaaaatgaaatcgaaaccacacttccttggaatgcagatcctgtggcaattaaatttgatgaaaaggggagggccattgaggtattagatggagaatatggacgacaactggactctgttagtgaagtggaagaacatgaaggaagtttgtggataggctctgcggtgcaaccatacattggtcttataaaagct

SEQ ID NO: 11145 - DNA, 1968 bp, Artificial sequence
  miR resistant mutant
atgaaacagaaacacgccttctttaaatccccaaatcttaatttctgcccatttagccatagtcatagtgtacatcgccgtttacgcgtcgcagatattcctctctcagacgaagatcacgacggcgacgccgtccgagaaacaccgtcgaccaaatgcttttcgcctcggaggctcgttgcttcgctgctcgcaccgctgaggccgaccaagggtctccgactccagcaacggcgccagaacgagaccggtgatttggaggcgccgtcgccgtcgtcgccgacgaacgaacttaaagggagcgacgaatcgaataatcagatatacgagaaactaatgtttgcttttcttttagggatgaaaaaggcaaaaatgctttacacttttactctttcatcgacttcaggacagttacatgagagtgatacatcttttaagctaggggttggttgtggtttgctatatctgattgcagcaagtaaaaatgagctcagcaagatgattgagctgcagaaagaaatggaaatgctccttcaaaatgcgaaaggggaactgcaaagtaaagattcacttcttaagccattgaaacaaagtgacacacttgccctttccataactgatattcaagaagtttccagctctagtagtcatctttctattcattcgaatatacaatatgttcaaccagagtcaaaaagcgatacggttcctaatcggtttctggaatataacactagcgaacaagatgaatgtgcagaagagataaatgagctccgggcagaatttgaaattgagttgcagcgcttgcagttgtatttggatggagaagctggatttgatgatgcacaacaagagggagtcaaggtaactcttgaggattctagttcaaaaagccatagttcaagttttggtgaaataataatggaacctcaaggagcaacttatgatgtatcttttggagttcctccaattgaattggagagaaggttgcatgaactgcttgaagcaagactggaagaacggatatcagagctggagtctgcattagaatgtaagacgcaaaagcttattaagaaagagatagaggttacttggtggaaagacactgcacaacttatctcacaacatgttccagaaacttctcggttcacttttccacttgatcctgatatttctttgaagttgagtcaacttggaggagtacaaaatggcggaaaggcagagtataactatacggttgattcggcgagagcgtctttggttagacaagaggacaccatcatttttggtttgattgagagagccaggttccccttaaattctccaacctacaatcaaagttacgcttccattcctcaatttcgtggcacattgctcgattttctcgttcgtgacacggaggtcattcaagctaaggctggaagatacactaaccttgaagaaaatcctttcttcccagaaaatttaccaccttcggttgagccacattaccccttctcacagtttttgcatccttcagccgctatgatcaacataaacaatgtcatttggaaactgtacattgatgagctgcttccaatatttgttgcttctggtgatgatggaaactatgcacaaactgctgctaccgatctttcattgttgcaggcaatctctagaaggattcattacggaaagtttattgccgaggccaaattcagagaatctcctaaaggctatgagcctttaattcgtgctaaggacaaagaagcattgatgaaattattgacaattgagagcgttgaagagatggtggtgaagagggttaaaaagaaggccatggtgttagggcaggaagtgagccttgatcgtaatgtcaagggaataaaatacaaggttgatccatcagtagtttctttcttgtaccagaaatggttaatacccctcacaaaaaacgttgaagtcgaatacttattaagccgcttagac

SEQ ID NO: 11146 - DNA, 1968 bp, Artificial sequence
  miR resistant mutant
atgaaacagaaacacgccttctttaaatccccaaatcttaatttctgtccatttagccatagtcatagtgtacatcgccgtttacgcgtcgcagatattcctctctcagacgaagatcacgacggcgacgccgtccgagaaacaccgtcgaccaaatgcttttcgcctcggaggctcgttgcttcgctgctcgcaccgctgaggccgaccaagggtctccgactccagcaacggcgccagaacgagaccggtgatttggaggcgccgtcgccgtcgtcgccgacgaacgaacttaaagggagcgacgaatcgaataatcagatatacgagaaactaatgtttgcttttcttttagggatgaaaaaggcaaaaatgctttacacttttactctttcatcgacttcaggacagttacatgagagtgatacatcttttaagctaggggttggttgtggtttgctatatctgattgcagcaagtaaaaatgagctcagcaagatgattgagctgcagaaagaaatggaaatgctccttcaaaatgcgaaaggggaactgcaaagtaaagattcacttcttaagccattgaaacaaagtgacacacttgccctttccataactgatattcaagaagtttccagctctagtagtcatctttctattcattcgaatatacaatatgttcaaccagagtcaaaaagcgatacggttcctaatcggtttctggaatataacactagcgaacaagatgaatgtgcagaagagataaatgagctccgggcagaatttgaaattgagttgcagcgcttgcagttgtatttggatggagaagctggatttgatgatgcacaacaagagggagtcaaggtaactcttgaggattctagttcaaaaagccatagttcaagttttggtgaaataataatggaacctcaaggagcaacttatgatgtatcttttggagttcctccaattgaattggagagaaggttgcatgaactgcttgaagcaagactggaagaacggatatcagagctggagtctgcattagaatgtaagacgcaaaagcttattaagaaagagatagaggttacttggtggaaagacactgcacaacttatctcacaacatgttccagaaacttctcggttcacttttccacttgatcctgatatttctttgaagttgagtcaacttggaggagtacaaaatggcggaaaggcagagtataactatacggttgattcggcgagagcgtctttggttagacaagaggacaccatcatttttggtttgattgagagagccaggttccccttaaattctccaacctacaatcaaagttacgcttccattcctcaatttcgtggcacattgctcgattttctcgttcgtgacacggaggtcattcaagctaaggctggaagatacactaaccttgaagaaaatcctttcttcccagaaaatttaccaccttcggttgagccacattaccccttctcacagtttttgcatccttcagccgctatgatcaacataaacaatgtcatttggaaactgtacattgatgagctgcttccaatatttgttgcttctggtgatgatggaaactatgcacaaactgctgctaccgatctttcattgttgcaggcaatctctagaaggattcattacggaaagtttattgccgaggccaaattcagagaatctcctaaaggctatgagcctttaattcgtgctaaggacaaagaagcattgatgaaattattgacaattgagagcgttgaagagatggtggtgaagagggttaaaaagaaggccatggtgttagggcaggaagtgagccttgatcgtaatgtcaagggaataaaatacaaggttgatccatcagtagtttctttcttgtaccagaaatggttaatacccctcacaaaaaacgttgaagtcgaatacttattaagccgcttagac

SEQ ID NO: 11147 - DNA, 951 bp, Artificial sequence
  miR resistant mutant
atggcaatgctggccaagaccgactccgaggttagcagcctcacgcagtcctcgccgacgcgatccccgcgacgggcagtgtactatgtgcagagcccgtcgcgagactcatcgcacgacggggagaagactacgaactcgtttcactcgagtccgctgcagagcccattgggctccccaccacatagtcatagtaatagtagtttgggccatcactcgcgcgagtccgcctccacgcgcttctctggctcgcgcaagagcagctcctcgggcaacaaccgcaagggcccgtggcggccctggaaggaccagttccatgccatcgaggaggagggcctcatcgatgctcacgacaatgcccgtggcttccctcgttgctgctatttcccagcatttgtcatcggcttcgtcctcctcttctccgcattctccctcattctctggggtgctagtcgcccccaaaagcccgccatttctctcaagagtataacctttgatcaattcgtgatacaagccggagcggacatgtcaggagttgccacaagtttggtgtccatgaattcatctgtgaaaatgacgtttcgtaacaccgctacatttttcggggtccatgtgacctcaactcccgtggatctcaattattatcaacttactctagccactggaactatgccaaagttttatcaatctaggaagagccaaagatctgttagagtgatggtgattgggagtcatataccactgtacggaggaggagcaaacctgaacagtgtgaacggtaaaccggttgaaccggtgccactgacgttgagcgtgatggtgcggtctagggcttatgttttgggcaaattggtgaagccaaagttctacaagaaaatagagtgttccatcgttatggatccgaagaagatgggcaaggccatttcactggtcaagaaatgcacttaccag

SEQ ID NO: 11148 - DNA, 951 bp, Artificial sequence
  miR resistant mutant
atggcaatgctggccaagaccgactccgaggttagcagcctcacgcagtcctcgccgacgcgatccccgcgacgggcagtgtactatgtgcagagcccgtcgcgagactcatcgcacgacggggagaagactacgaactcgtttcactcgagtccgctgcagagcccattgggctccccgccgcatagtcatagtaatagtagtttgggccatcactcgcgcgagtccgcctccacgcgcttctctggctcgcgcaagagcagctcctcgggcaacaaccgcaagggcccgtggcggccctggaaggaccagttccatgccatcgaggaggagggcctcatcgatgctcacgacaatgcccgtggcttccctcgttgctgctatttcccagcatttgtcatcggcttcgtcctcctcttctccgcattctccctcattctctggggtgctagtcgcccccaaaagcccgccatttctctcaagagtataacctttgatcaattcgtgatacaagccggagcggacatgtcaggagttgccacaagtttggtgtccatgaattcatctgtgaaaatgacgtttcgtaacaccgctacatttttcggggtccatgtgacctcaactcccgtggatctcaattattatcaacttactctagccactggaactatgccaaagttttatcaatctaggaagagccaaagatctgttagagtgatggtgattgggagtcatataccactgtacggaggaggagcaaacctgaacagtgtgaacggtaaaccggttgaaccggtgccactgacgttgagcgtgatggtgcggtctagggcttatgttttgggcaaattggtgaagccaaagttctacaagaaaatagagtgttccatcgttatggatccgaagaagatgggcaaggccatttcactggtcaagaaatgcacttaccag

SEQ ID NO: 11149 - DNA, 954 bp, Artificial sequence
  miR resistant mutant
atgacaatgctggccaaaaccgactccgaggttagcagcctcacgcagtcttcgccggcgcggtccccgcgacgggacgtgtactacgtgcaaagtccgtcgcgggactcgtcccacgacggcgagaagactacgaactcgttccactcgagtccgctgcagagccccttaggctccccaccacatagtcatagtaatagtagtctgggccgccactcccgcgagtccgcctccacgcggttctcgggctcacgcaagagcagctcctccggcaacaaccgcaagggtccgtggaggccctggaaggaccagttccacgccatcgaggaagagggcctcctcgaccccaacgacaatgcccaccatggcttccctcgtcgctgctatttccccgcgtttgtcgtcggcttcgtcgtcctcttctccgcgttctccctcattctctggggtgctagtcgccctcaaaagcccgccatttctctcaagagtataacgtttgaccaattcgtgatacaagcgggagcggatatgtcaggagttgccacaagtttggtgtccatgaattcatctgtgaaaatgacgtttcgtaacaccgctacatttttcggggtccatgtgacctcaactcccgtggatctcaattattatcaacttactgtagccactggaactatgccaaagttttatcaatcaaggaagagccaaagatctgttcgggtaatggtaattgggagtcatattccactgtacggaggtggagccaacctgaacagtgtgaacggtaaaccggttgaaccggtgccgttgacgttgagcgtgatggtgcggtcgagggcttatgttttaggcaaattggtgaagccaaagttctacaagaaaatagagtgttccatcgttatggatccgaagaagatgggcaaggcaatttcactcgtcaagaaatgcacttaccag

SEQ ID NO: 11150 - DNA, 954 bp, Artificial sequence
  miR resistant mutant
atgacaatgctggccaaaaccgactccgaggttagcagcctcacgcagtcttcgccggcgcggtccccgcgacgggacgtgtactacgtgcaaagtccgtcgcgggactcgtcccacgacggcgagaagactacgaactcgttccactcgagtccgctgcagagccccttaggctccccgccgcatagtcatagtaatagtagtctgggccgccactcccgcgagtccgcctccacgcggttctcgggctcacgcaagagcagctcctccggcaacaaccgcaagggtccgtggaggccctggaaggaccagttccacgccatcgaggaagagggcctcctcgaccccaacgacaatgcccaccatggcttccctcgtcgctgctatttccccgcgtttgtcgtcggcttcgtcgtcctcttctccgcgttctccctcattctctggggtgctagtcgccctcaaaagcccgccatttctctcaagagtataacgtttgaccaattcgtgatacaagcgggagcggatatgtcaggagttgccacaagtttggtgtccatgaattcatctgtgaaaatgacgtttcgtaacaccgctacatttttcggggtccatgtgacctcaactcccgtggatctcaattattatcaacttactgtagccactggaactatgccaaagttttatcaatcaaggaagagccaaagatctgttcgggtaatggtaattgggagtcatattccactgtacggaggtggagccaacctgaacagtgtgaacggtaaaccggttgaaccggtgccgttgacgttgagcgtgatggtgcggtcgagggcttatgttttaggcaaattggtgaagccaaagttctacaagaaaatagagtgttccatcgttatggatccgaagaagatgggcaaggcaatttcactcgtcaagaaatgcacttaccag

SEQ ID NO: 11151 - DNA, 1476 bp, Artificial sequence
  miR resistant mutant
atgttcctgttccagaaggcttccgcttctcatgtccagcttctgattgggtcaaagaagtactttcagttccatcttccccgtgacgcagttaacattgccgaggcctcagacgcaaccatagccaaactagtcctggaatcagacccacgcaccctctccgaagccctaaccaagcccagaatccactggaccccagagctagtaaacaaaacccttaagcgcctctggaaccacgggcccaaggccctcctattcttcaaacacctcgaccgccacctcccaagttatacacatagtccaagtagtttcgaccacgccgtcgacatcgcggcccgcatgcgcgacttcaactccgcctgggccctcgtgggccgcatgcgctccctccgcctcggcccgtctcccaaaaccctcgctatcctcgccgagcgctacgcctccatcggcaagccccaccgcgccgtccgcaccttcctctccatgcacgagcacggcctccaccaagatctccactccttcaacaccctccttgacatcctctgcaaatcgaaccgcgtcgaaaccgctcacgacctcctcagaactctcaaatctaggttcagacccgacaccgttagttacaacattctcgcgaacggttattgcttgaaaaaacgcacgccgatggcgctgcgggttttgaaggagatggtacagcgtgggattgagcctacgatggtcacgtataacaccatgctgaaggggtattttaggagtaatcagattaaggaggcttgggagttttacttggagatgaagaagaggaagtgtgagattgatgttgtgtcttacaccactgtgattcacgggtttggagaggcgggtgaggttaagaaagcaaaaagggtttttgatgagatggtgaaggagggtgtggctcctaatgttgctacttacaatgctttgattcaggttttttgtaagaaggatagtgtgcagaacgcagtggcggtttttgaggagatggtgagggagggggtgtgttcgccgaatgtggttactttcaatgttgttatacgaggtttgtgtcatgttggggacatggagagggcgttggggtttatggagaggatgggggagcatggtttgagggctagtgttcagacttataatgttgtgattcggtatttttgtgatgctggggagattgagaagggtttggaggtgtttgggaagatgggggatgggttgtgtttgccgaatttggatacttataatgttctgattagtgcgatgtttgtgaggaagaaatcggaggatttggtggtggctgggaagttgttgatggagatggttgagagaggcttcttgccacgcaagtttacttttaatagggtgctaaatggacttgttattactggcaatcaggattttgcaaaggatatactcagaatgcagagcaggtgtggccgtgttgttcggcgtttgaaattg

SEQ ID NO: 11152 - DNA, 1476 bp, Artificial sequence
  miR resistant mutant
atgttcctgttccagaaggcttccgcttctcatgtccagcttctgattgggtcaaagaagtactttcagttccatcttccccgtgacgcagttaacattgccgaggcctcagacgcaaccatagccaaactagtcctggaatcagacccacgcaccctctccgaagccctaaccaagcccagaatccactggaccccagagctagtaaacaaaacccttaagcgcctctggaaccacgggcccaaggccctcctattcttcaaacacctcgaccgccacctccctagttatacacatagtcctagtagtttcgaccacgccgtcgacatcgcggcccgcatgcgcgacttcaactccgcctgggccctcgtgggccgcatgcgctccctccgcctcggcccgtctcccaaaaccctcgctatcctcgccgagcgctacgcctccatcggcaagccccaccgcgccgtccgcaccttcctctccatgcacgagcacggcctccaccaagatctccactccttcaacaccctccttgacatcctctgcaaatcgaaccgcgtcgaaaccgctcacgacctcctcagaactctcaaatctaggttcagacccgacaccgttagttacaacattctcgcgaacggttattgcttgaaaaaacgcacgccgatggcgctgcgggttttgaaggagatggtacagcgtgggattgagcctacgatggtcacgtataacaccatgctgaaggggtattttaggagtaatcagattaaggaggcttgggagttttacttggagatgaagaagaggaagtgtgagattgatgttgtgtcttacaccactgtgattcacgggtttggagaggcgggtgaggttaagaaagcaaaaagggtttttgatgagatggtgaaggagggtgtggctcctaatgttgctacttacaatgctttgattcaggttttttgtaagaaggatagtgtgcagaacgcagtggcggtttttgaggagatggtgagggagggggtgtgttcgccgaatgtggttactttcaatgttgttatacgaggtttgtgtcatgttggggacatggagagggcgttggggtttatggagaggatgggggagcatggtttgagggctagtgttcagacttataatgttgtgattcggtatttttgtgatgctggggagattgagaagggtttggaggtgtttgggaagatgggggatgggttgtgtttgccgaatttggatacttataatgttctgattagtgcgatgtttgtgaggaagaaatcggaggatttggtggtggctgggaagttgttgatggagatggttgagagaggcttcttgccacgcaagtttacttttaatagggtgctaaatggacttgttattactggcaatcaggattttgcaaaggatatactcagaatgcagagcaggtgtggccgtgttgttcggcgtttgaaattg

SEQ ID NO: 11153 - DNA, 1536 bp, Artificial sequence
  miR resistant mutant
atgcagaaactgctacgcccttcttcagttcccttcctctctatctctgtcaccgtggctactccctttctttcgttgcctcccaaagttgcaaaccaaccaatgtcagcagctgctgctggttcttctctcaagcgccaactctcttattcccgctatttggcgctctctagtaccaacacttgctctgtctgcaggtgtctcagtttgacacatacacatagtcatccaaaaaataacaagacccttcttctccttaaccactctagaaaccgctccttgcattcggcttcagaaggctctttcatcacccaacccgaccctgttgagtatggttctcttgtggactcaaaagagaagccctttaactccaggctaaataggaggcaaaagggttctacttcttcttctcctgctccgtcaaatcctgatttgctggccatccccggtgtgggtcccagaaatttcagaaagctcgttcagaaaggtatcgctggtgttgcgcaactcaagcaactctacaaggataagagtgttgacgaggaggagttggaagacaattcctcttcctctgttcagaagaagcgcttaacattctgtgttgagggtaacattagcgttggcaagactaccttcctccagagaatagcgaatgaaacgatcgagttgcgtgatcttgttgaggtggttcctgaacccattagcaagtggcaggatgttggacctgatcactttaacattttggatgctttttatgccgagccgcaacggtatgcctacacctttcagaactatgtgtttgtcacacgggtcatgcaggaaagagagtcatctgctggaatcaagcctcttcgtttgatggagaggagtgttttcagtgacaggatggtttttgtacgagctgtccatgaagctaactggatgaatgggatggagatcagtatctatgactcgtggtttgatcctgtagtatcctccttgcctggacttattcctgatggttttatctatcttagggcaagtcctgacacttgccataagagaatgatgttaagaaaaagaacagaagaaggtggagtcagccttgactatctctgcgacctccatgaaaagcatgaaagctggttatttccctcccaaagtggtaatcatggagtattatctgtcaatcagctgccccatcatattgacaactctttacaccctgatataagagaccgcgttttttatctggagggtggtcacatgcattcaagcattcagaaggttcctgctttggttctggactgtgaacccaatattgatttcagcaaagatatcgaagcaaagaggcaatatgcacgccaagttgcagaattttttgaatttgtgaagaaaaggaatgaggtctcatccaaggaaggaagtagccaagcccaaccgcaggtgctgctacctcatgagggtggcctgtggctaccagatgggaagccttttccccgggaagctctcaaatctttggacttcagacaagcagcaacgtcattcatgtccggc

SEQ ID NO: 11154 - DNA, 1536 bp, Artificial sequence
  miR resistant mutant
atgcagaaactgctacgcccttcttcagttcccttcctctctatctctgtcaccgtggctactccctttctttcgttgcctcccaaagttgcaaaccaaccaatgtcagcagctgctgctggttcttctctcaagcgccaactctcttattcccgctatttggcgctctctagtaccaacacttgctctgtctgcaggtgtctcagtctaacacatacacatagtcatccaaaaaataacaagacccttcttctccttaaccactctagaaaccgctccttgcattcggcttcagaaggctctttcatcacccaacccgaccctgttgagtatggttctcttgtggactcaaaagagaagccctttaactccaggctaaataggaggcaaaagggttctacttcttcttctcctgctccgtcaaatcctgatttgctggccatccccggtgtgggtcccagaaatttcagaaagctcgttcagaaaggtatcgctggtgttgcgcaactcaagcaactctacaaggataagagtgttgacgaggaggagttggaagacaattcctcttcctctgttcagaagaagcgcttaacattctgtgttgagggtaacattagcgttggcaagactaccttcctccagagaatagcgaatgaaacgatcgagttgcgtgatcttgttgaggtggttcctgaacccattagcaagtggcaggatgttggacctgatcactttaacattttggatgctttttatgccgagccgcaacggtatgcctacacctttcagaactatgtgtttgtcacacgggtcatgcaggaaagagagtcatctgctggaatcaagcctcttcgtttgatggagaggagtgttttcagtgacaggatggtttttgtacgagctgtccatgaagctaactggatgaatgggatggagatcagtatctatgactcgtggtttgatcctgtagtatcctccttgcctggacttattcctgatggttttatctatcttagggcaagtcctgacacttgccataagagaatgatgttaagaaaaagaacagaagaaggtggagtcagccttgactatctctgcgacctccatgaaaagcatgaaagctggttatttccctcccaaagtggtaatcatggagtattatctgtcaatcagctgccccatcatattgacaactctttacaccctgatataagagaccgcgttttttatctggagggtggtcacatgcattcaagcattcagaaggttcctgctttggttctggactgtgaacccaatattgatttcagcaaagatatcgaagcaaagaggcaatatgcacgccaagttgcagaattttttgaatttgtgaagaaaaggaatgaggtctcatccaaggaaggaagtagccaagcccaaccgcaggtgctgctacctcatgagggtggcctgtggctaccagatgggaagccttttccccgggaagctctcaaatctttggacttcagacaagcagcaacgtcattcatgtccggc

SEQ ID NO: 11155 - DNA, 1650 bp, Artificial sequence
  miR resistant mutant
atgggcagggtttggacttcgatgatagcattgttgctttgcctgatgacatcatcggttcggggcgaggacccttacatttactacacatggaacgtgacctacggcaccattgccccattgggtgtcccccaacagggtatcctcatcaatggtcagtttcccggccccgaaatcaactccaccagcaacaacaacgtggtcatcaatgtcttcaacaacctcgatgagcctctcttgttcacatggcatggtgtccaacagaggaagaactcttggcaagatggcacattgggtgcccagtgccctatcgccccaggcaccaactacacctaccgctttcaggttaaggatcaaattggaacttacttctactacccgaccaccggcttgcaacgcgcagtgggtggcttcgggggtttaaggatcttcagccgtctgttgatcccagtgccctatgctgatcccgccgatgagtactgggtgctcatcggtgactggttcggcaagagccacactgccttgaaacaaacattggacagcggacgcagcattggcaggcccagtggggtccacatcaacggcaagaacggcgggctcgaggccctctacaccatggagcccggaaagacctataagtacagaatctgcaacgttgggctcaaggaagccctcaacttcaggatccagggccaccccatgaagctcgttgagaccgaaggctcccacgttgttcaaaacacctatgactccctcgacgtccacgtcggacagtgcttcaccgtcctcgttaccgccgaccaggagcccagggactacttcatggtcgcctccacgcgcttcacgaagaaggttataactgccacgcgcgtgattcgttactcgaatggcgtcgggcccgcatccccattattaccaccagccccacatcaaggctgggcctggtctcttaaccagttccgctccttccgttggaaccttaccgccagcgctgcaaggcccaaccctcagggctcataccactacggtcagattaacatcacccgcaccatcaagttggtcggcacccgaagcaagatcggcggcaagctccgttacgcactcaacggtgtctcccacgtcgaccccgaaacccctctcaagctcgccgagtactacggtgtcgccgacaaggtcttcaagtacaacctcatctctgacgccccagacgccgccatcgcctcccgcgaccccatcatcgcccccaacgtcatcaacgccaccttccgcaacttcatcgaagtcatcctcgagaaccccaccaaggtcacccagtcctacaaccttgatggctactctttctttgccgtcgcggttgagccggggcagtggagcccagagaagaggaagtgctacaaccttcttgatgctgtcagcaggcacaccatccaggtgttcccaaagtcttgggccgcaatcatgttgacttttgacaacgctggaatgtggaacttgaggtcggagatggcagagaatcgttacctgggacagcaattgtacgtgagtgtcttgtctcccaacaggtcccttagggatgagtacaacctcccagagacccagcttgtctgcggaatcgtcaaggatatgcctaagccaccaccttactccagt

SEQ ID NO: 11156 - DNA, 1650 bp, Artificial sequence
  miR resistant mutant
atgggcagggtttggacttcgatgatagcattgttgctttgcctgatgacatcatcggttcggggcgaggacccttacatttactacacatggaacgtgacctacggcaccattgccccattgggtgtcccccaacagggtatcctcatcaatggtcagtttcccggccccgaaatcaactccaccagcaacaacaacgtggtcatcaatgtcttcaacaacctcgatgagcctctcttgttcacatggcatggtgtccaacagaggaagaactcttggcaagatggcacattgggtgcccagtgccctatcgccccaggcaccaactacacctaccgctttcaggttaaggatcaaattggaacttacttctactacccgaccaccggcttgcaacgcgcagtgggtggcttcgggggtttaaggatcttcagccgtctgttgatcccagtgccctatgctgatcccgccgatgagtactgggtgctcatcggtgactggttcggcaagagccacactgccttgaaacaaacattggacagcggacgcagcattggcaggcccagtggggtccacatcaacggcaagaacggcgggctcgaggccctctacaccatggagcccggaaagacctataagtacagaatctgcaacgttgggctcaaggaagccctcaacttcaggatccagggccaccccatgaagctcgttgagaccgaaggctcccacgttgttcaaaacacctatgactccctcgacgtccacgtcggacagtgcttcaccgtcctcgttaccgccgaccaggagcccagggactacttcatggtcgcctccacgcgcttcacgaagaaggttataactgccacgcgcgtgattcgttactcgaatggcgtcgggcccgcatcccctttattacctcctgcccctcatcaaggctgggcctggtctcttaaccagttccgctccttccgttggaaccttaccgccagcgctgcaaggcccaaccctcagggctcataccactacggtcagattaacatcacccgcaccatcaagttggtcggcacccgaagcaagatcggcggcaagctccgttacgcactcaacggtgtctcccacgtcgaccccgaaacccctctcaagctcgccgagtactacggtgtcgccgacaaggtcttcaagtacaacctcatctctgacgccccagacgccgccatcgcctcccgcgaccccatcatcgcccccaacgtcatcaacgccaccttccgcaacttcatcgaagtcatcctcgagaaccccaccaaggtcacccagtcctacaaccttgatggctactctttctttgccgtcgcggttgagccggggcagtggagcccagagaagaggaagtgctacaaccttcttgatgctgtcagcaggcacaccatccaggtgttcccaaagtcttgggccgcaatcatgttgacttttgacaacgctggaatgtggaacttgaggtcggagatggcagagaatcgttacctgggacagcaattgtacgtgagtgtcttgtctcccaacaggtcccttagggatgagtacaacctcccagagacccagcttgtctgcggaatcgtcaaggatatgcctaagccaccaccttactccagt

SEQ ID NO: 11157 - DNA, 1647 bp, Artificial sequence
  miR resistant mutant
atggagattcaacaaagcttgaagctcacaatccacaagaaatggccatcatcacccaaaaaaccacctaaagaaacagaaccaataaccaccaccccaactactccaaagctgaaatggaagaaaatcttcttccaaaccaaaaccaaaacccaaactcaaacacccccagaagaattcctctgccctatttctcattccctcatgttcgacccagtcatcgtctcctccggccactccttcgaacgctcctccgtggaagcctgcataaatgtcaattttacccctcaactccccgacggcaccacccccgatttctccaccctcatccccaacctcgccctcaaatccgccatcctcaaatggtgccaatccacccatacccccccaccaccccatccaaacaacaacaacaaccacctcgtacaaaccttaatctcctcgaacccaagcctcaaaatctccgaccaagatttgattttgaattctctgaacgaaaacccaccactgacgaacctccgccaccacgcggaaaccgaggttccgataagacggacacatttgtacacaagttccgatgaatccatagcgacaacgtcagcctcaacgccgccacttcaactctccacgcgcccaagctgctgctactactcttcaccttcgtcttcagaactcgaacccgccacaaccccagaagaagaagaaatcatgacaaagctcaaaaaccctcaacacagtataatcgaagaagcgcttatctctctcagaaaactaacgagaataagagaagaaacaaggcttcaactttgcactcctcggttactctccgcgttacgttccctcgttttgtcgaagcacgtgaacgttcaggtgaacgctcttgcatcggtggtgaacctatcgttggagaaaagtaataaggtgaggatcgtgcggtcggggatggttccgccgttgatcgaggttttgaagtttggatcctctgaggcgcaggagcacggtgcgggcgcgctgtttagtttggcaatggatgatgataacaaaaccgcgattggggttttgggtggtttggctccgttgcttcacatgctccgatccgagagcgagcggactcggcatgactcggctttggcgctttatcatttgtctttggttcagagtaaccggtccaagatggttaaactcggttcggttccggttcttttgagcatggttaaatcgggtcatatgatgggtcgggttatgttgatattggggaatttgggttccgggtcggacggccgggccgcaatgttggatgcgggtgtggtggagtgtttagtggggttgctcagtgggcccgaaccggggaccgggtcaactcgggagagttgtgtggcagtgatgtatgcactgagtcacggcgggttgaggtttaaggcggtggcgaaggcggccggggtggtggaggtgttgcaaaaggtggagaagatggggagtgagagggccaggcggaaggtgaggaagatattggagataatgaggacaaaggaggtggaggaggaggatgtggattgggaggagttgctagactcggggttgggttgccggactcggagtagactcggtggtgggttggatgagtcaagtgcaaactcggccgagttt

SEQ ID NO: 11158 - DNA, 1647 bp, Artificial sequence
  miR resistant mutant
atggagattcaacaaagcttgaagctcacaatccacaagaaatggccatcatcacccaaaaaaccacctaaagaaacagaaccaataaccaccaccccaactactccaaagctgaaatggaagaaaatcttcttccaaaccaaaaccaaaacccaaactcaaacacccccagaagaattcctctgccctatttctcattccctcatgttcgacccagtcatcgtctcctccggccactccttcgaacgctcctccgtggaagcctgcataaatgtcaattttacccctcaactccccgacggcaccacccccgatttctccaccctcatccccaacctcgccctcaaatccgccatcctcaaatggtgccaatccacccacacccccccaccaccccacccaaacaacaacaacaaccacctcgtacaaaccttaatctcctcgaacccaagcctcaaaatctccgaccaagatttgattttgaattctctgaacgaaaacccaccactgacgaacctccgccaccacgcggaaaccgaggttccgataagacggacacatttgtacacaagttccgatgaatccatagcgacaacgtcagcctcaacgccgccacttcaactctccacgcgcccaagctgctgctactactcttcaccttcgtcttcagaactcgaacccgccacaaccccagaagaagaagaaatcatgacaaagctcaaaaaccctcaacacagtataatcgaagaagcgcttatctctctcagaaaactaacgagaataagagaagaaacaaggcttcaactttgcactcctcggttactctccgcgttacgttccctcgttttgtcgaagcacgtgaacgttcaggtgaacgctcttgcatcggtggtgaacctatcgttggagaaaagtaataaggtgaggatcgtgcggtcggggatggttccgccgttgatcgaggttttgaagtttggatcctctgaggcgcaggagcacggtgcgggcgcgctgtttagtttggcaatggatgatgataacaaaaccgcgattggggttttgggtggtttggctccgttgcttcacatgctccgatccgagagcgagcggactcggcatgactcggctttggcgctttatcatttgtctttggttcagagtaaccggtccaagatggttaaactcggttcggttccggttcttttgagcatggttaaatcgggtcatatgatgggtcgggttatgttgatattggggaatttgggttccgggtcggacggccgggccgcaatgttggatgcgggtgtggtggagtgtttagtggggttgctcagtgggcccgaaccggggaccgggtcaactcgggagagttgtgtggcagtgatgtatgcactgagtcacggcgggttgaggtttaaggcggtggcgaaggcggccggggtggtggaggtgttgcaaaaggtggagaagatggggagtgagagggccaggcggaaggtgaggaagatattggagataatgaggacaaaggaggtggaggaggaggatgtggattgggaggagttgctagactcggggttgggttgccggactcggagtagactcggtggtgggttggatgagtcaagtgcaaactcggccgagttt

SEQ ID NO: 11159 - DNA, 1026 bp, Artificial sequence
  miR resistant mutant
atggaatttggagagaacaacatgttcagccttaacacccacacaaaagaggaaaatggaaacactggcggtaacagtaacaataacaatattgttaatgtttggtattcatcatgggatgctactactacaactaatgcaccacacaccaccacggccgcggagggctacgccggcggcggtcaccgcctccatcaccaccaactatacggcggcgaagggtgtcacgtgcaggcggaccctcacctcacgtgcttgcatcttggtaaaagacattactttgaggatgctactaacggtgatgatgctaacaatgttacttctctggggaaccgacacgtgtgcggtggtggtggtgcgggttttgtttttgcgggtaacgataagagagcgagggggtattatggtggaggaggaggtggggctggcggtggtggtggtggtgggaaatcggcgccgtttgcgatggttcctcgatgtcaggtagaggggtgccacgtggcgcttgtgaacgcgaaggagtaccacaggaggcacagagtttgcgataagcattccaaggcacccaaagctgtggtcttagggttggagcagagattctgtcagcagtgtagcaggtttcatgtggtgtcagagtttgatgactcaaagaggagttgtaggaggagattggcaggtcataacgagcgaagaagaaagagctctcacctttctgttactaggaattctagacaaggatgcgcattaagcttattaagctctgggagtagtagtgaaaattggctatctcatcatgcggatttctccacaagatgcagtgcagcattgcgtgaattgatagcagaaaaccgtgctgccctaatcactagacaacaacaacttgtttatgatagagactggcctcatgttgtgccccaccatgatgctgcagtggaagaagaagaagaagactttgaagacttacaacaacaacaacaaccacctgagcccaattattttccacaacaacatatgtttccacagaca

SEQ ID NO: 11160 - DNA, 1026 bp, Artificial sequence
  miR resistant mutant
atggaatttggagagaacaacatgttcagccttaacacccacacaaaagaggaaaatggaaacactggcggtaacagtaacaataacaatattgttaatgtttggtattcatcatgggatgctactactacaactaatgcaccacacaccaccacggccgcggagggctacgccggcggcggtcaccgcctccatcaccaccaactatacggcggcgaagggtgtcacgtgcaggcggaccctcacctcacgtgcttgcatcttggtaaaagacattactttgaggatgctactaacggtgatgatgctaacaatgttacttctctggggaaccgacacgtgtgcggtggtggtggtgcgggttttgtttttgcgggtaacgataagagagcgagggggtattatggtggaggaggaggtggggctggcggtggtggtggtggtgggaaatcggcgccgtttgcgatggttcctcgatgtcaggtagaggggtgccacgtggcgcttgtgaacgcgaaggagtaccacaggaggcacagagtttgcgataagcattccaaggcacccaaagctgtggtcttagggttggagcagagattctgtcagcagtgtagcaggtttcatgtggtgtcagagtttgatgactcaaagaggagttgtaggaggagattggcaggtcataacgagcgaagaagaaagagctctcacctttctgttactaggaattctagacaagggtgcgcattaagcttattaagctctgggagtagtagtgaaaattggctatctcatcatgcggatttctccacaagatgcagtgcagcattgcgtgaattgatagcagaaaaccgtgctgccctaatcactagacaacaacaacttgtttatgatagagactggcctcatgttgtgccccaccatgatgctgcagtggaagaagaagaagaagactttgaagacttacaacaacaacaacaaccacctgagcccaattattttccacaacaacatatgtttccacagaca

SEQ ID NO: 11161 - DNA, 1077 bp, Artificial sequence
  miR resistant mutant
atggcttcagacgccaaactctcctcttctgagtccctcaacggtttgaaattcggccaaaaaatctattttgaggatgttggtcttgctactccagccacctctcttacttcttcttcttcttcttcttctgctgctactgttacttcttcttcttcttcaaggaaaggaagaggtgggtctgttcaaccagctcaacctcccaggtgtcaagttgaagggtgcaaagtagatctgagtgatgcaaaagcttactattctagacacaaggtctgtggcatgcactctaaatccccttcagtcattgttgctggtcttcaacaaaggttttgtcaacagtgtagcaggtttcatcagcttcctgagtttgatcaaggaaaaagaagttgccgtaggcgactagctggccataatgaacgtcggagaaagcccccaacaagctccctcttaacctctcgctatgccagactttcttcgtctgcttttgataatagtggcagaggtagcaactttctgatggaattgacttcatacccaaagcttagtctgagaaattcacttccaactcctagatcatctgagctagctcctggaaatcaaacctccacacttagctggaatggcaactcagagacatcatctgaccttttcttgcaaggttcggtgggtgggacaagcttcgccagcccgggacatcctccaggggaaagttacattggggtcaccgacacgtcatgcgcattaagcttattaagcaatcaaacatggggttctagaaacacagcaccaagtcttgggttgagtaacatgataaatttcaacgggacacccttgacacaacttgctgcatcatctcatggtgcatcaatccatcaacttccaaatacctcgtggtttttcaagggcattgattctggtaactgttcgcccgaggtggtccctgatctaggtctcggtcagatttcacagcctctcaatagccaacttcatggtgagctggacctgtcccaacagggcaggaggcattatatggatctagaacagtccagggcatatgaatctgctcattggtcactt

SEQ ID NO: 11162 - DNA, 1077 bp, Artificial sequence
  miR resistant mutant
atggcttcagacgccaaactctcctcttctgagtccctcaacggtttgaaattcggccaaaaaatctattttgaggatgttggtcttgctactccagccacctctcttacttcttcttcttcttcttcttctgctgctactgttacttcttcttcttcttcaaggaaaggaagaggtgggtctgttcaaccagctcaacctcccaggtgtcaagttgaagggtgcaaagtagatctgagtgatgcaaaagcttactattctagacacaaggtctgtggcatgcactctaaatccccttcagtcattgttgctggtcttcaacaaaggttttgtcaacagtgtagcaggtttcatcagcttcctgagtttgatcaaggaaaaagaagttgccgtaggcgactagctggccataatgaacgtcggagaaagcccccaacaagctccctcttaacctctcgctatgccagactttcttcgtctgcttttgataatagtggcagaggtagcaactttctgatggaattgacttcatacccaaagcttagtctgagaaattcacttccaactcctagatcatctgagctagctcctggaaatcaaacctccacacttagctggaatggcaactcagagacatcatctgaccttttcttgcaaggttcggtgggtgggacaagcttcgccagcccgggacatcctccaggggaaagttacattggggtcaccgacacgagctgcgcattaagcttattaagcaatcaaacatggggttctagaaacacagcaccaagtcttgggttgagtaacatgataaatttcaacgggacacccttgacacaacttgctgcatcatctcatggtgcatcaatccatcaacttccaaatacctcgtggtttttcaagggcattgattctggtaactgttcgcccgaggtggtccctgatctaggtctcggtcagatttcacagcctctcaatagccaacttcatggtgagctggacctgtcccaacagggcaggaggcattatatggatctagaacagtccagggcatatgaatctgctcattggtcactt

SEQ ID NO: 11163 - DNA, 1077 bp, Artificial sequence
  miR resistant mutant
atggcttcagacgcaaaactctcatcttctgagtccctcaacggtttgaaattcggccaaaaaatctattttgaggatgtgggttttgctactcccgctacctctcttacttcttctgctactactgctaccactgttacttcttcttcttcttcctcttcaagaaaaggaagaggtggttctgttcaaccagctcaacctccaaggtgtcaagttgaagggtgcgaagtagatctgagtaatgcaaaaacttactattctagacacaaagtttgtggcatgcactctaaatcccctacagtcattgttgctggtcttcaacaaaggttttgtcaacagtgtagcaggtttcatcagcttcctgagtttgatcaaggaaaaagaagttgccgcaggcgactagctggccataatgaacgtcggagaaagcccccacccagctccctcttgacctctcgctatgctagactttcttcatctgcttttgatcatagtggcagaggtggcaactttctgatggaattggcttcatacccaaaacttagtctgagaaattcacttccaactcctaggtcatccgagctagcgcctggaaatcaaacctccaccctcagctggcacgggaactcggagacatcatctgaccttttcttgcaaggttcggtgggtgggacaagcttcgccggcccgggacatcctccaggggaaagttacactggggtcaccacctcgtcatgcgcattaagcttattaagcaatcaaacatggggttctagaaacccagcaccaagtcttgggttgaataacatggtaaatttccacgggacgcccatgacacagcctgctgcatcatctcatggtgcatcaatccatcaacttccaaataccccgtggtgtttcaagggcattgattctggtaactgttcgcccgagggggtccctgatctaggtctcggtcagatttcgcagcctctcagtagccaacttcacggtgagctggacctgtcccaacaaggcaggagacattatatggatctagaacagtccagggcatatgaatctgctcattggtcactt

SEQ ID NO: 11164 - DNA, 1077 bp, Artificial sequence
  miR resistant mutant
atggcttcagacgcaaaactctcatcttctgagtccctcaacggtttgaaattcggccaaaaaatctattttgaggatgtgggttttgctactcccgctacctctcttacttcttctgctactactgctaccactgttacttcttcttcttcttcctcttcaagaaaaggaagaggtggttctgttcaaccagctcaacctccaaggtgtcaagttgaagggtgcgaagtagatctgagtaatgcaaaaacttactattctagacacaaagtttgtggcatgcactctaaatcccctacagtcattgttgctggtcttcaacaaaggttttgtcaacagtgtagcaggtttcatcagcttcctgagtttgatcaaggaaaaagaagttgccgcaggcgactagctggccataatgaacgtcggagaaagcccccacccagctccctcttgacctctcgctatgctagactttcttcatctgcttttgatcatagtggcagaggtggcaactttctgatggaattggcttcatacccaaaacttagtctgagaaattcacttccaactcctaggtcatccgagctagcgcctggaaatcaaacctccaccctcagctggcacgggaactcggagacatcatctgaccttttcttgcaaggttcggtgggtgggacaagcttcgccggcccgggacatcctccaggggaaagttacactggggtcaccacctcgagctgcgcattaagcttattaagcaatcaaacatggggttctagaaacccagcaccaagtcttgggttgaataacatggtaaatttccacgggacgcccatgacacagcctgctgcatcatctcatggtgcatcaatccatcaacttccaaataccccgtggtgtttcaagggcattgattctggtaactgttcgcccgagggggtccctgatctaggtctcggtcagatttcgcagcctctcagtagccaacttcacggtgagctggacctgtcccaacaaggcaggagacattatatggatctagaacagtccagggcatatgaatctgctcattggtcactt

SEQ ID NO: 11165 - DNA, 1095 bp, Artificial sequence
  miR resistant mutant
atggattgggatgggaaagagtttgcttgggatccacgtgggttggagctgctggccaatggtgaaggccagaagagtgaagcagcttcagtggatttgaggcttggtggggaaaaaatagccccagatgttgctaaagacacaaaagaatcgaaaaccgtgtcatcgccatctggttcgtcgaaaagatcccgccttcagaatggatcacagaacatgtgttgttctgttgatggatgcaattctgacctcagtgattgcagagattatcacaggcgccatagggtctgcgaaaagcactccaaaaccccggttgtgttggtgggggggaaacaacagaggttctgccaacaatgcagcaggtttcattcacttggggagtttgatgaggttaagaggagttgtaggaaacggcttgacgggcataacaggcgccggaggaaacctcagccaccgtctcttttcatggctgctgagaagttcatgtacaattacaaaggacctagaatcctacactttggtagccctgaggcttatgccaaccctattatgagaaacatgtggcctgctgctgccaaaactggagctgaatctggttatgatcctcctcgacttttatacagaatcgacaagcataagcaagataagggacatcctctttggcaagaaaatgaccctaaagtaggcagtggtgatgaagcaatgccgggaactcccatttgtcagcctattcatggcaccattgccccatcaacgggtggaaagagcacccgaaagctctctacagatgcaaaacctggatcctttgactcaggatgcgcattatacttattaagcacacttcagtcacaaagtccagagttgagtatggcgcaatctagcatcacctgtccaatgcaatctccatccggatctgtgcattttgatgctgtgaatgagtattcatgctcagaaacggaaaaagataagcccagtggtcaagtattggtttttgatgcaaacacaaccaaccttcattacaacggaatgctgcagatggggctggatggattggttgaaaatgaggacccactgacacttcccttcttgtgggag

SEQ ID NO: 11166 - DNA, 1095 bp, Artificial sequence
  miR resistant mutant
atggattgggatgggaaagagtttgcttgggatccacgtgggttggagctgctggccaatggtgaaggccagaagagtgaagcagcttcagtggatttgaggcttggtggggaaaaaatagccccagatgttgctaaagacacaaaagaatcgaaaaccgtgtcatcgccatctggttcgtcgaaaagatcccgccttcagaatggatcacagaacatgtgttgttctgttgatggatgcaattctgacctcagtgattgcagagattatcacaggcgccatagggtctgcgaaaagcactccaaaaccccggttgtgttggtgggggggaaacaacagaggttctgccaacaatgcagcaggtttcattcacttggggagtttgatgaggttaagaggagttgtaggaaacggcttgacgggcataacaggcgccggaggaaacctcagccaccgtctcttttcatggctgctgagaagttcatgtacaattacaaaggacctagaatcctacactttggtagccctgaggcttatgccaaccctattatgagaaacatgtggcctgctgctgccaaaactggagctgaatctggttatgatcctcctcgacttttatacagaatcgacaagcataagcaagataagggacatcctctttggcaagaaaatgaccctaaagtaggcagtggtgatgaagcaatgccgggaactcccatttgtcagcctattcatggcaccattgccccatcaacgggtggaaagagcacccgaaagctctctacagatgcaaaacctggatcctttgactcaggttgcgcattatacttattaagcacacttcagtcacaaagtccagagttgagtatggcgcaatctagcatcacctgtccaatgcaatctccatccggatctgtgcattttgatgctgtgaatgagtattcatgctcagaaacggaaaaagataagcccagtggtcaagtattggtttttgatgcaaacacaaccaaccttcattacaacggaatgctgcagatggggctggatggattggttgaaaatgaggacccactgacacttcccttcttgtgggag

SEQ ID NO: 11167 - DNA, 1308 bp, Artificial sequence
  miR resistant mutant
atggagtggaatgcaaaatctctcgggcaatgggactgggagcacttattcttcaatacaaaagcagctgagaatccaaggttacaaccaactgattgtagcagtgaagcagatccagaaatcaatgttggactgttgtatccatcaggtggtagtgcttgttctggctctgaactaatacatgcttcttcatcaaggagctcaaaatcagcttccaacaattcatcatcaaatggggatagcagggaatctatattgactctggaaggttctcaggatgattccactgggaagaaagaattgtgcaatggagagccggttgaaacttctccagcagcagtgccctctcctgtctctggtgaaccattgctcactctaaagcttggtaaacgattgtactttgaggatgtctgcaccggaagtgattccaagaaaccatcttcctttgaggttcccattttatcagggaagaaatataaaacaagtagtcagactgtacagcatccaagctgccaggtggaaggctgtggccttgacctctcatctgctaaagattaccatcgcaaacacagagtttgtgaagctcattccaaatcccctaaggtggttatagctggtttggaacgtcgattttgccagcaatgtagcaggttccatgctctgtcagagtttgatgacaaaaaaagaagctgtaggcaacgactttcagatcacaatgcaaggcgccgcaaaactcagcctgactcaatccaattaaatccatcagctttgtcttcatctccctatgatgggaggcaaataatgagcccatttgcattttcaaggactgctacaaatttagcttggcaagatatgcacagcagcaagcacccccaaacaaaagaattcctcccgaagcctgccaaagccttcaataagataccgagtatagtctctatgctttctgatgattccagtggccttctaacatctagaggcatagcaacgaagagtattagaattattgttgcaggtatggaagttccaaatggtacacaagatgttaatagagcattaagcttattaagcacgaattcatcatggtgtccatatgagaccaagtccctttctctggaacactccactcggacaacacactcaatcactcagcatcgtttaccacttccttcctcggagtattggcacactgatcaacaaaattcaagcatgtgtatctcattctcggattgcgatagcagcaatcgctttcaagactttcagctcttgagctcaccctatgaatcaggttttccgtgcaaccaactggat

SEQ ID NO: 11168 - DNA, 1308 bp, Artificial sequence
  miR resistant mutant
atggagtggaatgcaaaatctctcgggcaatgggactgggagcacttattcttcaatacaaaagcagctgagaatccaaggttacaaccaactgattgtagcagtgaagcagatccagaaatcaatgttggactgttgtatccatcaggtggtagtgcttgttctggctctgaactaatacatgcttcttcatcaaggagctcaaaatcagcttccaacaattcatcatcaaatggggatagcagggaatctatattgactctggaaggttctcaggatgattccactgggaagaaagaattgtgcaatggagagccggttgaaacttctccagcagcagtgccctctcctgtctctggtgaaccattgctcactctaaagcttggtaaacgattgtactttgaggatgtctgcaccggaagtgattccaagaaaccatcttcctttgaggttcccattttatcagggaagaaatataaaacaagtagtcagactgtacagcatccaagctgccaggtggaaggctgtggccttgacctctcatctgctaaagattaccatcgcaaacacagagtttgtgaagctcattccaaatcccctaaggtggttatagctggtttggaacgtcgattttgccagcaatgtagcaggttccatgctctgtcagagtttgatgacaaaaaaagaagctgtaggcaacgactttcagatcacaatgcaaggcgccgcaaaactcagcctgactcaatccaattaaatccatcagctttgtcttcatctccctatgatgggaggcaaataatgagcccatttgcattttcaaggactgctacaaatttagcttggcaagatatgcacagcagcaagcacccccaaacaaaagaattcctcccgaagcctgccaaagccttcaataagataccgagtatagtctctatgctttctgatgattccagtggccttctaacatctagaggcatagcaacgaagagtattagaattattgttgcaggtatggaagttccaaatggtacacaagatgttaacagagcattaagcttattaagcacgaattcatcatggtgtccatatgagaccaagtccctttctctggaacactccactcggacaacacactcaatcactcagcatcgtttaccacttccttcctcggagtattggcacactgatcaacaaaattcaagcatgtgtatctcattctcggattgcgatagcagcaatcgctttcaagactttcagctcttgagctcaccctatgaatcaggttttccgtgcaaccaactggat

SEQ ID NO: 11169 - DNA, 1188 bp, Artificial sequence
  miR resistant mutant
atggattggaatttgaaagcaccttcttgggatttgagtgaagtggatcaggcaaacttacccaacatggaaacaatggaaggctcaagcagatatggaatgtatagaactaagggggaattttctgttgacttgaagcttggccaagtgggaaattctggcagggaatcatcagtgttgactaagtccaaagatggtggtgctgttggagtctccaaaatgatatcctcatcttcttcagggtcagctaagagagctcgttcccttagcaacgggacacaaacagtgtcatgccttgtggacgggtgccactctgatctcagtaactgcagagactatcataggcgccataaggtctgtgaagtccattccaagactgcacaggtcacaattggaggccagaaacaaaggttctgccagcagtgtagcaggttccattcactggaggaatttgatgaggggaaaaggagctgcaggaagcggttagatgggcacaaccgacggagaagaaagccacaaccagaagttgttctaacgcggtctgctagttttttgtcgaattaccaccaaggcacacaattgctatctttctcaagttcacatgtgtacccatccactactgtggtgaatcctactttgggtggagttgttacttctggtgatgtaaggcttcatgggcagaaccaccaccaccaccaaatgcatttggttgataaacaggacctgtttcttggatcttctccaaccggttacaaggaagggaagcatttggcattcatgcaaggtgaccacaccctcaacaaccagagcccacatcttccaggtgcttccgtgggcccggcccagatgtttcttaggaccagcccgtattcagaaagcggtggattgagatgcaaaatgttctgcgatagcctaacaggttcggcccacggcaacaccagcagagcattaagcttattaagctcaccaccacagccgcacagtcctggaaatggattaaaccaaatggtgaaccctcactcgccacttatgcaacccttgggcctgagcctgcatgataacagcctgggctccgtggacccggttttgggccccaacgggagtgaccattcctcatcaatgcatcacataggttctaatggatcccaggtgaatgaggcccctccactatttccctttcaatgggaa

SEQ ID NO: 11170 - DNA, 1188 bp, Artificial sequence
  miR resistant mutant
atggattggaatttgaaagcaccttcttgggatttgagtgaagtggatcaggcaaacttacccaacatggaaacaatggaaggctcaagcagatatggaatgtatagaactaagggggaattttctgttgacttgaagcttggccaagtgggaaattctggcagggaatcatcagtgttgactaagtccaaagatggtggtgctgttggagtctccaaaatgatatcctcatcttcttcagggtcagctaagagagctcgttcccttagcaacgggacacaaacagtgtcatgccttgtggacgggtgccactctgatctcagtaactgcagagactatcataggcgccataaggtctgtgaagtccattccaagactgcacaggtcacaattggaggccagaaacaaaggttctgccagcagtgtagcaggttccattcactggaggaatttgatgaggggaaaaggagctgcaggaagcggttagatgggcacaaccgacggagaagaaagccacaaccagaagttgttctaacgcggtctgctagttttttgtcgaattaccaccaaggcacacaattgctatctttctcaagttcacatgtgtacccatccactactgtggtgaatcctactttgggtggagttgttacttctggtgatgtaaggcttcatgggcagaaccaccaccaccaccaaatgcatttggttgataaacaggacctgtttcttggatcttctccaaccggttacaaggaagggaagcatttggcattcatgcaaggtgaccacaccctcaacaaccagagcccacatcttccaggtgcttccgtgggcccggcccagatgtttcttaggaccagcccgtattcagaaagcggtggattgagatgcaaaatgttctgcgatagcctaacaggttcggcccacggcaacaccagccgtgcattaagcttattaagctcaccaccacagccgcacagtcctggaaatggattaaaccaaatggtgaaccctcactcgccacttatgcaacccttgggcctgagcctgcatgataacagcctgggctccgtggacccggttttgggccccaacgggagtgaccattcctcatcaatgcatcacataggttctaatggatcccaggtgaatgaggcccctccactatttccctttcaatgggaa

SEQ ID NO: 11171 - DNA, 1095 bp, Artificial sequence
  miR resistant mutant
atggattgggatgggaaagagtttgcttgggatccacgtgggttggagctggctaatggtgaaggccagaagagtgaagcagcttcagtggatttgaggcttggtgaggaaaaaacagccccagatgttgttgctaaggacacaaaagactcaaaaaccgtgtcatcgccatccgggtcgtcgaaaagatcccgccttcagaatggattacagaacatgtgttgttctgttgatggatgcaattctgatctcagtgattgcagagagtatcataggcgccatagggtctgcgaaaagcactccaaaaccccggttgtgatggtgggggggaaacaacagaggttctgccagcaatgcagcaggtttcattcgcttggggagtttgatgaggttaagaggagttgtaggaaacggcttgacgggcataacaggcgccggaggaaacctcagccaccctctcttttcatggctgctgagaagttcatgtacaattacaaaggacctagaatcctacactttggtagccctgaggcttatgccaaccctattatgagagacatgtggcctgctgctgccaaaactggagctgaatctggtcatgattctcctcgacttttatacagaattgacaagcataagcaagataagggacatcctctttggcaagaaaatgaccctaaagtaggcagtggtgatgaagcaatgccgggaactcccatttgtcagcctattcatggcaccatcgccccatcaatgggtggaaagagcaaccgaaagctctctacagatgcaaaacctggatcctttgactcaggatgcgcattatacttattaagcacacttcaatcacaaagtccagagttgagtatggtgcaatctagcatcacctgccctgtgcaatctccatcaggatctgtgcattttgatgctgtgaatgagtatgcatgctcagaaacggaaagagataagcctagtggtcaagtattggttttcgatgcaaaaacaaccaaccttcattacaacggaatgctgcaaatggatctcgatggatttgttgaaaatgaggacccactagcacttcctttcttgtgggag

SEQ ID NO: 11172 - DNA, 1095 bp, Artificial sequence
  miR resistant mutant
atggattgggatgggaaagagtttgcttgggatccacgtgggttggagctggctaatggtgaaggccagaagagtgaagcagcttcagtggatttgaggcttggtgaggaaaaaacagccccagatgttgttgctaaggacacaaaagactcaaaaaccgtgtcatcgccatccgggtcgtcgaaaagatcccgccttcagaatggattacagaacatgtgttgttctgttgatggatgcaattctgatctcagtgattgcagagagtatcataggcgccatagggtctgcgaaaagcactccaaaaccccggttgtgatggtgggggggaaacaacagaggttctgccagcaatgcagcaggtttcattcgcttggggagtttgatgaggttaagaggagttgtaggaaacggcttgacgggcataacaggcgccggaggaaacctcagccaccctctcttttcatggctgctgagaagttcatgtacaattacaaaggacctagaatcctacactttggtagccctgaggcttatgccaaccctattatgagagacatgtggcctgctgctgccaaaactggagctgaatctggtcatgattctcctcgacttttatacagaattgacaagcataagcaagataagggacatcctctttggcaagaaaatgaccctaaagtaggcagtggtgatgaagcaatgccgggaactcccatttgtcagcctattcatggcaccatcgccccatcaatgggtggaaagagcaaccgaaagctctctacagatgcaaaacctggatcctttgactcaggttgcgcattatacttattaagcacacttcaatcacaaagtccagagttgagtatggtgcaatctagcatcacctgccctgtgcaatctccatcaggatctgtgcattttgatgctgtgaatgagtatgcatgctcagaaacggaaagagataagcctagtggtcaagtattggttttcgatgcaaaaacaaccaaccttcattacaacggaatgctgcaaatggatctcgatggatttgttgaaaatgaggacccactagcacttcctttcttgtgggag

SEQ ID NO: 11173 - DNA, 2406 bp, Artificial sequence
  miR resistant mutant
atggaaggagagggaagcattcatgtacaagttgatgaactacaaaggatgaggctcagcgaaaccatcagcataggcaccaccatgtttgagcctcgtggactcagcagcatagacaagctggacagtaataatagcactgccaattctgtgtcttcaacaacctcagcaccagaaaagaagctcacccttttcgctcttcagcttgcggtgcttgaaaaagcagcaaccgggttgggaactctcggcttcatttgggcaaccgttgtccttctcggcggtttcgccatcaccttagaaaaaaccgacttctggttcatcaccatcatacttgtagttgaaggaaccaggattttcagcaggagtcatgaacttgaatggcagcaccaagccacatggtccatcactgaggtacttgtaactcccagtacaaaggtactgagagagattttcaaaaaccatcaccaccaatatgtttcaacagatactaccccaacaaggacacgaactaggatgtgggttagctcagatgttccactcctaccatatgctaaatggtttttcctttcgaggcatgtcagtagacttctctattggcttcagcttctttctgcaacggcttgtgtggttctctcgttaataaagctcgtcaagcatgattatggagaggtggcaaagggggacactgacaagaggaaccgcaaaagcgcattaagcatattttacgccttggctctttcggaagctttgttgttcctaatggaaaaggcctattgggaatggcaagtcagctattgtaaactgttggaagaggtcaacaaggagtgtgagttggggccatcaggaatggtgtccactagaaggctcttctatgatgcctattcaagatgtgtcaatggaagcatatttgatggcttgaaaatggatatggtaggtttttctatggacttgttggcttctaactcccctgatgagcagctcattggagcaaggattcttaggcagttttcaatcagtgaaagattttgtgatgacacccttcaaaagattggaattgacatatcaatggtggagagactagttgagatgttgaattggacagacttcaaggacgaagagattaggctctcagctgctgagattttgtcaaaactagctggcaagaagcagaactctctccgcatagccggaataccgggagctatggaatcaatatcatctcttttacaaactaataggagtgtgattcctgcagctgatgagattggtgaaaagaaacttgtatttgatcaccaaaattatgggttctggacttttaaccacttgggactcctcatactgaaaaaacttgcacgtgaccttgacaactgtggaaagattggaaacacaaggggcctccttccaaagatcatagacttcacacatgctgaagagtggttgctaaagagtgaaaatgttactccatcccaagttctgacactgaagagatctctgcaactggtgaagatgctggctagcacagttggcaccactgggaaacatcttcgaagagagattgcggagatagttttcaccatcagcaatattagagatattttaaggcatggagagaagcatcctcttctacagaaactttgcatagaaattttaaccagtctggcattggaagaggatgcaacggaaagaatagggggtacaggtggagtacttaaagaattgttcaacatatttttcaaacacaacataccagaaaatcagaaacatgtaaaaattgttgctggtgaggcccttgcaatgctggctttagaaagcaagagtaactgccatcgaattttaaagttgaaagtactagaaaagctcgctgaagcattgaaagatccattgctccgtgtcaatgcagctagaattctaagaaatttatgcacctatagtggatcagaatggttcatccagctaaagggggtaacaactgcagcacccataatacttcgggcgatcatgtcagaagacaacaagatacaagaggtgatgattggactagcagcaaatgttttcagatacatgacctctcatgaatcaagcattgtatttgaagaagctggaattactgaggctgaacttgcaaacaaattagttcagattctcaagaaataccagtatcccccaactaagattccaaggataaggaggttcgtaatagagctggctatttggatgatgaaagacaaagcagaaaacatagaaacctttaagggtctgggaatggaggaggtgttggagggtgtcttagagaccacatcagaacttgaaagctttaatgttttctctggcactgttggactgaaccggcacactctaacaactcagtcactggttgagatggcattgaaattgatggaagatagt

SEQ ID NO: 11174 - DNA, 2406 bp, Artificial sequence
  miR resistant mutant
atggaaggagagggaagcattcatgtacaagttgatgaactacaaaggatgaggctcagcgaaaccatcagcataggcaccaccatgtttgagcctcgtggactcagcagcatagacaagctggacagtaataatagcactgccaattctgtgtcttcaacaacctcagcaccagaaaagaagctcacccttttcgctcttcagcttgcggtgcttgaaaaagcagcaaccgggttgggaactctcggcttcatttgggcaaccgttgtccttctcggcggtttcgccatcaccttagaaaaaaccgacttctggttcatcaccatcatacttgtagttgaaggaaccaggattttcagcaggagtcatgaacttgaatggcagcaccaagccacatggtccatcactgaggtacttgtaactcccagtacaaaggtactgagagagattttcaaaaaccatcaccaccaatatgtttcaacagatactaccccaacaaggacacgaactaggatgtgggttagctcagatgttccactcctaccatatgctaaatggtttttcctttcgaggcatgtcagtagacttctctattggcttcagcttctttctgcaacggcttgtgtggttctctcgttaataaagctcgtcaagcatgattatggagaggtggcaaagggggacactgacaagaggaaccgcaaatctgcattatctatattttacgccttggctctttcggaagctttgttgttcctaatggaaaaggcctattgggaatggcaagtcagctattgtaaactgttggaagaggtcaacaaggagtgtgagttggggccatcaggaatggtgtccactagaaggctcttctatgatgcctattcaagatgtgtcaatggaagcatatttgatggcttgaaaatggatatggtaggtttttctatggacttgttggcttctaactcccctgatgagcagctcattggagcaaggattcttaggcagttttcaatcagtgaaagattttgtgatgacacccttcaaaagattggaattgacatatcaatggtggagagactagttgagatgttgaattggacagacttcaaggacgaagagattaggctctcagctgctgagattttgtcaaaactagctggcaagaagcagaactctctccgcatagccggaataccgggagctatggaatcaatatcatctcttttacaaactaataggagtgtgattcctgcagctgatgagattggtgaaaagaaacttgtatttgatcaccaaaattatgggttctggacttttaaccacttgggactcctcatactgaaaaaacttgcacgtgaccttgacaactgtggaaagattggaaacacaaggggcctccttccaaagatcatagacttcacacatgctgaagagtggttgctaaagagtgaaaatgttactccatcccaagttctgacactgaagagatctctgcaactggtgaagatgctggctagcacagttggcaccactgggaaacatcttcgaagagagattgcggagatagttttcaccatcagcaatattagagatattttaaggcatggagagaagcatcctcttctacagaaactttgcatagaaattttaaccagtctggcattggaagaggatgcaacggaaagaatagggggtacaggtggagtacttaaagaattgttcaacatatttttcaaacacaacataccagaaaatcagaaacatgtaaaaattgttgctggtgaggcccttgcaatgctggctttagaaagcaagagtaactgccatcgaattttaaagttgaaagtactagaaaagctcgctgaagcattgaaagatccattgctccgtgtcaatgcagctagaattctaagaaatttatgcacctatagtggatcagaatggttcatccagctaaagggggtaacaactgcagcacccataatacttcgggcgatcatgtcagaagacaacaagatacaagaggtgatgattggactagcagcaaatgttttcagatacatgacctctcatgaatcaagcattgtatttgaagaagctggaattactgaggctgaacttgcaaacaaattagttcagattctcaagaaataccagtatcccccaactaagattccaaggataaggaggttcgtaatagagctggctatttggatgatgaaagacaaagcagaaaacatagaaacctttaagggtctgggaatggaggaggtgttggagggtgtcttagagaccacatcagaacttgaaagctttaatgttttctctggcactgttggactgaaccggcacactctaacaactcagtcactggttgagatggcattgaaattgatggaagatagt

SEQ ID NO: 11175 - DNA, 1170 bp, Artificial sequence
  miR resistant mutant
atggactggaatttgaaagcactttcttgggatttgagtgaagtggatcaggcaaacttacccaacatggaaacaatggaaggctcaagcagatatggaatgtatagaactaagggggaattttctgttgacttgaagcttggccaggtggggaattctggcacagaatcagtgttgactaagtccaaagatgctgttggagtctccaaaatgacatcctcatctacttcagggtcatctaagagagctcgtgcccttagcaacgggacacaaacagtgtcatgccttgtggatgggtgccacgctgatctcagtaactgcagggactatcataggcgccataaggtctgtgaagtccattccaagactgcacaggtctcaattggaggccagaaacaaaggttctgccagcagtgtagcaggttccattcactggaggaatttgatgaggggaaaaggagctgcaggaagcggttagacgggcacaaccgacggagaagaaagccccaaccagaatctctaacgcgctctggtagttttttgtcgaattaccaaggcacacagttgctacctttctcaagttcacatgagtacccatccacaactgtggtgaatcctacttggggtggagttcttacaacttctggtgatgttaggcttcatgggcacaaccaacaccaccaccaggtgcatttggctgataaacaggacctttttcttggatcttctccagccggttacaaagaagggaagcaattggcattcatgcaaggtgaccacaccctcaacaaccggagcccacatcttccaggtgcttccgtgggccaggcccagatgtttcttaggaccagcctgtattcagaaagcgatgggctgagatgcaaaatgttctgtgatagcctaacaagttcgatccaagacaacaacaccagcagagcattaagcttattaagctcaccaccacaaccgctcagtcctggaaatggattaaacctgatggtgaactctcactcgccccttatgcaacccttgggcctgagcctgcatgataacagcctgggctccgtggaccctgttttgggccccaatgattcttcatcaatgtataacataggttctaatggatctcaggggaatgaggcccctccactatttccctttcaatgggaa

SEQ ID NO: 11176 - DNA, 1170 bp, Artificial sequence
  miR resistant mutant
atggactggaatttgaaagcactttcttgggatttgagtgaagtggatcaggcaaacttacccaacatggaaacaatggaaggctcaagcagatatggaatgtatagaactaagggggaattttctgttgacttgaagcttggccaggtggggaattctggcacagaatcagtgttgactaagtccaaagatgctgttggagtctccaaaatgacatcctcatctacttcagggtcatctaagagagctcgtgcccttagcaacgggacacaaacagtgtcatgccttgtggatgggtgccacgctgatctcagtaactgcagggactatcataggcgccataaggtctgtgaagtccattccaagactgcacaggtctcaattggaggccagaaacaaaggttctgccagcagtgtagcaggttccattcactggaggaatttgatgaggggaaaaggagctgcaggaagcggttagacgggcacaaccgacggagaagaaagccccaaccagaatctctaacgcgctctggtagttttttgtcgaattaccaaggcacacagttgctacctttctcaagttcacatgagtacccatccacaactgtggtgaatcctacttggggtggagttcttacaacttctggtgatgttaggcttcatgggcacaaccaacaccaccaccaggtgcatttggctgataaacaggacctttttcttggatcttctccagccggttacaaagaagggaagcaattggcattcatgcaaggtgaccacaccctcaacaaccggagcccacatcttccaggtgcttccgtgggccaggcccagatgtttcttaggaccagcctgtattcagaaagcgatgggctgagatgcaaaatgttctgtgatagcctaacaagttcgatccaagacaacaacaccagccgtgcattaagcttattaagctcaccaccacaaccgctcagtcctggaaatggattaaacctgatggtgaactctcactcgccccttatgcaacccttgggcctgagcctgcatgataacagcctgggctccgtggaccctgttttgggccccaatgattcttcatcaatgtataacataggttctaatggatctcaggggaatgaggcccctccactatttccctttcaatgggaa

SEQ ID NO: 11177 - DNA, 1329 bp, Artificial sequence
  miR resistant mutant
atggagtgtaatgcaaaatctctcgggcaatgggactgggagcacttattcttcttcaatacaaaagcagctgaaaatccaaggttacaaccaactgattgtagcagtgaagcagatcgggaaatcaacgttggaatgttgcatccatcaggtggtagtgcttgttctggctctgaactaatacatgcttcttcatcaaggagctcaaaatcagcttccaacaattcatcatcaaatggggatagcaaggcatctatattgactctggaaggttctcatgatgattccactgggaagaaagaattgtgcaatggagagccaattgaaacttctcctgcagcagtgccctctcctgtctctggtgaaccgttgctcactctaaagcttggtaaacgattgtactttgaggatgtctgtaccggaagtgattccaagaaaccatcttcctttgacattcccatttcatcaggaaagaaacataaaaccagtagtcagactttacagcatccaagctgccaggtggaaggctgtggccttgacctctcatctgctaaagattaccatcgcaaacaccgagtttgtgaagctcattccaaatcccctaaggtggttataactggtttggaacgccgattttgccagcaatgtagcaggttccatgctctgtcagagtttgatgacaaaaaaagaagctgtaggcgacgtctttcagatcacaatgcaaggcgccgcaaacctcagcctgactcaatccaattaaatccatcagctttgtcttcatcaccctatgatgggaggcaaatagtgagtccatttgcattttcaaggactgccacaaatttagcttggcaagatatgcacccccagacaaaagaatttctcccgaagcctgcaaaagccttcaataagataccgagtattgtctccatgctttctgatgattccagtggccttctaacatctagaggcatagcaacgaagagtactgttccagatgttgcaggtatggaagatcccattaggttgtctgatccaaacggtacacaagatgttaatagagcattaagcttattaagcacgaattcttcatcttcatggggtgcatatgagactaagtccctttctttggaacactccactcgggcaacacactcaatcactcagcatcacttaccacttccttcctcggcagagtattggcacactgatcatcaacaacattcaagcatgtgtatctcattcacggattgcgatagcagcaatcgctttcaagactttcagctgttgagctcaccctatgaatcaccttttccttgcaaccaactggat

SEQ ID NO: 11178 - DNA, 1329 bp, Artificial sequence
  miR resistant mutant
atggagtgtaatgcaaaatctctcgggcaatgggactgggagcacttattcttcttcaatacaaaagcagctgaaaatccaaggttacaaccaactgattgtagcagtgaagcagatcgggaaatcaacgttggaatgttgcatccatcaggtggtagtgcttgttctggctctgaactaatacatgcttcttcatcaaggagctcaaaatcagcttccaacaattcatcatcaaatggggatagcaaggcatctatattgactctggaaggttctcatgatgattccactgggaagaaagaattgtgcaatggagagccaattgaaacttctcctgcagcagtgccctctcctgtctctggtgaaccgttgctcactctaaagcttggtaaacgattgtactttgaggatgtctgtaccggaagtgattccaagaaaccatcttcctttgacattcccatttcatcaggaaagaaacataaaaccagtagtcagactttacagcatccaagctgccaggtggaaggctgtggccttgacctctcatctgctaaagattaccatcgcaaacaccgagtttgtgaagctcattccaaatcccctaaggtggttataactggtttggaacgccgattttgccagcaatgtagcaggttccatgctctgtcagagtttgatgacaaaaaaagaagctgtaggcgacgtctttcagatcacaatgcaaggcgccgcaaacctcagcctgactcaatccaattaaatccatcagctttgtcttcatcaccctatgatgggaggcaaatagtgagtccatttgcattttcaaggactgccacaaatttagcttggcaagatatgcacccccagacaaaagaatttctcccgaagcctgcaaaagccttcaataagataccgagtattgtctccatgctttctgatgattccagtggccttctaacatctagaggcatagcaacgaagagtactgttccagatgttgcaggtatggaagatcccattaggttgtctgatccaaacggtacacaagatgttaacagagcattaagcttattaagcacgaattcttcatcttcatggggtgcatatgagactaagtccctttctttggaacactccactcgggcaacacactcaatcactcagcatcacttaccacttccttcctcggcagagtattggcacactgatcatcaacaacattcaagcatgtgtatctcattcacggattgcgatagcagcaatcgctttcaagactttcagctgttgagctcaccctatgaatcaccttttccttgcaaccaactggat

SEQ ID NO: 11179 - DNA, 1659 bp, Artificial sequence
  miR resistant mutant
atggaatcttggagctatgtccctgaagaaaaggagtgtgtctccaatgaggcactctcacctcccaacactctcgggaggagtaaaaattctttcttgggctgggaactcaaaaccccatgtggtttttccaacgacatgttgggtttgggtcaccacagcattgagaatcaaggttttgaggaattgggttttcctgaaatgttgggaaaacacatgtccgatgatctaattgggagtgttccaaccagaaaggtgaatggtaatagacaacaacaacacagtgacagaatcactggcactgttgtggatgccccaagtgggttttctcaaagaggggactcaaattcaaagctttcaaactcaaattccctcattgatttgaagctgggtcgatttgctgaccatggagatttcactgatcgggcgttttccaaagttttgtcttcttctgagtcatcaacgcctcctaagagagtgagagcttcagggttgcactctcagactgcatattgccaagtctatggctgcaacaaggatctcagctcctgcaaggactaccacaagaggcacaaggtctgtgaggttcactccaagactgccattgttatagtcaatggcattgagcaaaggttttgccagcaatgtagtaggtttcatttgctggctgaatttgatgatggtaagcggagctgccgaaaacgccttgcaggtcataatgagcgtagaagaaaaccacaaatgggtattcacccaggaaagtctgggaggttgcttcagccatgtgggggtaattatacatatagcagattccagggatccatgctaacttcatcttttatctgcccagagatgcttccaagtggggtcacgtgttctgagaaatatggtatgagtgacttttggagacctatcaaagcagaacacgggactggttttaggaatctttcctctatggctgcaaccaatggacatcctccatcaagatctttatttccatcatataacggaaatcaatttccttttcttcatgaaaacagtgctacatccaccacaggaagcatcttctgtgagagcaatagcccctatccatctgcccttggggcccaaaattctgggttgagaccactattccaggacactgtaggaaatgagaacttcaatgtttttgatacctcatcaactgttcaaggattgtcggggatttcagactcttgctgcgcattaagcttattaagctctcaatcccagaactcttcaagccaatcatcaggaattcccttggctcactccttggttattccaagcagtcatagccataactacaacatgagtcaggtctctgaaaagataggaataagctcacagacttcttcaagccgagtgtcagatagttttccatcagaactaaatcatgcagatggaagtcatctcagtcctgtattaatatcagacaataattgtattgtaaactttgatatggcagatggtatcttccaagcttcagattacttgaatgtaaaagatcatctttccggtgaagatggtgcaaccattgacttactacaattgtcatcacagcttcagcgagttgagcatgagaggcaatccttgcaggtgaagcaagagaatgattcttcttgcactctgcggattaca

SEQ ID NO: 11180 - DNA, 1659 bp, Artificial sequence
  miR resistant mutant
atggaatcttggagctatgtccctgaagaaaaggagtgtgtctccaatgaggcactctcacctcccaacactctcgggaggagtaaaaattctttcttgggctgggaactcaaaaccccatgtggtttttccaacgacatgttgggtttgggtcaccacagcattgagaatcaaggttttgaggaattgggttttcctgaaatgttgggaaaacacatgtccgatgatctaattgggagtgttccaaccagaaaggtgaatggtaatagacaacaacaacacagtgacagaatcactggcactgttgtggatgccccaagtgggttttctcaaagaggggactcaaattcaaagctttcaaactcaaattccctcattgatttgaagctgggtcgatttgctgaccatggagatttcactgatcgggcgttttccaaagttttgtcttcttctgagtcatcaacgcctcctaagagagtgagagcttcagggttgcactctcagactgcatattgccaagtctatggctgcaacaaggatctcagctcctgcaaggactaccacaagaggcacaaggtctgtgaggttcactccaagactgccattgttatagtcaatggcattgagcaaaggttttgccagcaatgtagtaggtttcatttgctggctgaatttgatgatggtaagcggagctgccgaaaacgccttgcaggtcataatgagcgtagaagaaaaccacaaatgggtattcacccaggaaagtctgggaggttgcttcagccatgtgggggtaattatacatatagcagattccagggatccatgctaacttcatcttttatctgcccagagatgcttccaagtggggtcacgtgttctgagaaatatggtatgagtgacttttggagacctatcaaagcagaacacgggactggttttaggaatctttcctctatggctgcaaccaatggacatcctccatcaagatctttatttccatcatataacggaaatcaatttccttttcttcatgaaaacagtgctacatccaccacaggaagcatcttctgtgagagcaatagcccctatccatctgcccttggggcccaaaattctgggttgagaccactattccaggacactgtaggaaatgagaacttcaatgtttttgatacctcatcaactgttcaaggattgtcggggatttcagactcttgttgtgcattaagcttattaagctctcaatcccagaactcttcaagccaatcatcaggaattcccttggctcactccttggttattccaagcagtcatagccataactacaacatgagtcaggtctctgaaaagataggaataagctcacagacttcttcaagccgagtgtcagatagttttccatcagaactaaatcatgcagatggaagtcatctcagtcctgtattaatatcagacaataattgtattgtaaactttgatatggcagatggtatcttccaagcttcagattacttgaatgtaaaagatcatctttccggtgaagatggtgcaaccattgacttactacaattgtcatcacagcttcagcgagttgagcatgagaggcaatccttgcaggtgaagcaagagaatgattcttcttgcactctgcggattaca

SEQ ID NO: 11181 - DNA, 1626 bp, Artificial sequence
  miR resistant mutant
atggaatcttggagctatatccctgaagaaaaggagtgtgtctccaatgaggcaccctcacctcccaacactctcgggaggagtaaaaattctttcttgggctgggaactcaaaaccccatgtggtttttccaccgacatgttgggtttgggtcaccacagcattgagaatcaaggtttcgaggaattggggtttcctgaaatgttgggaaaacacatgtccgatgatctagttgccagtgttccaaccagaaaggtggatggtaatagacaacaacaacaacaccacagtgacagaatcactggcactgttgtggatgccccaagtgggttttctcaaagaggggactcaaattccctcatcgatttgaagctgggtcgatttgctgagcatggagatttcactgatccagcgttttccaaagttctgtcttcttctgagtcatcaacgcctcctaagagagtgcgaacttcagggttacattctcagactgcatattgccaagtctatggctgcaacaaggatcttagctcctgtaaggactaccacaagaggcacaaggtgtgtgaggttcactccaagactgccattgttatagtcaatggcattgagcaaaggttttgccagcaatgtagtaggtttcatttgctggctgaatttgatgatggcaagcgaagctgccgaaaacgccttgcaggtcataatgagcgtagaagaaaaccacaaatgggtattcacccaggaaagtctgggacgttgcttcagccatatagcagattccagggatccatgctaacatcatcttttatccgaccagagatgcttccaagtggggtcatgtgttccgagaaatatggtatgagtgacttctggagacctatcaaagcagaacacgggactggttttaggaatctttcttctatggctgcaaccaatggacatcctctgccaagatctttattttcatcatataacggaaaacaatttccctttcttcatgaaaacagttctacatccaccacaggaagcatcttctgtgagagcaatagccactatccatctgcccttggggcccaaaattctggattgagaccactattccaggacactgtaggaaatgaggacttcagtgtttttgatacctcaccaaatgttcaaggattatcagggatttcagactcttgctgcgcattaagcttattaagctctcaatcccagaactcttcaagccaatcatcaggaattcccttggctcactccttggttattccaagcagtcatagccatcactacaacatgagtcaggtctctgacaagataggaataagctcacagacttcttcaagccgagtgtcagatagttttccaccagaactaaatcatgccgatggaagccatctcagtcctgtattaatatcaggcaataatgatattataaactttgatatggcagatggtatcttccaaggttcagattacttgaatgtgaaagatcgtctttccgatgaagatggtgcaaccattgacttgctacaattgtcatcacagcttcagcgagttgagcatgagaggcaatccttgcaggtgaagcaagagaatgattcttcttgcactctgcggattaca

SEQ ID NO: 11182 - DNA, 1626 bp, Artificial sequence
  miR resistant mutant
atggaatcttggagctatatccctgaagaaaaggagtgtgtctccaatgaggcaccctcacctcccaacactctcgggaggagtaaaaattctttcttgggctgggaactcaaaaccccatgtggtttttccaccgacatgttgggtttgggtcaccacagcattgagaatcaaggtttcgaggaattggggtttcctgaaatgttgggaaaacacatgtccgatgatctagttgccagtgttccaaccagaaaggtggatggtaatagacaacaacaacaacaccacagtgacagaatcactggcactgttgtggatgccccaagtgggttttctcaaagaggggactcaaattccctcatcgatttgaagctgggtcgatttgctgagcatggagatttcactgatccagcgttttccaaagttctgtcttcttctgagtcatcaacgcctcctaagagagtgcgaacttcagggttacattctcagactgcatattgccaagtctatggctgcaacaaggatcttagctcctgtaaggactaccacaagaggcacaaggtgtgtgaggttcactccaagactgccattgttatagtcaatggcattgagcaaaggttttgccagcaatgtagtaggtttcatttgctggctgaatttgatgatggcaagcgaagctgccgaaaacgccttgcaggtcataatgagcgtagaagaaaaccacaaatgggtattcacccaggaaagtctgggacgttgcttcagccatatagcagattccagggatccatgctaacatcatcttttatccgaccagagatgcttccaagtggggtcatgtgttccgagaaatatggtatgagtgacttctggagacctatcaaagcagaacacgggactggttttaggaatctttcttctatggctgcaaccaatggacatcctctgccaagatctttattttcatcatataacggaaaacaatttccctttcttcatgaaaacagttctacatccaccacaggaagcatcttctgtgagagcaatagccactatccatctgcccttggggcccaaaattctggattgagaccactattccaggacactgtaggaaatgaggacttcagtgtttttgatacctcaccaaatgttcaaggattatcagggatttcagactcttgttgtgcattaagcttattaagctctcaatcccagaactcttcaagccaatcatcaggaattcccttggctcactccttggttattccaagcagtcatagccatcactacaacatgagtcaggtctctgacaagataggaataagctcacagacttcttcaagccgagtgtcagatagttttccaccagaactaaatcatgccgatggaagccatctcagtcctgtattaatatcaggcaataatgatattataaactttgatatggcagatggtatcttccaaggttcagattacttgaatgtgaaagatcgtctttccgatgaagatggtgcaaccattgacttgctacaattgtcatcacagcttcagcgagttgagcatgagaggcaatccttgcaggtgaagcaagagaatgattcttcttgcactctgcggattaca

SEQ ID NO: 11183 - DNA, 1446 bp, Artificial sequence
  miR resistant mutant
atggaatcttggagttatgtccccgaagagaaaggctatttgttttctgatgaaatggatttttcacttgatgctttcatgagaagtagaaaagcattggttgaatgggacaacaaatccaactttgttgagaaagatggatttaattcagacagagaggtagttagaagcatggaatttgtggatttgggattccctgacttgttgcaaaagtcttttcatggaagccagcctctagagacatctagctatgaactagatagtaataattctagtaaaagagggaattcctccccacatgtcattgccttggattcttctatgggggaagaggaatccgattcaaagcatttgagttctctagttgaatccaagactcatgattcttcactgattgatctgaagctagggagattagcagattgtaaaggtgcaagtagtgataaagttgcaaaagaagggttcactttaacatctatacatccgaccacactttggaagagagctcgcacttccagcttgcctgcacaggctcctgtatgtcaagtttatggttgtaacatggatcttagctcctcaaaagattaccacaaaaggcataaagtttgtgatgctcactccaaaacagctaaagttattgtaaatggaattgaacagaggttttgtcagcagtgcagcaggtttcatttgctagctgagttcgatgatggtaagcgcagttgtcgcaggcgtctagcaggacacaatgaacgccgaaggaaaccccaatttgattacgtgactggtaaacagcacaagattcttcagtcatatcaaggtactaagtatctggggtcttcattacagaataaaccccagtttccctttcaagacatatttcaaagcagcatccttttccccggaaagcatgctcaattctctcagagtggacgtgtcaaactggaagaggactcgatttacggttcccaacttgctgcaccggtcacacttgatcaggaatcatcatcatgcgcattaagcttattaagcgatcagtcacagtatccgtcatgccacgcagcaggcaatccattagccagtccccaagtctttagtggcatccgcatacccgacagagacagccgagtttccaaaaagcctttgaggataagccctgcagataaacttgcaccaaatgagtcctttccatgtgatacaatctccaaggaagttatcaagaatagatccgccgcaacattttccagtgttggtcatgctcttgaagtccataatggagatgatatctgccaaccatcagagttgttcagcattaaacacagtctttcctcggaacatgcagccacggttgatttgttccaattgtcttcacatcttcagagggtggagcagcaaagaaattctgttttggtgaagtgggaaaatgaggactactgtttcccaactgtg

SEQ ID NO: 11184 - DNA, 1446 bp, Artificial sequence
  miR resistant mutant
atggaatcttggagttatgtccccgaagagaaaggctatttgttttctgatgaaatggatttttcacttgatgctttcatgagaagtagaaaagcattggttgaatgggacaacaaatccaactttgttgagaaagatggatttaattcagacagagaggtagttagaagcatggaatttgtggatttgggattccctgacttgttgcaaaagtcttttcatggaagccagcctctagagacatctagctatgaactagatagtaataattctagtaaaagagggaattcctccccacatgtcattgccttggattcttctatgggggaagaggaatccgattcaaagcatttgagttctctagttgaatccaagactcatgattcttcactgattgatctgaagctagggagattagcagattgtaaaggtgcaagtagtgataaagttgcaaaagaagggttcactttaacatctatacatccgaccacactttggaagagagctcgcacttccagcttgcctgcacaggctcctgtatgtcaagtttatggttgtaacatggatcttagctcctcaaaagattaccacaaaaggcataaagtttgtgatgctcactccaaaacagctaaagttattgtaaatggaattgaacagaggttttgtcagcagtgcagcaggtttcatttgctagctgagttcgatgatggtaagcgcagttgtcgcaggcgtctagcaggacacaatgaacgccgaaggaaaccccaatttgattacgtgactggtaaacagcacaagattcttcagtcatatcaaggtactaagtatctggggtcttcattacagaataaaccccagtttccctttcaagacatatttcaaagcagcatccttttccccggaaagcatgctcaattctctcagagtggacgtgtcaaactggaagaggactcgatttacggttcccaacttgctgcaccggtcacacttgatcaggaatcatcaagctgcgcattaagcttattaagcgatcagtcacagtatccgtcatgccacgcagcaggcaatccattagccagtccccaagtctttagtggcatccgcatacccgacagagacagccgagtttccaaaaagcctttgaggataagccctgcagataaacttgcaccaaatgagtcctttccatgtgatacaatctccaaggaagttatcaagaatagatccgccgcaacattttccagtgttggtcatgctcttgaagtccataatggagatgatatctgccaaccatcagagttgttcagcattaaacacagtctttcctcggaacatgcagccacggttgatttgttccaattgtcttcacatcttcagagggtggagcagcaaagaaattctgttttggtgaagtgggaaaatgaggactactgtttcccaactgtg

SEQ ID NO: 11185 - DNA, 1191 bp, Artificial sequence
  miR resistant mutant
atggactggaatttgaaagcaccttcttgggatttggtggatgtggataaggcaaccttacaacaacacagaggagcaatggaggagcaaaaccgatttggagtttatagaatgaaaggggagttttctgttgacttgaagcttggtcatcatgtggggaattctggcactgaatcagcactagccaacaagtccaaagatgctgctgctgcaggagtttccaaaatggcatcctcaccttcagggtcttctaagagagctagagccataaacagcacatccctcacagtggcatgccttgtggatgggtgcaattcagatcttagcaattgtagagattatcataggcgccataaggtgtgtgagctccattccaagaccccagaggtcacaattggtggcttcaagcaaaggttctgccaacaatgtagcaggttccattcgctggagcaatttgatgaaagaaaaagaagctgcagaaaacgtttagatggacacaatagaaggagaagaaagccccagccagaacctctctcgagacctggtagttttttgtcgaattaccaaggcacccaattgctacccttctcaagcccacacgtatatccatccactgccatagtgagcccagcttggagtgcttcacttgtcacttcctctgcagatgctaggttgcacaaccacaaccaacaacaacaccaccaccaccaacaagacctttttcttggatcttcccacaaagaagggaagcaagtagcattcttacacaacaaccatccctccacagctgcagcactcagcagccaaaccccgccaccttttccatcctcttccgttcgccacacccttctcaggaccgaccctctatcagaaacttgcggcggagctagaagcaaaatgttctgtgaaagcttaacaacaacaacaactaacaataattcggtgcatgacactactccatgcgcattaagcttattaagctcatcacagacgcacacaccagggaatggcttgaaccaaatggtgcagcctcctccctcaatgtccctcatgcagcccttaggcctgagcttgcaggataataacagcttagagtctgtggatcattgttcctccatgtatagcttggcttctgatcatggatcccagtgcaatgaagcagcccctcaactgtttccctttcaatgggaa

SEQ ID NO: 11186 - DNA, 1191 bp, Artificial sequence
  miR resistant mutant
atggactggaatttgaaagcaccttcttgggatttggtggatgtggataaggcaaccttacaacaacacagaggagcaatggaggagcaaaaccgatttggagtttatagaatgaaaggggagttttctgttgacttgaagcttggtcatcatgtggggaattctggcactgaatcagcactagccaacaagtccaaagatgctgctgctgcaggagtttccaaaatggcatcctcaccttcagggtcttctaagagagctagagccataaacagcacatccctcacagtggcatgccttgtggatgggtgcaattcagatcttagcaattgtagagattatcataggcgccataaggtgtgtgagctccattccaagaccccagaggtcacaattggtggcttcaagcaaaggttctgccaacaatgtagcaggttccattcgctggagcaatttgatgaaagaaaaagaagctgcagaaaacgtttagatggacacaatagaaggagaagaaagccccagccagaacctctctcgagacctggtagttttttgtcgaattaccaaggcacccaattgctacccttctcaagcccacacgtatatccatccactgccatagtgagcccagcttggagtgcttcacttgtcacttcctctgcagatgctaggttgcacaaccacaaccaacaacaacaccaccaccaccaacaagacctttttcttggatcttcccacaaagaagggaagcaagtagcattcttacacaacaaccatccctccacagctgcagcactcagcagccaaaccccgccaccttttccatcctcttccgttcgccacacccttctcaggaccgaccctctatcagaaacttgcggcggagctagaagcaaaatgttctgtgaaagcttaacaacaacaacaactaacaataattcggtgcatgacactactccttgcgcattaagcttattaagctcatcacagacgcacacaccagggaatggcttgaaccaaatggtgcagcctcctccctcaatgtccctcatgcagcccttaggcctgagcttgcaggataataacagcttagagtctgtggatcattgttcctccatgtatagcttggcttctgatcatggatcccagtgcaatgaagcagcccctcaactgtttccctttcaatgggaa

SEQ ID NO: 11187 - DNA, 1119 bp, Artificial sequence
  miR resistant mutant
atgagttctggttcagtcaccaaagcaccaccaccctcttcttcttcatcacccaactcttcctctgagtcccttgatggcttgaagtttggccagaaaatctactttgaggatgtgagtgttgcagcaacaacaacaactcaaggggcctacaaaacaagtcgtgtggtttcttccccttcttctgcttcaaagaagggaaggggtggttctttgcaacctcctaggtgtcaggttgagggctgcaaagtagatctgagtggtgctaaggcttactattctaggcacaaagtttgtaccatgcactccaagttccctactgttattgttgctggtttggagcaaaggttttgccaacagtgtagcaggtttcatctgctttctgaatttgatgaaggaaaacgaagctgccgcaggcgacttgctggtcataatgagcgccgacgaaagcccccgccaagctccacactagcctctcactatggcagactctctacgcctatttttgataacagtggccgagccggtggctttctgatggaatttgcttcatacccaaaggttacattgcgaaatacactgccaacacaaagatcagccgagccggctctcggtaaccatgctgcaacacttacctggcaaggaagctcagacacaccatctgaatttttcctgcaagaatcagggagtggtggaacaagcttccttggttccaaacatcccttactggaaagttacactggagtgactgactcaaattgcgcattaagcttattaagcagacaaacctggggttccagaaacacagccccagcaacaagtgttgagctgaacaacaacttgttgaatttcaatgggacatccatgacacaattttccgcggcttcttcacaaactgcagccatccatcaacttccaaatgccacctcatggttgtacctaaagggagttggttctggtgattgttcgcctgagggtgtccccgatcttggtctaggtcaaatttcgccgcctcttgatagccatcttcatggtgagcttaatgtgtcacagcagggcaggaggcattacatggatctaggggaatccagggcatgtgagtcttctcactggtctctt

SEQ ID NO: 11188 - DNA, 1119 bp, Artificial sequence
  miR resistant mutant
atgagttctggttcagtcaccaaagcaccaccaccctcttcttcttcatcacccaactcttcctctgagtcccttgatggcttgaagtttggccagaaaatctactttgaggatgtgagtgttgcagcaacaacaacaactcaaggggcctacaaaacaagtcgtgtggtttcttccccttcttctgcttcaaagaagggaaggggtggttctttgcaacctcctaggtgtcaggttgagggctgcaaagtagatctgagtggtgctaaggcttactattctaggcacaaagtttgtaccatgcactccaagttccctactgttattgttgctggtttggagcaaaggttttgccaacagtgtagcaggtttcatctgctttctgaatttgatgaaggaaaacgaagctgccgcaggcgacttgctggtcataatgagcgccgacgaaagcccccgccaagctccacactagcctctcactatggcagactctctacgcctatttttgataacagtggccgagccggtggctttctgatggaatttgcttcatacccaaaggttacattgcgaaatacactgccaacacaaagatcagccgagccggctctcggtaaccatgctgcaacacttacctggcaaggaagctcagacacaccatctgaatttttcctgcaagaatcagggagtggtggaacaagcttccttggttccaaacatcccttactggaaagttacactggagtgactgactcaaactgcgcattaagcttattaagcagacaaacctggggttccagaaacacagccccagcaacaagtgttgagctgaacaacaacttgttgaatttcaatgggacatccatgacacaattttccgcggcttcttcacaaactgcagccatccatcaacttccaaatgccacctcatggttgtacctaaagggagttggttctggtgattgttcgcctgagggtgtccccgatcttggtctaggtcaaatttcgccgcctcttgatagccatcttcatggtgagcttaatgtgtcacagcagggcaggaggcattacatggatctaggggaatccagggcatgtgagtcttctcactggtctctt

SEQ ID NO: 11189 - DNA, 1701 bp, Artificial sequence
  miR resistant mutant
atggagtcttggagctatgttgctgaggagaaagggtatgtctccagtgaggcactatcacctcccaacacacttgagagaagcaaaggttcctgttttggttgggaactgaaaaccccatgtagtttttccaatgacatgttgggtttgggccagcaaaacgttgaggatcaaggttttggggagttgggttttccaggaatgttggggaagcagttgtgcggtgatgatcctaatcctattggtgctgttcagagcagaaaggtggatgatgttgttgttgactgcagaatcactagtcctagtcctgttgtggctgccccaaatggattttcttcaagggaggacttcaattccaagctttcaaacgctctggtggactctaatggtggaaattcactcattgatttgaagctgggttggtttgctgaccatggagatgccatggttccaacattttccaagggagcccccattttgtcttcttccgagttgtcgacgccaccaaagagggtgagagcttcgggggcgcattctcagactgcttactgcctagtctatggctgtaacaaggatctgagtggttgcaaagactaccacaagaggcacaaagtttgtgaggttcactccaagacttccaaagttatagtgaatggcattgaacaaaggttttgtcagcaatgtagtaggtttcatttgctggctgaatttgatgatggtaagcgtagctgtcgtaaacgccttgcaggccacaatgagcgtcgaagaaagccacaagtgggtattcactctggaaaagctgggaggttgcttcagccatatgctggtattgcagatagcagattccaggagaccatgctaacatcgtcttttatctgccaagagatactccccagtggagtcttgtcttctgagaaatatggagcaagtgacatgtggagacctatcaaagctgaagacagcaccggttttacttttaggcccctttcttctattcctattaccaatggacatcctcagtcacgatctttatttccttcgtatagtggaaaacaacttccatttcttcatgaaaatggtgctacatctgccacaggaaacatcttctctgaaaacaataaccaatataatcctccttccctcggtggccaaagttccgggtcacaatcactattccaggacagctccttaggaagggaggacttcaatgttttcgacacagaatcagctgttcaaggactatcaggaatttctgactctggatgcgcattaagcttattaagctctcaatcccagaactcttcgggccaatcatcagggattcccattgctcacccgatggttattccaagcagccacagccattacaacatgagtcgggtttctgaaaagatgataggaataagttcacaggcttcaagtggagtgtcagataggtttccacctgaattcaatcctgtagatggaagtcatcttagtcccatattgatatcagataataatgaaatcatcaattttgaaatggcaaatgggatcttccaagggtcggatttcgtgaacgtgaaagatcgcctttcctgtgaagacagcctcaccattgacttgcttcaactatcgtcgcaacttcagcgtgtcgagaatcagaggctgtccttgcaggtgaaacaagaaaatgattcttcctgctctctgcggattact

SEQ ID NO: 11190 - DNA, 1701 bp, Artificial sequence
  miR resistant mutant
atggagtcttggagctatgttgctgaggagaaagggtatgtctccagtgaggcactatcacctcccaacacacttgagagaagcaaaggttcctgttttggttgggaactgaaaaccccatgtagtttttccaatgacatgttgggtttgggccagcaaaacgttgaggatcaaggttttggggagttgggttttccaggaatgttggggaagcagttgtgcggtgatgatcctaatcctattggtgctgttcagagcagaaaggtggatgatgttgttgttgactgcagaatcactagtcctagtcctgttgtggctgccccaaatggattttcttcaagggaggacttcaattccaagctttcaaacgctctggtggactctaatggtggaaattcactcattgatttgaagctgggttggtttgctgaccatggagatgccatggttccaacattttccaagggagcccccattttgtcttcttccgagttgtcgacgccaccaaagagggtgagagcttcgggggcgcattctcagactgcttactgcctagtctatggctgtaacaaggatctgagtggttgcaaagactaccacaagaggcacaaagtttgtgaggttcactccaagacttccaaagttatagtgaatggcattgaacaaaggttttgtcagcaatgtagtaggtttcatttgctggctgaatttgatgatggtaagcgtagctgtcgtaaacgccttgcaggccacaatgagcgtcgaagaaagccacaagtgggtattcactctggaaaagctgggaggttgcttcagccatatgctggtattgcagatagcagattccaggagaccatgctaacatcgtcttttatctgccaagagatactccccagtggagtcttgtcttctgagaaatatggagcaagtgacatgtggagacctatcaaagctgaagacagcaccggttttacttttaggcccctttcttctattcctattaccaatggacatcctcagtcacgatctttatttccttcgtatagtggaaaacaacttccatttcttcatgaaaatggtgctacatctgccacaggaaacatcttctctgaaaacaataaccaatataatcctccttccctcggtggccaaagttccgggtcacaatcactattccaggacagctccttaggaagggaggacttcaatgttttcgacacagaatcagctgttcaaggactatcaggaatttctgactctggctgcgcattaagcttattaagctctcaatcccagaactcttcgggccaatcatcagggattcccattgctcacccgatggttattccaagcagccacagccattacaacatgagtcgggtttctgaaaagatgataggaataagttcacaggcttcaagtggagtgtcagataggtttccacctgaattcaatcctgtagatggaagtcatcttagtcccatattgatatcagataataatgaaatcatcaattttgaaatggcaaatgggatcttccaagggtcggatttcgtgaacgtgaaagatcgcctttcctgtgaagacagcctcaccattgacttgcttcaactatcgtcgcaacttcagcgtgtcgagaatcagaggctgtccttgcaggtgaaacaagaaaatgattcttcctgctctctgcggattact

SEQ ID NO: 11191 - DNA, 1002 bp, Artificial sequence
  miR resistant mutant
atggcaaacaaacagcacaaccacaatgataacaacaaggagcttcaaccactccttgtgcttggtcctcctttcatgttcccaacctttgaagctcaaaaccttcacaactaccgtttcctcaatgccttttcctcccaaatccctctccaccaattcctcgccgagcaaaacgttgacccttcatccattcaagccatactctgcagccctcgccagaagatctccgcagacgccatccggctcctcccatcactcagcctcattgtgaccactagtaatggaacccgccacatagacttggctgagtgcagctaccgtggcattcaggttgcctctattccaggagatcaattagccgtggatgttgctgacatgactgtggggttgttgattgatgtcatgtggaacatttctgcagctgatcgacatcttaggaaatggggtccttctaagccctgcaatctttcttctggttccaagctagaaggcaagcgagtaggcattgttggattgggaaaaattggcagagaagttgctaaaaggctggaggccttcggctgcagaattatgtacaattcaagaaaccagaagccatttgtctcgtaccctttttactctaatgttgttgagcttgctggtaatagtgatgtccttgtgctttcttgctcattaaatgagcaaacaaggcacatagtcaaaagggaagtgatgttggcattggggaaagaaggagttattgtgaatattggacgtggagatctaattgatgaaaaggaattggtgagatgtttgatggaaggggagataaagggtgctggcttggatgtgtttgagaatgagcctaacgtaccaaaggaattattcccattggataatgttgtcctttcacctcatgctgcttcattgacttcacatcgtatatatgatgtttgtgaacgtgtagcagagtgtcttgaagcattcttttcaagtaaactaccggagtaccctggtcttgga

SEQ ID NO: 11192 - DNA, 1002 bp, Artificial sequence
  miR resistant mutant
atggcaaacaaacagcacaaccacaatgataacaacaaggagcttcaaccactccttgtgcttggtcctcctttcatgttcccaacctttgaagctcaaaaccttcacaactaccgtttcctcaatgccttttcctcccaaatccctctccaccaattcctcgccgagcaaaacgttgacccttcatccattcaagccatactctgcagccctcgccagaagatctccgcagacgccatccggctcctcccatcactcagcctcattgtgaccactagtaatggaacccgccacatagacttggctgagtgcagctaccgtggcattcaggttgcctctattccaggagatcaattagccgtggatgttgctgacatgactgtggggttgttgattgatgtcatgtggaacatttctgcagctgatcgacatcttaggaaatggggtccttctaagccctgcaatctttcttctggttccaagctagaaggcaagcgagtaggcattgttggattgggaaaaattggcagagaagttgctaaaaggctggaggccttcggctgcagaattatgtacaattcaagaaaccagaagccatttgtctcgtaccctttttactctaatgttgttgagcttgctggtaatagtgatgtccttgtgctttcttgctcattaaatgagcaaacaaggcacatagtcaaaagggaagtgatgttggcattggggaaagaaggagttattgtgaatattggacgtggagatctaattgatgaaaaggaattggtgagatgtttgatggaaggggagataaagggtgctggcttggatgtgtttgagaatgagcctaatgtaccaaaggaattattcccattggataatgttgtcctttcacctcatgctgcttcattgacttcacatcgtatatatgatgtttgtgaacgtgtagcagagtgtcttgaagcattcttttcaagtaaactaccggagtaccctggtcttgga

SEQ ID NO: 11193 - DNA, 1002 bp, Artificial sequence
  miR resistant mutant
atggcaaacaaacagcacaaccacaatgataacaacaaggagcttcaaccactccttgtgcttggtcctcctttcatgttcccaacctttgaagctcaaaaccttcacaactaccgtttcctcaatgccttttcctcccaaatccctctccaccaattcctcgccgagcaaaacgttgacccttcatccattcaagccatactctgcagccctcgccagaagatctccgcagacgccatccggctcctcccatcactcagcctcattgtgaccactagtaatggaacccgccacatagacttggctgagtgcagctaccgtggcattcaggttgcctctattccaggagatcaattagccgtggatgttgctgacatgactgtggggttgttgattgatgtcatgtggaacatttctgcagctgatcgacatcttaggaaatggggtccttctaagccctgcaatctttcttctggttccaagctagaaggcaagcgagtaggcattgttggattgggaaaaattggcagagaagttgctaaaaggctggaggccttcggctgcagaattatgtacaattcaagaaaccagaagccatttgtctcgtaccctttttactctaatgttgttgagcttgctggtaatagtgatgtccttgtgctttcttgctcattaaatgagcaaacaaggcacatagtcaaaagggaagtgatgttggcattggggaaagaaggagttattgtgaatattggacgtggagatctaattgatgaaaaggaattggtgagatgtttgatggaaggggagataaagggtgctggcttggatgtgtttgagaatgagcctaacgttccaaaggaattattcccattggataatgttgtcctttcacctcatgctgcttcattgacttcacatcgtatatatgatgtttgtgaacgtgtagcagagtgtcttgaagcattcttttcaagtaaactaccggagtaccctggtcttgga

SEQ ID NO: 11194 - DNA, 1002 bp, Artificial sequence
  miR resistant mutant
atggcaaacaaacagcacaaccacaatgataacaacaaggagcttcaaccactccttgtgcttggtcctcctttcatgttcccaacctttgaagctcaaaaccttcacaactaccgtttcctcaatgccttttcctcccaaatccctctccaccaattcctcgccgagcaaaacgttgacccttcatccattcaagccatactctgcagccctcgccagaagatctccgcagacgccatccggctcctcccatcactcagcctcattgtgaccactagtaatggaacccgccacatagacttggctgagtgcagctaccgtggcattcaggttgcctctattccaggagatcaattagccgtggatgttgctgacatgactgtggggttgttgattgatgtcatgtggaacatttctgcagctgatcgacatcttaggaaatggggtccttctaagccctgcaatctttcttctggttccaagctagaaggcaagcgagtaggcattgttggattgggaaaaattggcagagaagttgctaaaaggctggaggccttcggctgcagaattatgtacaattcaagaaaccagaagccatttgtctcgtaccctttttactctaatgttgttgagcttgctggtaatagtgatgtccttgtgctttcttgctcattaaatgagcaaacaaggcacatagtcaaaagggaagtgatgttggcattggggaaagaaggagttattgtgaatattggacgtggagatctaattgatgaaaaggaattggtgagatgtttgatggaaggggagataaagggtgctggcttggatgtgtttgagaatgagcctaacgtacccaaggaattattccccttggataatgttgtcctttcacctcatgctgcttcattgacttcacatcgtatatatgatgtttgtgaacgtgtagcagagtgtcttgaagcattcttttcaagtaaactaccggagtaccctggtcttgga

SEQ ID NO: 11195 - DNA, 1911 bp, Artificial sequence
  miR resistant mutant
atgggatcgaatgaagaaatgggtctggatcagctcccttccgctctggttgcgaccatcatgtccaaactggacattgcatccatctgttcattggcttccacctcatccaccttccgctcctgcgcccgacacatcttaagtttcttaccaacatttcatctcctcgacattgcgccttcgggggagttgctgagacccttgctaccgcccaatccctacctcaccaatctcaagctcgattgcgctggcctcgacgattccgcaattgggttcttgctcaaaccctccttgcacgacctttctctccacaattgcgccgatttcagtggcagactcttgtccgagatcggcaaccgatgcaaccatctcaggtctctctatttgggctccgtggctgagaaaagagggagggcaattcatatttctgatctccaggagttactcaccggttgctcccacttggaagcactgattctgatgtttgacgtctctctctttctacgtcacaactttgctcgagtatgggcttctgcctcagagaaactcacttctcttgagattggctacatttcttcagtgacagtgactgaactgcttagcccaaatttgggatcccagctgccctcaaatcctgctcaaccatccatacttccaagcattcagaaactgtgtcttaatgtagactatataactgatgctatggttggtacaatatccaaaggtctcatgcttttgacccatttggatcttcaagatgcaccactgattgaaccaagaattacatttgacctaaccaatgctggtcttcaacaaattaatcaacttgggagattgaaacatctttcattggttcgaagccaagagttccaaattacctacttccgaagagtgaatgatctgggattacttctaatggctgacaagtgtgcaaacatggagagcatatgccttggtggcttttgtcgtgtcacagacactggtttcaaaactatcctgcattcttgcactcgcttatacaagcttaaggtcactcatgggactcatttaactgatctagtttttcatgatatttccgcaacatcccttactttaacacatgttagcttaagacggtgcaatctgttaactaaccatgctgttttgagtttggcatcaaacaaggtacttaaaattcttgacttgagagattgcaggagccttggggatgaagctctccaggccattggcactcttccaagactgaaaattttactattagatggctctgatataacagatgcaggacttttgtacttaagaccatctgttattagctcactgtatgcattgtcgcttcgagggtgcaagagacttacagataaatgcatcacagctctatttaatggctgctgtgtgctggaattacgagaactggatctatctaatcttcctaacctctcagataatggagttctgctgctggcaaaaagtcggattcccttttttgaactccgtatgcgacagtgccctctaattggtgatacttcagttatggcattagcttcaatgctggttgatgaggccaaacatggaagcagtttgcgattattggatctttttaactgtggtggcattacaccgcttgcttttcgctggttgaagaaaccatattttccaaggctcaaatggttgggagtgaccggaagtgttaatagagacatggtagatgctttagccagaagcagaccattcttacatgtggcatgccatggtgaggagcttggggctgatccctatggcacttcagatgggttatacacacatgattatgatgacgtggatgaatttgagcagtggcttcttgaagctgatattgatagtgactacgaagagatgggcgatgctgaaaataatgatgaaatggttatg

SEQ ID NO: 11196 - DNA, 1911 bp, Artificial sequence
  miR resistant mutant
atgggatcgaatgaagaaatgggtctggatcagctcccttccgctctggttgcgaccatcatgtccaaactggacattgcatccatctgttcattggcttccacctcatccaccttccgctcctgcgcccgacacatcctcagtttcctcccaacatttcatctcctcgacattgcgccttcgggggagttgctgagacccttgctaccgcccaatccctacctcaccaatctcaagctcgattgcgctggcctcgacgattccgcaattgggttcttgctcaaaccctccttgcacgacctttctctccacaattgcgccgatttcagtggcagactcttgtccgagatcggcaaccgatgcaaccatctcaggtctctctatttgggctccgtggctgagaaaagagggagggcaattcatatttctgatctccaggagttactcaccggttgctcccacttggaagcactgattctgatgtttgacgtctctctctttctacgtcacaactttgctcgagtatgggcttctgcctcagagaaactcacttctcttgagattggctacatttcttcagtgacagtgactgaactgcttagcccaaatttgggatcccagctgccctcaaatcctgctcaaccatccatacttccaagcattcagaaactgtgtcttaatgtagactatataactgatgctatggttggtacaatatccaaaggtctcatgcttttgacccatttggatcttcaagatgcaccactgattgaaccaagaattacatttgacctaaccaatgctggtcttcaacaaattaatcaacttgggagattgaaacatctttcattggttcgaagccaagagttccaaattacctacttccgaagagtgaatgatctgggattacttctaatggctgacaagtgtgcaaacatggagagcatatgccttggtggcttttgtcgtgtcacagacactggtttcaaaactatcctgcattcttgcactcgcttatacaagcttaaggtcactcatgggactcatttaactgatctagtttttcatgatatttccgcaacatcccttactttaacacatgttagcttaagacggtgcaatctgttaactaaccatgctgttttgagtttggcatcaaacaaggtacttaaaattcttgacttgagagattgcaggagccttggggatgaagctctccaggccattggcactcttccaagactgaaaattttactattagatggctctgatataacagatgcaggacttttgtacttaagaccatctgttattagctcactgtatgcattgtcgcttcgagggtgcaagagacttacagataaatgcatcacagctctatttaatggctgctgtgtgctggaattacgagaactggatctatctaatcttcctaacctctcagataatggagttctgctgctggcaaaaagtcggattcccttttttgaactccgtatgcgacagtgccctctaattggtgatacttcagttatggcattagcttcaatgctggttgatgaggccaaacatggaagcagtttgcgattattggatctttttaactgtggtggcattacaccgcttgcttttcgctggttgaagaaaccatattttccaaggctcaaatggttgggagtgaccggaagtgttaatagagacatggtagatgctttagccagaagcagaccattcttacatgtggcatgccatggtgaggagcttggggctgatccctatggcacttcagatgggttatacacacatgattatgatgacgtggatgaatttgagcagtggcttcttgaagctgatattgatagtgactacgaagagatgggcgatgctgaaaataatgatgaaatggttatg

SEQ ID NO: 11197 - DNA, 543 bp, Artificial sequence
  miR resistant mutant
atggcttccataccaaacttaagcagctttttgcccacactctcccattcgaacccaaacaaccaatgcactctccctccaacctctctcttcggcaccagaatcaccctcctacgcgccacctcatcgtcccgttccctccccaacacaagttgcagtgccacgtcagcaaccgtgtcgtttagcctccccaccccgaaacccctttcggatacgcccgataaaaccccaaagtggtcggagagggctataaaatcgtatgcaatgggggaattggaagcgaggaagctcaagtatccaaacacgggaaccgaggcgattctcatggggattttggttgaaggaacaagtaatgctgcaaaattcttaagagctaatggaattactcttttgaaagcacgtgaagaaacagtagagctacttgggaaatctgatttgtttttcttcagccctgagcatcctcctttgactgaaccagcccagaaagcccttgattgggcaattgaggagaaattgaagtcagatcttggctactctaggttt

SEQ ID NO: 11198 - DNA, 543 bp, Artificial sequence
  miR resistant mutant
atggcttccattccaaacttaagcagctttttgcccacactctcccattcgaacccaaacaaccaatgcactctccctccaacctctctcttcggcaccagaatcaccctcctacgcgccacctcatcgtcccgttccctccccaacacaagttgcagtgccacgtcagcaaccgtgtcgtttagcctccccaccccgaaacccctttcggatacgcccgataaaaccccaaagtggtcggagagggctataaaatcgtatgcaatgggggaattggaagcgaggaagctcaagtatccaaacacgggaaccgaggcgattctcatggggattttggttgaaggaacaagtaatgctgcaaaattcttaagagctaatggaattactcttttgaaagcacgtgaagaaacagtagagctacttgggaaatctgatttgtttttcttcagccctgagcatcctcctttgactgaaccagcccagaaagcccttgattgggcaattgaggagaaattgaagtcagatcttggctactctaggttt

SEQ ID NO: 11199 - DNA, 3342 bp, Artificial sequence
  miR resistant mutant
atggaatcatggatgtggtgtttccttctctgttcccatttgctcatcctttatttttcaccctctcattccttatgccacccccatgacaactctgccttgctccacttcaaaaactccttcactatttatgaagatccttattattcttattattgtgatcatggttattcaaagacgacaacatgggaaaatgggagagattgttgctcttgggctggagtcacctgccaccccatctcaggtcacgtcactgagctcgacctcagctgcagtggccttcacggcaatatccatccaaacagtacgcttttccatctttctcatcttcactcactcaaccttgctttcaatcatttgtatacatctcatttgtcatctctctttggtgggtttgtgagcctcacacatctcaacttgtctcattctgaatttgaaggggatattcctagtcagataagccatttaagtaagttagtctcacttgatctctcaaaaaatgcaacagttttaaaggtgcttcttttggattttacagatatgtcttccatttcaatcaggacactcaatatgtcttcttctttggtaactcttggtcttctagcaaatgggctaagcggaaagttgacagatggcattctttgtttaccaaatcttcagtacctatatctttcatttaatgaggaccttcatggtcagcagcttccagaaatgagttgcagcacaacttctcttggtttcttagatctttcaggttgtggtttccaagggtcaatccctccctctttctctaacctcacacatcttacttccctggatctctcagctaacaacctcaatggttcagtcccatcctcactcttaacccttccacggctaacctttctgaatctaaacaataaccaactcagtggtcaaatcccaaatatttttcctaagtcaaacaactttcacgaattgcatttgagttataacaacatagagggtgagatcccatcaacactttcaaatcttcaacatctcattatcttggatctgtcactttgtgatttccaaggttcaatccctccctctttctctaacctcatacttcttacttccctggatctctcatataaccacctcaacggttcagtcccatcctcgctcttaacccttccacggctaacttttctaaatctcaatgctaattgtctcagtggtcaaatcccaaatgtctttcttcagtcaaacaacattcacgaattggatttgagtaataacaaaatagagggtgagctgccatcaacactttcaaatcttcaacgtctcattctcttggatctttcacataataaatttattggtcaaatcccagatgtgtttgtcgggctaaccaaattgaatagtctcaatctttcggataacaatttaggaggcccaatcccatcttcattatttggcttaacacaattttcttacttggattgttctaataataaattggagggccccctgccgaacaaaataagagggttttcaaatctaacatcgttaaggttatatggcaacttcctgaatggaacaattccttcttggtgtttatctttgccatctttggtggatttatatctatcagaaaaccaattctcagggcatattagtgtaatctcatcatattcattggtgagattatctttatcccacaacaagttacaaggcaatattccagatacaattttcagccttgtaaaccttactgacttagatctatcatcaaacaatttaagcggatctgtcaactttccacttttctcaaagcttcaaaatttggaaagacttaatctttcacataataatcagttatcactaaatttcaaatccaatgtcaattatagtttttccagtttatggagtttggacttatcttctacgggtttaactgaatttccaaaattatcaggaaaagtcccaattttgaaattactccatttgtccaataatacacttaaaggtagagtaccaaattggttgcacgacacgaactcatcgttatatttattggacctctctcataacctattgacgcaatcattggaccaattctcatggaaccaacacctcgtttaccttgatcttagttttaactcaatcactgctggctcttcctcaatttgcaatgcaactgcaattgaggttctcaacttatctcacaacaagttgacaggaaccattccacaatgccttattaactcatcaaccctggaagttttggatctgcaactgaacaagcttcatggccctttgccaagtacctttgcaaagaactgtcagctcagaactctagatctcaatggcaaccaattattagaaggttttctgccagaatctttgtccaattgcattaatctggaggttttaaatcttggaaacaatcaaataaaggatgtgtttccccattggcttcaaactctaccagaattgaaagtattggttttgagagccaacaagttgtacggtcccattgagggttcaaagaccaagcatggattccccagtttagttatttttgatgtctcttccaacaacttcagcggctcaataccaaatgcctacataaaaaaatttgaagccatgaagaacgttgttctatatcccgattggcaatacatggaaatttctatttcttttgcagaaaccaactaccatgattctgtgactataacaacaaaagcaattactatgacaatggacagaattcgaaatgactttgtaagcattgatttatccaaaaacagatttgaaggagggattccaaatgccattggagagcttcattcactcagaggactcaacctttcccataacaggcttattggtcctattccccagtccatgggaaatttgagatacttagaatcattggatctctcctcaaatatgctcattggtgggatacctacagaattaagcaatttgaactttcttgaagtcctaaatctttccaataaccatcttgtgggagaaatacctcgaggacaacagttcaatacttttcccaatgattcctacaagggaaactctgggttatgtggactcccactgacaatcaaatgcagcaaggaccctgaacaacattctccaccttcaactaccttcaggagagaaccaggatttggatttggttggaaaccagtggctataggatatggatgtggagtggtctttggagtgggaatgggatgttgtgtattgttaataggaaagcctcaatggcttgtgagaatggtcggaggtaaactcaataaaaaggtgaaaaggaagacaaggatgagatctaatgaaaatggtagcagaatgaat

SEQ ID NO: 11200 - DNA, 3342 bp, Artificial sequence
  miR resistant mutant
atggaatcatggatgtggtgtttccttctctgttcccatttgctcatcctttatttttcaccctctcattccttatgccacccccatgacaactctgccttgctccacttcaaaaactccttcactatttatgaagatccttattattcttattattgtgatcatggttattcaaagacgacaacatgggaaaatgggagagattgttgctcttgggctggagtcacctgccaccccatctcaggtcacgtcactgagctcgacctcagctgcagtggccttcacggcaatatccatccaaacagtacgcttttccatctttctcatcttcactcactcaaccttgctttcaatcatttgtatacatctcatttgtcatctctctttggtgggtttgtgagcctcacacatctcaacttgtctcattctgaatttgaaggggatattccttcccagataagccatttatccaagttagtctcacttgatctctcaaaaaatgcaacagttttaaaggtgcttcttttggattttacagatatgtcttccatttcaatcaggacactcaatatgtcttcttctttggtaactcttggtcttctagcaaatgggctaagcggaaagttgacagatggcattctttgtttaccaaatcttcagtacctatatctttcatttaatgaggaccttcatggtcagcagcttccagaaatgagttgcagcacaacttctcttggtttcttagatctttcaggttgtggtttccaagggtcaatccctccctctttctctaacctcacacatcttacttccctggatctctcagctaacaacctcaatggttcagtcccatcctcactcttaacccttccacggctaacctttctgaatctaaacaataaccaactcagtggtcaaatcccaaatatttttcctaagtcaaacaactttcacgaattgcatttgagttataacaacatagagggtgagatcccatcaacactttcaaatcttcaacatctcattatcttggatctgtcactttgtgatttccaaggttcaatccctccctctttctctaacctcatacttcttacttccctggatctctcatataaccacctcaacggttcagtcccatcctcgctcttaacccttccacggctaacttttctaaatctcaatgctaattgtctcagtggtcaaatcccaaatgtctttcttcagtcaaacaacattcacgaattggatttgagtaataacaaaatagagggtgagctgccatcaacactttcaaatcttcaacgtctcattctcttggatctttcacataataaatttattggtcaaatcccagatgtgtttgtcgggctaaccaaattgaatagtctcaatctttcggataacaatttaggaggcccaatcccatcttcattatttggcttaacacaattttcttacttggattgttctaataataaattggagggccccctgccgaacaaaataagagggttttcaaatctaacatcgttaaggttatatggcaacttcctgaatggaacaattccttcttggtgtttatctttgccatctttggtggatttatatctatcagaaaaccaattctcagggcatattagtgtaatctcatcatattcattggtgagattatctttatcccacaacaagttacaaggcaatattccagatacaattttcagccttgtaaaccttactgacttagatctatcatcaaacaatttaagcggatctgtcaactttccacttttctcaaagcttcaaaatttggaaagacttaatctttcacataataatcagttatcactaaatttcaaatccaatgtcaattatagtttttccagtttatggagtttggacttatcttctacgggtttaactgaatttccaaaattatcaggaaaagtcccaattttgaaattactccatttgtccaataatacacttaaaggtagagtaccaaattggttgcacgacacgaactcatcgttatatttattggacctctctcataacctattgacgcaatcattggaccaattctcatggaaccaacacctcgtttaccttgatcttagttttaactcaatcactgctggctcttcctcaatttgcaatgcaactgcaattgaggttctcaacttatctcacaacaagttgacaggaaccattccacaatgccttattaactcatcaaccctggaagttttggatctgcaactgaacaagcttcatggccctttgccaagtacctttgcaaagaactgtcagctcagaactctagatctcaatggcaaccaattattagaaggttttctgccagaatctttgtccaattgcattaatctggaggttttaaatcttggaaacaatcaaataaaggatgtgtttccccattggcttcaaactctaccagaattgaaagtattggttttgagagccaacaagttgtacggtcccattgagggttcaaagaccaagcatggattccccagtttagttatttttgatgtctcttccaacaacttcagcggctcaataccaaatgcctacataaaaaaatttgaagccatgaagaacgttgttctatatcccgattggcaatacatggaaatttctatttcttttgcagaaaccaactaccatgattctgtgactataacaacaaaagcaattactatgacaatggacagaattcgaaatgactttgtaagcattgatttatccaaaaacagatttgaaggagggattccaaatgccattggagagcttcattcactcagaggactcaacctttcccataacaggcttattggtcctattccccagtccatgggaaatttgagatacttagaatcattggatctctcctcaaatatgctcattggtgggatacctacagaattaagcaatttgaactttcttgaagtcctaaatctttccaataaccatcttgtgggagaaatacctcgaggacaacagttcaatacttttcccaatgattcctacaagggaaactctgggttatgtggactcccactgacaatcaaatgcagcaaggaccctgaacaacattctccaccttcaactaccttcaggagagaaccaggatttggatttggttggaaaccagtggctataggatatggatgtggagtggtctttggagtgggaatgggatgttgtgtattgttaataggaaagcctcaatggcttgtgagaatggtcggaggtaaactcaataaaaaggtgaaaaggaagacaaggatgagatctaatgaaaatggtagcagaatgaat

SEQ ID NO: 11201 - DNA, 1239 bp, Artificial sequence
  miR resistant mutant
atggacctactgaagcaagagcttctcaagaagcgccaatccctggcgcaagacaccggcggcaagaaattcttcaagcgctccgagatccagcagaaggaaatccagaaactccgggagcaagagaagcgcgaattggaagccaagtcacagaagcgcctcgcaacgtcctccgacaacgctgcaacagcaccaagtagtagcagtaccgcctccgcctcggcctcttccacaatcgcatcctcctccgccgcctccctcaccaacgagcaaaacatcgacaacctcgtcctcccaaagcccgaagtcatccgccgcctccgcttcctcaagcagccggtcacgctcttcggcgaagacgacgacgccaggctggaccgcctgaagtatgtcctcaaggccggcgtcttcgaggttgacagcgacatgacggaggggcagaccaacgatttcctgcgcgacatcgcggagctcaggaagcgccagaagaccgggattctcggcgagaggaagcgccagaaggccgacgacggcgccgctgaggaccgcgagggcggcgccggagatgatgacttgagtgactgcggcggctccgatggtgccgatgcggacaaggacttgaagcggatgaaggcgaatttcgaggagctttgcgatgaggataagattctggtgttctttaagaagctgttgaatgagtggaagcaggagttgcgcgagatgcctgaggcggagaagcgcacggccaaggggaagtccatggttgccactttcaagcagtgtgcgcgttacttgaacccgctgtttaagttttgcaggaagaaggttcttccggatgacattcgacaggcgttattgttgatggttgaatgctgtatgaggcgagattatctggctgcaatggaccattatatcaagctggctatcgggaatgcaccctggcctattggtgtcactatggttggtattcacgaaagatctgcccgtgaaaagatctacaccaacagtgttgctcacatcatgaatgatgagaccactcgcaaatacttgcaatctgtgaagagattaatgacattttgccaacgccgttatccgacattgccttctaaagccgttgagttcaatagtttggcaaatggcagtgatttgcattcacttctagcagaagagagatttagtgggggcaatcaggcggcatctgaagagaggcttaggataatgcctgctccaagagacagc

SEQ ID NO: 11202 - DNA, 1239 bp, Artificial sequence
  miR resistant mutant
atggacctactgaagcaagagcttctcaagaagcgccaatccctggcgcaagacaccggcggcaagaaattcttcaagcgctccgagatccagcagaaggaaatccagaaactccgggagcaagagaagcgcgaattggaagccaagtcacagaagcgcctcgcaacgtcctccgacaacgctgcaaccgcaccaagtagtagcagtaccgcctccgcctcggcctcttccacaatcgcatcctcctccgccgcctccctcaccaacgagcaaaacatcgacaacctcgtcctcccaaagcccgaagtcatccgccgcctccgcttcctcaagcagccggtcacgctcttcggcgaagacgacgacgccaggctggaccgcctgaagtatgtcctcaaggccggcgtcttcgaggttgacagcgacatgacggaggggcagaccaacgatttcctgcgcgacatcgcggagctcaggaagcgccagaagaccgggattctcggcgagaggaagcgccagaaggccgacgacggcgccgctgaggaccgcgagggcggcgccggagatgatgacttgagtgactgcggcggctccgatggtgccgatgcggacaaggacttgaagcggatgaaggcgaatttcgaggagctttgcgatgaggataagattctggtgttctttaagaagctgttgaatgagtggaagcaggagttgcgcgagatgcctgaggcggagaagcgcacggccaaggggaagtccatggttgccactttcaagcagtgtgcgcgttacttgaacccgctgtttaagttttgcaggaagaaggttcttccggatgacattcgacaggcgttattgttgatggttgaatgctgtatgaggcgagattatctggctgcaatggaccattatatcaagctggctatcgggaatgcaccctggcctattggtgtcactatggttggtattcacgaaagatctgcccgtgaaaagatctacaccaacagtgttgctcacatcatgaatgatgagaccactcgcaaatacttgcaatctgtgaagagattaatgacattttgccaacgccgttatccgacattgccttctaaagccgttgagttcaatagtttggcaaatggcagtgatttgcattcacttctagcagaagagagatttagtgggggcaatcaggcggcatctgaagagaggcttaggataatgcctgctccaagagacagc

SEQ ID NO: 11203 - DNA, 1428 bp, Artificial sequence
  miR resistant mutant
atggaagtctcaaaagaagaagctcgagtggcacccgcaccggccctagtggcgatgctgccatcccctggcatgggccacctaatcccaatgatcgagttcgcaaagcgagtggtgtgctaccataacctggcggtgagcttcgtgatccccactgacggcccaccttcaaaagcccaaaaggcagttctggaggcccttccggactcaatttcccacaccttcctccctccggtcaatctctccgacttcccgccggacaccaaaatcgaaaccctgataagtcatacagtattaagaagtcttccttccctccgccaagcattccactccctctccgccacaaacaccctctccgccgtcgtcgtagacctcttctccaccgacgccttcgacgtcgccgccgaattcaatgcctccccctacgtcttctatccctccactgccaccgtcctctccttgttcttccacctccccaccctcgaccagcaggtccagtgcgagttccgagacctcccagaaccggtcagcatccccggttgcattcctcttcccggcaaggacctgttggacccggttcaggaccgcaaaaacgaggcctacaagtggatcctacaccactgcaagcgatacaaagaagccgaggggataatcgggaacagcttcgaggagctcgaaccgggagcctggaacgagctgcagaaggaagaacaagggaggcctccggtttacgcggtgggaccgcttgtaagaatggaagcaggtcaggccgactcggagtgcttgaggtggctggacgagcagccacgtggaagtgttttgtttgtttccttcggaagcggtgggacactctcgagtgcacagatcaacgagctggctctcgggttggaaaaaagtgagcaacggtttctgtgggtggtgaagagcccaaacgaagaaatagccaacgcgacgtacttcagcgccgagagccaagcggatcccttgcagttcttaccggaagggttcgtggagagaacaaaaggaagagggtttttggttcagtcttgggctccgcagcctcaggtattgggccatccatccacgggtgggttcttgacccactgcggctggaactctattctggagagcgtggtgaacggtgtgcctttcatagcctggcctctgttcgcggagcagaggaccaacgcctttatgctcacgcatgacgtcaaggtggcgctgaggcccaacgttgcagagagtggcttggtggagagacaggagatagccagcctagtcaagtgcctcatggaaggtgaacaagggaagaagcttcgttaccgaatcaaggatatcaaggaggctgcggctaaggctctcgctcaacatggttcctccaccaccaacatctccaatttggctctcaagtggacccacaaattcaac

SEQ ID NO: 11204 - DNA, 1428 bp, Artificial sequence
  miR resistant mutant
atggaagtctcaaaagaagaagctcgagtggcacccgcaccggccctagtggcgatgctgccatcccctggcatgggccacctaatcccaatgatcgagttcgcaaagcgagtggtgtgctaccataacctggcggtgagcttcgtgatccccactgacggcccaccttcaaaagcccaaaaggcagttctggaggcccttccggactcaatttcccacaccttcctccctccggtcaatctctccgacttcccgccggacaccaaaatcgaaaccctgataagtcacacagtattaagaagtcttccttccctccgccaagcattccactccctctccgccacaaacaccctctccgccgtcgtcgtagacctcttctccaccgacgccttcgacgtcgccgccgaattcaatgcctccccctacgtcttctatccctccactgccaccgtcctctccttgttcttccacctccccaccctcgaccagcaggtccagtgcgagttccgagacctcccagaaccggtcagcatccccggttgcattcctcttcccggcaaggacctgttggacccggttcaggaccgcaaaaacgaggcctacaagtggatcctacaccactgcaagcgatacaaagaagccgaggggataatcgggaacagcttcgaggagctcgaaccgggagcctggaacgagctgcagaaggaagaacaagggaggcctccggtttacgcggtgggaccgcttgtaagaatggaagcaggtcaggccgactcggagtgcttgaggtggctggacgagcagccacgtggaagtgttttgtttgtttccttcggaagcggtgggacactctcgagtgcacagatcaacgagctggctctcgggttggaaaaaagtgagcaacggtttctgtgggtggtgaagagcccaaacgaagaaatagccaacgcgacgtacttcagcgccgagagccaagcggatcccttgcagttcttaccggaagggttcgtggagagaacaaaaggaagagggtttttggttcagtcttgggctccgcagcctcaggtattgggccatccatccacgggtgggttcttgacccactgcggctggaactctattctggagagcgtggtgaacggtgtgcctttcatagcctggcctctgttcgcggagcagaggaccaacgcctttatgctcacgcatgacgtcaaggtggcgctgaggcccaacgttgcagagagtggcttggtggagagacaggagatagccagcctagtcaagtgcctcatggaaggtgaacaagggaagaagcttcgttaccgaatcaaggatatcaaggaggctgcggctaaggctctcgctcaacatggttcctccaccaccaacatctccaatttggctctcaagtggacccacaaattcaac

SEQ ID NO: 11205 - DNA, 684 bp, Artificial sequence
  miR resistant mutant
atgaccatcggcaccctccgtcgattctttcttccatgtttcttcccttccaagcctcaacccaccgttcctttctccgatcaccaccacccacccacaaagaaccggccttcctcgccggcttcttcgacgtcgtcttccaccgctgcttcggcggctccgccgcgtccctcgaagtcgatggtgatcggaaccatcttcggtaaccgccgcggccacgtgtggttctgcatccagcacgaccgtctttcttcaaagccttcccttcttcttgagctgccgctctccaccgaccaccttgtccgcgaaatgcggaacggcatcgtccgcatcgccctcgaatgctccgccgccgccaacgcctgcccattaagaagtgtaccattatggaccgccttctgtaacggcaagaagaccggcttcgccgcccgccgccgcgccggagaccgcgtccgcaacatcctccgcaccatgcagtgcgtctccgtcggcgccggcgtcatcccctccggcttcgcctcctccgccgccgcagcctccgaggaactcatgtacatgcgcgccaacttcgaacacgtggtgggcaacgccgattccgaatcgtttcatctcatcaaccccgacgagtgccccggccaggaactcagtgtgttccttctccgatccagacttggtgccactcgc

SEQ ID NO: 11206 - DNA, 684 bp, Artificial sequence
  miR resistant mutant
atgaccatcggcaccctccgtcgattctttcttccatgtttcttcccttccaagcctcaacccaccgttcctttctccgatcaccaccacccacccacaaagaaccggccttcctcgccggcttcttcgacgtcgtcttccaccgctgcttcggcggctccgccgcgtccctcgaagtcgatggtgatcggaaccatcttcggtaaccgccgcggccacgtgtggttctgcatccagcacgaccgtctttcttcaaagccttcccttcttcttgagctgccgctctccaccgaccaccttgtccgcgaaatgcggaacggcatcgtccgcatcgccctcgaatgctccgccgccgccaacgcctgccccttaagaagtgtacccttatggaccgccttctgtaacggcaagaagaccggcttcgccgcccgccgccgcgccggagaccgcgtccgcaacatcctccgcaccatgcagtgcgtctccgtcggcgccggcgtcatcccctccggcttcgcctcctccgccgccgcagcctccgaggaactcatgtacatgcgcgccaacttcgaacacgtggtgggcaacgccgattccgaatcgtttcatctcatcaaccccgacgagtgccccggccaggaactcagtgtgttccttctccgatccagacttggtgccactcgc

SEQ ID NO: 11207 - DNA, 693 bp, Artificial sequence
  miR resistant mutant
atgaccatcgacgccctccgtcggttctttcttccatgtttcttcccttccaagcctcaatccaccatccctttctccgaccaccaccaccaccctccagccaccaagaacaaccacccttcctcgccagcttcttcgacgtcatcttccaccgctgcttcgacggctccgccgcgtccctcgaagtcgatggtgatcggaaccatcttcggtaaccgccgcggccacgtgtggttctgcatccagcacgaccgtctttcttcaaaaccttcccttcttcttgagctgccgctctccaccgaccacctcgtccgagaaatgcggaacggcgtcgtccgcatcgcccttgagtgctccgcagccaccaacgccagcccattaagaagtgtaccattatggactgccttttgcaacggcaagaagaccggcttcgccgcccgccgccgcgccggagaccgcgtccgcaacatcctccgcaccatgcagtgcgtctccgtcggtgccggcgtcatcccctccggcttcgcctccgcctccgccgcctcctccgaggagctcatgtatatgcgcgccaatttcgagcacgtggtgggtaacgccgactccgaatcgtttcatctcatcaaccccgacgagtgccccggccaggaactcagtctgttcttgctccggtccagactcggtgccactcgc

SEQ ID NO: 11208 - DNA, 693 bp, Artificial sequence
  miR resistant mutant
atgaccatcgacgccctccgtcggttctttcttccatgtttcttcccttccaagcctcaatccaccatccctttctccgaccaccaccaccaccctccagccaccaagaacaaccacccttcctcgccagcttcttcgacgtcatcttccaccgctgcttcgacggctccgccgcgtccctcgaagtcgatggtgatcggaaccatcttcggtaaccgccgcggccacgtgtggttctgcatccagcacgaccgtctttcttcaaaaccttcccttcttcttgagctgccgctctccaccgaccacctcgtccgagaaatgcggaacggcgtcgtccgcatcgcccttgagtgctccgcagccaccaacgccagccccttaagaagtgtacccttatggactgccttttgcaacggcaagaagaccggcttcgccgcccgccgccgcgccggagaccgcgtccgcaacatcctccgcaccatgcagtgcgtctccgtcggtgccggcgtcatcccctccggcttcgcctccgcctccgccgcctcctccgaggagctcatgtatatgcgcgccaatttcgagcacgtggtgggtaacgccgactccgaatcgtttcatctcatcaaccccgacgagtgccccggccaggaactcagtctgttcttgctccggtccagactcggtgccactcgc

SEQ ID NO: 11209 - DNA, 1356 bp, Artificial sequence
  miR resistant mutant
atggctcgaaaaccccttctcaagcaaaccctagccacactcttccttctcttcgtcctctacgcaatcttcaacgccttcttccagcccaccgattcctccgccttcgacgccgccgccaccttctccagtgcaagtagtgtattattaagtggcgcaaccaccaaatcccccgccatcaatgtcttcctctacgatcttccccgcaggttcacctccgacgtcatccatcaccacgcgctggcgcgtggtggcgcctcacgcgtcacccctgatgacgacgcggcggcgcccaagtaccccggccaccagcacatggcggagtggtacctcttcgcggatctctcccgagccgagtccgaacgcgcaggctcgggctcgcccgtggttctggtcgcggatcccgaggaggcggatttgttcttcgtgccgttcttctcgtcgctgagtttgattgtgaacccggttcgaccgcccgggtcaaattccggttcggagaaaccggtttacagcgacgaggagaaccaggaggcgctggtggagtggctggagaagcaggagtattggaagaggaacagtgggagggatcacgtgattgtggcttcggatccgaatgcgatgtaccgggtcatcgatcgggtaaggaacgctgtcttgctggtgtcggattttgggaggctgagacccgaccagggatcgctggtgaaggatgtggttgtgccctactcccaccgtatcagaacttaccagggtgatgccggtgttgaagatcgtaacaccttgttattttttatgggaaaccggtatcgcaaagagggagggaaaattcgtgatatactctttaaaattctagaaaatgaaaaggatgtcataataaagcatggagcacaatccagagagagtcggcgggcagcttcacaaggaatgcatacatctaaattctgtttacatcctgcaggagatactccatcagcctgccgactgtttgatgctatagttagcttgtgcattccagtgattgtcagtgataatattgagttgccttttgaagatactatagactacagaaagcttgctgtatttatagaaacttcttctgctataaagccaggatatttggtctcaaaattgagagcactgaccccagatagagtcttggcatatcagaaagagctaaaggaggttaagcgatattttgaatacgaagaacctgatggaacggttaatgagatttggcgccaagtttcgaaaaaactacccctgattaaattgatgattaaccgtgagaaaaggttgtttggaaaacaagtggagtgctcttgcgtatgtacaaaccagactgctgttagaacccta

SEQ ID NO: 11210 - DNA, 1356 bp, Artificial sequence
  miR resistant mutant
atggctcgaaaaccccttctcaagcaaaccctagccacactcttccttctcttcgtcctctacgcaatcttcaacgccttcttccagcccaccgattcctccgccttcgacgccgccgccaccttctcctccgcatcctccgtattattatccggcgcaaccaccaaatcccccgccatcaatgtcttcctctacgatcttccccgcaggttcacctccgacgtcatccatcaccacgcgctggcgcgtggtggcgcctcacgcgtcacccctgatgacgacgcggcggcgcccaagtaccccggccaccagcacatggcggagtggtacctcttcgcggatctctcccgagccgagtccgaacgcgcaggctcgggctcgcccgtggttctggtcgcggatcccgaggaggcggatttgttcttcgtgccgttcttctcgtcgctgagtttgattgtgaacccggttcgaccgcccgggtcaaattccggttcggagaaaccggtttacagcgacgaggagaaccaggaggcgctggtggagtggctggagaagcaggagtattggaagaggaacagtgggagggatcacgtgattgtggcttcggatccgaatgcgatgtaccgggtcatcgatcgggtaaggaacgctgtcttgctggtgtcggattttgggaggctgagacccgaccagggatcgctggtgaaggatgtggttgtgccctactcccaccgtatcagaacttaccagggtgatgccggtgttgaagatcgtaacaccttgttattttttatgggaaaccggtatcgcaaagagggagggaaaattcgtgatatactctttaaaattctagaaaatgaaaaggatgtcataataaagcatggagcacaatccagagagagtcggcgggcagcttcacaaggaatgcatacatctaaattctgtttacatcctgcaggagatactccatcagcctgccgactgtttgatgctatagttagcttgtgcattccagtgattgtcagtgataatattgagttgccttttgaagatactatagactacagaaagcttgctgtatttatagaaacttcttctgctataaagccaggatatttggtctcaaaattgagagcactgaccccagatagagtcttggcatatcagaaagagctaaaggaggttaagcgatattttgaatacgaagaacctgatggaacggttaatgagatttggcgccaagtttcgaaaaaactacccctgattaaattgatgattaaccgtgagaaaaggttgtttggaaaacaagtggagtgctcttgcgtatgtacaaaccagactgctgttagaacccta

SEQ ID NO: 11211 - DNA, 2196 bp, Artificial sequence
  miR resistant mutant
atggtggcatcgttgcacttgcacatcagaagaatcgtctttaggaacgcacatcccagacttcactcaacactcactaaaccccagctcaaggccctcgttctcgaccactactcccatggcaagttcgccaaccttatccaaaacgttgtcgcaagcccaccagtattattaacagcatgccaaaacctctccccctcctttccccccccggaccgcttcagcatcccggccacgtgccttgagctcctcgaaaaccgcttcgacgtggcatcatgctgcctcccactaactccctctttcgttttgcccaacttgaagctcaaggtcgtcattgaggccattcgaatggttatggaaatcgtctacgacgaccgcttcgtcaccttttgctacggtggccgcgtcggaatgggacgacacacagccataaggtacttaaaaaactccctcgagaaccctacttggtggttcaccgtcaggttcaagcctcacaggtttcaacatttccatgtcgagaagctctgttctgttattgaacgcaaagtcaacgattccgttttcattgatttgataaagaggttgtttcaatgtaaggctttggtcattgaattgggtgcggattggttaggaaggggacttcctcaggaatgtggcttgtgctccattttgatcaatgtttattttgatgcctttgataaagagattcaagagatgcgtcttcgggagaatcgagagaaccgggaattggatccgaagattattgcttcgggtttgtattctgatgtgttttacaagccggtgaaggtgtatgcggtgaggtacttggatgagatactccttgccacatcagggtccaagatgttggccttggagttgaggacgggggttgtcaagactttggaacttggattgggtttgcgtgttgataaggtgaataccgcgattcatagcgcggtgtcggagaagattgagtttcttgggatggaattgcaggctgttctgccttccattttgcgcccgccaatgtcggagaaagcaatcagggcacggaagaagtacctcaggcagaaggaagtcagggctcttgaattgagaaatgctagagcaaggaacagaaggaaactggggttgaagatatttagtcatgtttataaaaagatcaagcaaagtgacgggtttaaatttgactttagtattgaaaaccaggtccgagaaatttttagatcttgggctgatgaagtagtgcaagagttcttggggaatatagatgagtgtcaagaatggcatcgaagtctatcagctggcgatttcctacagttgagacacattagaaatcaattaccacctgagcttgttgatgcttatgataagttccaagagcaggtagatcaacatttgaatcctataaaagctaggaaggcgatagaggaagaagaaagaagagtaaaggaagaagaggaacaaaattattcaaaaggaacagttgaggatttgacaaagctctgtatgaaagttgaggcaccagaaatactcataagaaaggctgtgaagttggttgggtttacaaatcatatgggtcgtccacgaccaattgaatttcttgttgcacttgaggatgccgatattatcaagtggtatgctggcatagcaagaaggtggcttgattatttctgctgttgccacaacttcaagacagtcaaaactattgtaacttatcatttaaggttctcctgtatcttgacattagcagagaagcatgaatccaccaagcgtgaagtgataaagcatttcagcaaagatttgagagtctatgatatgaatggaaatcatgaagtgcattttcctacagaaagagaggttaagatgatgggagatagaaatctttctgatccaaaaccagtagatggggctttatctttggctgtagtaaggttggcatctgatgagcctccatgtcattgcattgcccatttctgtgacaagacaactactgtcttttatcgggtccatttgctgcaaaacagattgaatgtcagcccattggacaaagaaaaatgggtacaagggatgggtgtaattcatgaaagcctaaaccgtaagtgcctccctctctgtactgatcatgtaaatgatttgtacatggggagaatcacacttcaagacattgactgttcttattgtgtggatgtggac

SEQ ID NO: 11212 - DNA, 2196 bp, Artificial sequence
  miR resistant mutant
atggtggcatcgttgcacttgcacatcagaagaatcgtctttaggaacgcacatcccagacttcactcaacactcactaaaccccagctcaaggccctcgttctcgaccactactcccatggcaagttcgccaaccttatccaaaacgttgtcgcgagcccaccagtattattaacagcatgccaaaacctctccccctcctttccccccccggaccgcttcagcatcccggccacgtgccttgagctcctcgaaaaccgcttcgacgtggcatcatgctgcctcccactaactccctctttcgttttgcccaacttgaagctcaaggtcgtcattgaggccattcgaatggttatggaaatcgtctacgacgaccgcttcgtcaccttttgctacggtggccgcgtcggaatgggacgacacacagccataaggtacttaaaaaactccctcgagaaccctacttggtggttcaccgtcaggttcaagcctcacaggtttcaacatttccatgtcgagaagctctgttctgttattgaacgcaaagtcaacgattccgttttcattgatttgataaagaggttgtttcaatgtaaggctttggtcattgaattgggtgcggattggttaggaaggggacttcctcaggaatgtggcttgtgctccattttgatcaatgtttattttgatgcctttgataaagagattcaagagatgcgtcttcgggagaatcgagagaaccgggaattggatccgaagattattgcttcgggtttgtattctgatgtgttttacaagccggtgaaggtgtatgcggtgaggtacttggatgagatactccttgccacatcagggtccaagatgttggccttggagttgaggacgggggttgtcaagactttggaacttggattgggtttgcgtgttgataaggtgaataccgcgattcatagcgcggtgtcggagaagattgagtttcttgggatggaattgcaggctgttctgccttccattttgcgcccgccaatgtcggagaaagcaatcagggcacggaagaagtacctcaggcagaaggaagtcagggctcttgaattgagaaatgctagagcaaggaacagaaggaaactggggttgaagatatttagtcatgtttataaaaagatcaagcaaagtgacgggtttaaatttgactttagtattgaaaaccaggtccgagaaatttttagatcttgggctgatgaagtagtgcaagagttcttggggaatatagatgagtgtcaagaatggcatcgaagtctatcagctggcgatttcctacagttgagacacattagaaatcaattaccacctgagcttgttgatgcttatgataagttccaagagcaggtagatcaacatttgaatcctataaaagctaggaaggcgatagaggaagaagaaagaagagtaaaggaagaagaggaacaaaattattcaaaaggaacagttgaggatttgacaaagctctgtatgaaagttgaggcaccagaaatactcataagaaaggctgtgaagttggttgggtttacaaatcatatgggtcgtccacgaccaattgaatttcttgttgcacttgaggatgccgatattatcaagtggtatgctggcatagcaagaaggtggcttgattatttctgctgttgccacaacttcaagacagtcaaaactattgtaacttatcatttaaggttctcctgtatcttgacattagcagagaagcatgaatccaccaagcgtgaagtgataaagcatttcagcaaagatttgagagtctatgatatgaatggaaatcatgaagtgcattttcctacagaaagagaggttaagatgatgggagatagaaatctttctgatccaaaaccagtagatggggctttatctttggctgtagtaaggttggcatctgatgagcctccatgtcattgcattgcccatttctgtgacaagacaactactgtcttttatcgggtccatttgctgcaaaacagattgaatgtcagcccattggacaaagaaaaatgggtacaagggatgggtgtaattcatgaaagcctaaaccgtaagtgcctccctctctgtactgatcatgtaaatgatttgtacatggggagaatcacacttcaagacattgactgttcttattgtgtggatgtggac

SEQ ID NO: 11213 - DNA, 1059 bp, Artificial sequence
  miR resistant mutant
atggcactctccttccgacccctcatccacccccgcttcaccgaccggtcactctttcagttcctcccacccaagcctcccccttttcctcctcctccacccccaagtgtattattaccactcacgcgccgccgcggcggcttcatctcctcctgcctctccgacgacgccgtctccacgcgcaacttcgaccgtggcttcaccgtgatcgccgccatgctccgccgcatcgagcccctcgacaactccgccatctcgaaaggcgtgtcccccgccgcccgagactccatgaagcagaccatttccaccatgctcggattgctcccctccgaccacttcgctgtcaccgtcaccgtctccaaacaccccctccaccgcctcctcttctcctccatcgtcacagggtacactctatggaatgcggagtacaggatgtctctggcgaggaatctggatatgtcgggttctaggaatgaggggtcagattgtgaaacatgttcagaggttttggaggtgaaggatgtagcaaaaacagtgggtgatgagaaaatcgatgttgttaatgatttggaaagttgcagcagcagtggtagcttgaaagaatttggagatttgccttctcaggctctgagttacattcagcagttggagtctgagttgacaagtgtgatggaggaactgaatgcccagaagcaggaaatgatgcaattagaatatgacaagggaaaatggaataatttgttggaatatcttcggtctctggatcctgatatggtgactgaattgtcccggccttcatcattagaagtggaggatataattcaccaacttgttcagaacatattgagaagattctttgtggatgatgctagctctagttttatggaacaatcagtggaaggaaacgtagacaatcgcacagacagtgatgagcttagtaatacagtagccacttctcgtgattacctagcaaagttgcttttctggtgcatgttattgggtcatcacttaagagggttggaaaatagattgcatctgagctgtgttgttggactgttg

SEQ ID NO: 11214 - DNA, 1059 bp, Artificial sequence
  miR resistant mutant
atggcactctccttccgacccctcatccacccccgcttcaccgaccggtcactctttcagttcctcccacccaagcctcccccttttcctcctcctccgcccccgagtgtattattaccgctcacgcgccgccgcggcggcttcatctcctcctgcctctccgacgacgccgtctccacgcgcaacttcgaccgtggcttcaccgtgatcgccgccatgctccgccgcatcgagcccctcgacaactccgccatctcgaaaggcgtgtcccccgccgcccgagactccatgaagcagaccatttccaccatgctcggattgctcccctccgaccacttcgctgtcaccgtcaccgtctccaaacaccccctccaccgcctcctcttctcctccatcgtcacagggtacactctatggaatgcggagtacaggatgtctctggcgaggaatctggatatgtcgggttctaggaatgaggggtcagattgtgaaacatgttcagaggttttggaggtgaaggatgtagcaaaaacagtgggtgatgagaaaatcgatgttgttaatgatttggaaagttgcagcagcagtggtagcttgaaagaatttggagatttgccttctcaggctctgagttacattcagcagttggagtctgagttgacaagtgtgatggaggaactgaatgcccagaagcaggaaatgatgcaattagaatatgacaagggaaaatggaataatttgttggaatatcttcggtctctggatcctgatatggtgactgaattgtcccggccttcatcattagaagtggaggatataattcaccaacttgttcagaacatattgagaagattctttgtggatgatgctagctctagttttatggaacaatcagtggaaggaaacgtagacaatcgcacagacagtgatgagcttagtaatacagtagccacttctcgtgattacctagcaaagttgcttttctggtgcatgttattgggtcatcacttaagagggttggaaaatagattgcatctgagctgtgttgttggactgttg

SEQ ID NO: 11215 - DNA, 1377 bp, Artificial sequence
  miR resistant mutant
atggcgcgaaaaccccttctgaagcaaaccctagctacgctctttctcttcttcgtgctttatgcaatcttcaacgccttcttccaccccaccgattcctccgccttcgacgccgccgccaccttctccagtgcaagtagcgtattattaagtgctggcaccaccaaatccttatacgtcaaggttttcctctacgatctcccgcgaaggttcacctccggcgtaatccaccaccacacgcttgcgcgtggtagtggtggtgttggtggcagcgcctcacgcgccacccccgatgacgtggcggatgcgctaaagtaccccgggcaccagcatatggcggagtggtacctcttcgcggatctctcccgagccgagtccgaacgtgcaggctcgggctcgccagtggttcgggtcgcggatcccgaagaagcagatttgttcttcgttccgttcttctcatcgctgagtctcatcgtgaacccggttcgaccgccagggtcgaattccggtttggagaaaccggtttacagcgacgaggagaatcaggaggcgctggtggagtggctggagaagcaggagtattggaagaggaacaatgggagggatcacgtgattgtggcttctgatccaaatgcgatgtaccgagtcatcgatcgggtcagaaacgctgtattgcttgtttcggatttcgggaggttgagacccgaccagggatcgctggtgaaggatgtggttgtgccctactcgcaccggatcagaacgtacccgggtgatgtcggtgttgaagatcgtaaaaccttgttgtttttcatggggaatcggtaccggaaagagggagggaaaattcgtgatttactctttcaaattctagaaaatgaaaaggatgtcataataaagcatggagcacaatccagagagagtcggcgggcagcttcacatggaatgcatacatcaaagttctgtttacatccggcaggagatactccatcagcctgccgactgtttgatgctatagttagcttgtgcattccagtgattgtcagtgataatatcgagttgccttttgaagacactatagactacagaaagattgctgtatttgtagaaacttcttcagctataaagccaggacatttgctctcaaaattgagagcagtgaccccagatagagtcttggaatatcagaaaaaactaaaggaggttaagcgatattttgaatacgaagaacccgatggaacgataaatgagatttggcgccaagtttcgaaaaaactaccccttattaaattgatgattaaccgtgagaaaaggctgtttggaaaggaagtggagtgctcttgcgtatgtacaaaccagactgcagttattagaacccta

SEQ ID NO: 11216 - DNA, 1377 bp, Artificial sequence
  miR resistant mutant
atggcgcgaaaaccccttctgaagcaaaccctagctacgctctttctcttcttcgtgctttatgcaatcttcaacgccttcttccaccccaccgattcctccgccttcgacgccgccgccaccttctcctccgcatccagcgtattattatccgctggcaccaccaaatccttatacgtcaaggttttcctctacgatctcccgcgaaggttcacctccggcgtaatccaccaccacacgcttgcgcgtggtagtggtggtgttggtggcagcgcctcacgcgccacccccgatgacgtggcggatgcgctaaagtaccccgggcaccagcatatggcggagtggtacctcttcgcggatctctcccgagccgagtccgaacgtgcaggctcgggctcgccagtggttcgggtcgcggatcccgaagaagcagatttgttcttcgttccgttcttctcatcgctgagtctcatcgtgaacccggttcgaccgccagggtcgaattccggtttggagaaaccggtttacagcgacgaggagaatcaggaggcgctggtggagtggctggagaagcaggagtattggaagaggaacaatgggagggatcacgtgattgtggcttctgatccaaatgcgatgtaccgagtcatcgatcgggtcagaaacgctgtattgcttgtttcggatttcgggaggttgagacccgaccagggatcgctggtgaaggatgtggttgtgccctactcgcaccggatcagaacgtacccgggtgatgtcggtgttgaagatcgtaaaaccttgttgtttttcatggggaatcggtaccggaaagagggagggaaaattcgtgatttactctttcaaattctagaaaatgaaaaggatgtcataataaagcatggagcacaatccagagagagtcggcgggcagcttcacatggaatgcatacatcaaagttctgtttacatccggcaggagatactccatcagcctgccgactgtttgatgctatagttagcttgtgcattccagtgattgtcagtgataatatcgagttgccttttgaagacactatagactacagaaagattgctgtatttgtagaaacttcttcagctataaagccaggacatttgctctcaaaattgagagcagtgaccccagatagagtcttggaatatcagaaaaaactaaaggaggttaagcgatattttgaatacgaagaacccgatggaacgataaatgagatttggcgccaagtttcgaaaaaactaccccttattaaattgatgattaaccgtgagaaaaggctgtttggaaaggaagtggagtgctcttgcgtatgtacaaaccagactgcagttattagaacccta

SEQ ID NO: 11217 - DNA, 975 bp, Artificial sequence
  miR resistant mutant
atggagactaatccccgcacgatccgcagcctagtctcgaagctgagctccgtttccgaagccgcccgcgtcgacgccctctcccaactccgcctcatgtccaaacagtcccccgaaacccgccccctcatcgccgacgccggcgcaatccccttcgtcgccgaaaccctctattgctcttcgcaccccccccaagaaaacgccgctgccacactcctgaacctcagcatcacccaaaaggagcccctcatgtcgacacgtggcgtcctcgacgccatcgctcacgtgatctctcaccacaatacaacaagtagtccagcagcagtccagtccgccgccgccaccatccacagcctcctctcctccgtggactcctaccgccccgtcgtcgggtccaagcgcgagattgtctactccctcatcgacatcctccgctgccacgtctcgtctcctcctcgcaccatcaaggactcgttaaaggccttattcgccatcgcgcttcatcctcttaaccgatctactatgattaatcttggcgcggttcccgcgcttttttcgttggttgccaaggacggtagggttgggattgtggaggacgccaccgccgtcatcgcgcaggtcgccggttgcgaggacgccgccgaggccttttttaaggcctccggagtcggcgtcctcgctgacctcctcgaccttgccaccgccgccagcatgcggactaaagagaacgccgtctcggcgttgctcaatttggtgcggtgcggcggtgacaaggtcgccgccgacgtgcgcgacgccgtggcgttcggcgcgttggatggaattgcggatgttagggacggcgggagcggcaaggggaagaacaaagctgcggagttgttgaaggttttgctcggtgagaacaatggcgatgttgttgcgttgaacagtgatacttgttcttcgtttggttcctcgaggaatcatgattcggaa

SEQ ID NO: 11218 - DNA, 975 bp, Artificial sequence
  miR resistant mutant
atggagactaatccccgcacgatccgcagcctagtctcgaagctgagctccgtttccgaagccgcccgcgtcgacgccctctcccaactccgcctcatgtccaaacagtcccccgaaacccgccccctcatcgccgacgccggcgcaatccccttcgtcgccgaaaccctctattgctcttcgcaccccccccaagaaaacgccgctgccacactcctgaacctcagcatcacccaaaaggagcccctcatgtcgacacgtggcgtcctcgacgccatcgctcacgtgatctctcaccacaacacaacaagtagtccagcagcagtccagtccgccgccgccaccatccacagcctcctctcctccgtggactcctaccgccccgtcgtcgggtccaagcgcgagattgtctactccctcatcgacatcctccgctgccacgtctcgtctcctcctcgcaccatcaaggactcgttaaaggccttattcgccatcgcgcttcatcctcttaaccgatctactatgattaatcttggcgcggttcccgcgcttttttcgttggttgccaaggacggtagggttgggattgtggaggacgccaccgccgtcatcgcgcaggtcgccggttgcgaggacgccgccgaggccttttttaaggcctccggagtcggcgtcctcgctgacctcctcgaccttgccaccgccgccagcatgcggactaaagagaacgccgtctcggcgttgctcaatttggtgcggtgcggcggtgacaaggtcgccgccgacgtgcgcgacgccgtggcgttcggcgcgttggatggaattgcggatgttagggacggcgggagcggcaaggggaagaacaaagctgcggagttgttgaaggttttgctcggtgagaacaatggcgatgttgttgcgttgaacagtgatacttgttcttcgtttggttcctcgaggaatcatgattcggaa

SEQ ID NO: 11219 - DNA, 699 bp, Artificial sequence
  miR resistant mutant
atggcttttgaagctctcaactcaccaacaacaaccgccccatctttccccttcgacgacccaactattccatgggccaaaagaaaacgttcaaagcgttgttcacgcgaccacccttcggaggaagagtacctcgctctctgcctcatcatgctcgctcgcggcggcaccacccgccgcgtcagcactccaccgccgcaaccgactccagatccttccaccaagctcagttacaaatgctccgtttgcaacaaaagcttcccctcttaccaagcgctcggtggacacaaggccagtcaccggaaactcgctgcctccggcggcgaagaccaaccaacaacaacaagtagtgcagcaagctccgccaacaccgcctccggaggtaggacccacgagtgctccatctgccacaagtccttccccaccggacaggccctcggcggacacaaacgttgtcactacgaaggtaacagtaatggaaataacaacaacagtaacagctctgtcaccgccgcctcggaaggcgtggggtccacccacaccgtgagtcacggccaccaccgcgacttcgatctcaacatcccggcctttccggatttttcgaccaaggtcggagaagacgaggttgagagccctcaccctgtcatgaagaagcctcgcctcttcgtcattcccaagatcgaaatcccccaatttcaa

SEQ ID NO: 11220 - DNA, 699 bp, Artificial sequence
  miR resistant mutant
atggcttttgaagctctcaactcaccaacaacaaccgccccatctttccccttcgacgacccaactattccatgggccaaaagaaaacgttcaaagcgttgttcacgcgaccacccttcggaggaagagtacctcgctctctgcctcatcatgctcgctcgcggcggcaccacccgccgcgtcagcactccaccgccgcaaccgactccagatccttccaccaagctcagttacaaatgctccgtttgcaacaaaagcttcccctcttaccaagcgctcggtggacacaaggccagtcaccggaaactcgctgcctccggcggcgaagaccaacccacaacaacaagtagtgcagcaagctccgccaacaccgcctccggaggtaggacccacgagtgctccatctgccacaagtccttccccaccggacaggccctcggcggacacaaacgttgtcactacgaaggtaacagtaatggaaataacaacaacagtaacagctctgtcaccgccgcctcggaaggcgtggggtccacccacaccgtgagtcacggccaccaccgcgacttcgatctcaacatcccggcctttccggatttttcgaccaaggtcggagaagacgaggttgagagccctcaccctgtcatgaagaagcctcgcctcttcgtcattcccaagatcgaaatcccccaatttcaa

SEQ ID NO: 11221 - DNA, 2001 bp, Artificial sequence
  miR resistant mutant
atgaggatccgtaacctggtggcacccacccttcaatttcaaacacaatcgacagtaaccggtaacctccgacgaaggctctccccccccggcgtcgacttcgccgcctatggctcggccctccagcactgcagtgatcatagattattaagacaaggcaagcagctccacgctcgcctcatcctactctccgttacacccgataacttcctcgcctcgaaactcatcctcttctactccaaatccaaccacgcgcacttcgcgcgtaaggtgttcgacacgaccccccacagaaacaccttcacgtggaacgccatgctcctcggctactccttcaacagcatgttccgccacgcgctcaacctcttcgggtcgttcactttctccacaacccccaacgcctcccccgataacttcaccatatcctgcgtcttgaaagccttagcttcgtctttttgtagccccgaattggcgaaagaggttcactgtttaatccttcgacgcgggttgtactctgatattttcgttctcaacgcgttgatcacgtgctactgcaggtgcgacgaggtttggcttgcgcggcacgtgttcgacggaatgtccgagagagatatcgtaacgtggaacgcgatgattggtgggtattctcagaggaggttatatgatgagtgtaagaggttgtacttggagatgttgaatgtttccgcggttgcacccaatgtggttacggcggtgagcgtgatgcaggcgtgtggacagtccatggaccttgcgtttggaatggagcttcaccgtttcgtgaaggagagtggaattgagattgatgtttcgctctccaatgctgtggttgctatgtatgccaagtgtggtaggttggattatgcgcgggagatgtttgagggaatgcgtgagaaggacgaggttacttatggggcaattatttcggggtacatggattatgggcttgttgatgatgccatgggtgtttttcgaggggtggagaaccctggattgaatatgtggaatgctgtgatttctggtatggttcagaataagcagtttgaaggggtttttgatttggtacggcaaatgcagggttctggtttgagtcccaatgctgtcacacttgctagcattcttccttcgttttcgtacttctcaaacctgcgaggagggaaagaggtgcatggttatgctatcaggagaggttatgagcaaaatgtatatgtgtcaacttctattattgatgcttatggaaagttggggtgtatttgtggggcacggtgggtttttgatctatcacagagtaggagcttgataatttggacatcaattatatctgcttatgctgctcatggtgatgctggtttggcacttggtctctatgctcagatgctagataagggaattcgacctgacccggtgacattaacttctgtattgacagcttgtgctcactctggattggttgatgaagcttggaatatcttcaattcgatgccctcaaaatatggcattcaacctttggtggagcactatgcttgcatggtgggtgttcttagtcgagctggtaagctctcagaagcagtgcaattcatttctgaaatgccaattgaaccaagtgctaaagtttggggtcctctactacacggggcttctgtttttggtgatgttgaaatcggcaagtttgcttgtgatcatttgtttgagattgagcctgaaaatactgggaattacatcattatggccaatttatatgcacatgcagggaaatgggaacaagctggtgaggttagggaaagaatgaaagtaattgggttacaaaagatccgtggaagtagctggattgaaacgagtggagggctactgagtttcattgccaaggatgtgtcaaatggaagatctgatgagatttatgcattgctggaagggttgcttggtttgatgagggaagaaggatgtgtattacaggaagagttagattatgagaatgtttttagt

SEQ ID NO: 11222 - DNA, 2001 bp, Artificial sequence
  miR resistant mutant
atgaggatccgtaacctggtggcacccacccttcaatttcaaacacaatcgacagtaaccggtaacctccgacgaaggctctccccccccggcgtcgacttcgccgcctatggctcggccctccagcactgctccgatcatagattattaagacaaggcaagcagctccacgctcgcctcatcctactctccgttacacccgataacttcctcgcctcgaaactcatcctcttctactccaaatccaaccacgcgcacttcgcgcgtaaggtgttcgacacgaccccccacagaaacaccttcacgtggaacgccatgctcctcggctactccttcaacagcatgttccgccacgcgctcaacctcttcgggtcgttcactttctccacaacccccaacgcctcccccgataacttcaccatatcctgcgtcttgaaagccttagcttcgtctttttgtagccccgaattggcgaaagaggttcactgtttaatccttcgacgcgggttgtactctgatattttcgttctcaacgcgttgatcacgtgctactgcaggtgcgacgaggtttggcttgcgcggcacgtgttcgacggaatgtccgagagagatatcgtaacgtggaacgcgatgattggtgggtattctcagaggaggttatatgatgagtgtaagaggttgtacttggagatgttgaatgtttccgcggttgcacccaatgtggttacggcggtgagcgtgatgcaggcgtgtggacagtccatggaccttgcgtttggaatggagcttcaccgtttcgtgaaggagagtggaattgagattgatgtttcgctctccaatgctgtggttgctatgtatgccaagtgtggtaggttggattatgcgcgggagatgtttgagggaatgcgtgagaaggacgaggttacttatggggcaattatttcggggtacatggattatgggcttgttgatgatgccatgggtgtttttcgaggggtggagaaccctggattgaatatgtggaatgctgtgatttctggtatggttcagaataagcagtttgaaggggtttttgatttggtacggcaaatgcagggttctggtttgagtcccaatgctgtcacacttgctagcattcttccttcgttttcgtacttctcaaacctgcgaggagggaaagaggtgcatggttatgctatcaggagaggttatgagcaaaatgtatatgtgtcaacttctattattgatgcttatggaaagttggggtgtatttgtggggcacggtgggtttttgatctatcacagagtaggagcttgataatttggacatcaattatatctgcttatgctgctcatggtgatgctggtttggcacttggtctctatgctcagatgctagataagggaattcgacctgacccggtgacattaacttctgtattgacagcttgtgctcactctggattggttgatgaagcttggaatatcttcaattcgatgccctcaaaatatggcattcaacctttggtggagcactatgcttgcatggtgggtgttcttagtcgagctggtaagctctcagaagcagtgcaattcatttctgaaatgccaattgaaccaagtgctaaagtttggggtcctctactacacggggcttctgtttttggtgatgttgaaatcggcaagtttgcttgtgatcatttgtttgagattgagcctgaaaatactgggaattacatcattatggccaatttatatgcacatgcagggaaatgggaacaagctggtgaggttagggaaagaatgaaagtaattgggttacaaaagatccgtggaagtagctggattgaaacgagtggagggctactgagtttcattgccaaggatgtgtcaaatggaagatctgatgagatttatgcattgctggaagggttgcttggtttgatgagggaagaaggatgtgtattacaggaagagttagattatgagaatgtttttagt

SEQ ID NO: 11223 - DNA, 1044 bp, Artificial sequence
  miR resistant mutant
atgtcctgccggaaaagacaaaagacttcgccggacaaaacctccgacgacttcttcgactctctccccgacgacttagtattaagcatattatgtaagctcagctccaccgcaacttccccctccgatttcattagtgtcttaataacgtgcaagagactaaactccttaggccttcactctcttgtgttatcaaaagcttcccacaaaacattctcagtcaaagccaaaaactggtgcgactctcttcaccgtttcctcaaacattgtgcagatgccggaaacattgaagcctgttacactctcggcatgattcggttttactgcttgcaaaacagagggagcggcgcgtcgctgatggcgaaggcggcgatgaactctcacgcgccggcgctgtactcgctcgcggtgatacagttcaacggaagcggcggcaccaaaaacgacaaggaccttcgagcgggtgtggcgctttgcgcacgcgctgcgttcctcggtcatatcgacgcgctgcgtgagcttggtcattgcttgcaagacggttacggcgttaagctaaacgtaacggagggacgacggtttttggtgcaagcaaacgctcgtgaactcgccgccgtgctctccgccgggaataccaagcgcccctggctgacctggagccaccaccctgtcacccacccgcggctccggtcgggttgcccgttgatgagtgattacgggtgcaatgttccggcgccggatgctcacccggcgagtcagtttatgtcggagtggtttgatatccggggcgggtttccgggtccggatatgaggctttgttctcattcgggttgcgggcgacccgagacaaggaggcacgagtttcgaaggtgttcggtttgcggtttggtgaattattgctcacgcgcttgtcaggcgcttgattggaagttccggcacaaggcggaatgtgctaccgttgagaggtggctcgatgacgacggcgaaggcgtcgccggtgagaatgacggcggcggagatgacggggtaatgatggttaatagt

SEQ ID NO: 11224 - DNA, 1044 bp, Artificial sequence
  miR resistant mutant
atgtcctgccggaaaagacaaaagacttcgccggacaaaacctccgacgacttcttcgactctctccccgacgaccttgtacttagcatactttgtaagctcagctccaccgcaacttccccctccgatttcattagtgtcttaataacgtgcaagagactaaactccttaggccttcactctcttgtgttatcaaaagcttcccacaaaacattctcagtcaaagccaaaaactggtgcgactctcttcaccgtttcctcaaacattgtgcagatgccggaaacattgaagcctgttacactctcggcatgattcggttttactgcttgcaaaacagagggagcggcgcgtcgctgatggcgaaggcggcgatgaactctcacgcgccggcgctgtactcgctcgcggtgatacagttcaacggaagcggcggcaccaaaaacgacaaggaccttcgagcgggtgtggcgctttgcgcacgcgctgcgttcctcggtcatatcgacgcgctgcgtgagcttggtcattgcttgcaagacggttacggcgttaagctaaacgtaacggagggacgacggtttttggtgcaagcaaacgctcgtgaactcgccgccgtgctctccgccgggaataccaagcgcccctggctgacctggagccaccaccctgtcacccacccgcggctccggtcgggttgcccgttgatgagtgattacgggtgcaatgttccggcgccggatgctcacccggcgagtcagtttatgtcggagtggtttgatatccggggcgggtttccgggtccggatatgaggctttgttctcattcgggttgcgggcgacccgagacaaggaggcacgagtttcgaaggtgttcggtttgcggtttggtgaattattgctcacgcgcttgtcaggcgcttgattggaagttccggcacaaggcggaatgtgctaccgttgagaggtggctcgatgacgacggcgaaggcgtcgccggtgagaatgacggcggcggagatgacggggtaatgatggttaatagt

SEQ ID NO: 11225 - DNA, 1044 bp, Artificial sequence; identical to SEQ ID NO: 11224
  miR resistant mutant

SEQ ID NO: 11226 - DNA, 1044 bp, Artificial sequence; identical to SEQ ID NO: 11224
  miR resistant mutant

SEQ ID NO: 11227 - DNA, 1533 bp, Artificial sequence
  miR resistant mutant
atggttaccaccaccgttgattcttcctctaaccatcactcacccactgctgctgatacctctaataatttcccgcaaaaaaccatgccatctccgtgggctcaggtcgttcgcggtgccgacgctgagccaaatgaccagagcccacccagctcttcctcttcctcgtccctcgattccattaattctaacggtcccgccgttcaaacaagcgatatcgccgtgaaacctgcgtggaagaaaccggaggccaatggcgtcgccgaagttgggcctgtaatgggcgctcattcttggcccgatttatccgagtccaccaagcccaccgctaaattgacatctgactcctctgttaagactgctgctgatgaagagtcaaccaccactcctcagggtcctgttacttcagacccccctcagaaacaagccactgctaatgcaaaacctagtcctactcctgcaatgaactatggtatggctaatagacaaagatcaatgaagcagcgtggaggggcaaatggcaataatgttgggtctggtcctgttcagaacaacttctctggtactaccccaaatcttcctccaccaccacctccgcccccctttcctgttcttctgatgcctccaagtacatttgcccatgggataccaggggctcctgttcctactccaagggatccttacaggaacaataactgggatgcaagacctcaacatgggggttttatgccaccaatgaatgagcatcggagtccctctcacaggggcaatgctgggcaccatccacgtggagaaggtccctatcacaacagttatggcaacaggcgcgatcaggaccgtgtaggttatgcaaatactagagatgctcatgtaaatcaacagaggatgcctccaaggggattaatgaggcccccaccacctaatcctgctccatttatggggcctcagcctatgcgaccccttgcaaaccctgctgggtttcctgaatactattatttcccaacacttcaatttgaaccctttgggggcatgccatttttcacacatgcacctcctcctgcgatgttctacccggttgcagaaactcctctcaccaatacaatagccaaccaaattgattattactttagtgatgctaatttagtgaaggatgagtatttaaggtccaacatggatgaacagggatgggttcctatttctttgattgcaagcttcccacgtgttagaagtttgacaagcaacattaagttgatattggattcattgagaacttccacttttgtggaagtgcagggggacaagttgaggaggcgcactgagtggatgaagtggcttccgtctgttcagcttctggccaagtctggctcaatatcccctagcgaatcaagttctaataacctagcagctgattttgaaaagatcacagtggatgatgctaaagttaacgccaagcctacggcaaatgatgatgctgcaggagagtcctcaactcagtcccaagtcccaaatgatgctactactgtgagcagcaat

SEQ ID NO: 11228 - DNA, 1533 bp, Artificial sequence
  miR resistant mutant
atggttaccaccaccgttgattcttcctctaaccatcactcacccactgctgctgatacctctaataatttcccgcaaaaaaccatgccatctccgtgggctcaggtcgttcgcggtgccgacgctgagccaaacgaccagagcccacccagctcttcctcttcctcgtccctcgattccattaattctaacggtcccgccgttcaaacaagcgatatcgccgtgaaacctgcgtggaagaaaccggaggccaatggcgtcgccgaagttgggcctgtaatgggcgctcattcttggcccgatttatccgagtccaccaagcccaccgctaaattgacatctgactcctctgttaagactgctgctgatgaagagtcaaccaccactcctcagggtcctgttacttcagacccccctcagaaacaagccactgctaatgcaaaacctagtcctactcctgcaatgaactatggtatggctaatagacaaagatcaatgaagcagcgtggaggggcaaatggcaataatgttgggtctggtcctgttcagaacaacttctctggtactaccccaaatcttcctccaccaccacctccgcccccctttcctgttcttctgatgcctccaagtacatttgcccatgggataccaggggctcctgttcctactccaagggatccttacaggaacaataactgggatgcaagacctcaacatgggggttttatgccaccaatgaatgagcatcggagtccctctcacaggggcaatgctgggcaccatccacgtggagaaggtccctatcacaacagttatggcaacaggcgcgatcaggaccgtgtaggttatgcaaatactagagatgctcatgtaaatcaacagaggatgcctccaaggggattaatgaggcccccaccacctaatcctgctccatttatggggcctcagcctatgcgaccccttgcaaaccctgctgggtttcctgaatactattatttcccaacacttcaatttgaaccctttgggggcatgccatttttcacacatgcacctcctcctgcgatgttctacccggttgcagaaactcctctcaccaatacaatagccaaccaaattgattattactttagtgatgctaatttagtgaaggatgagtatttaaggtccaacatggatgaacagggatgggttcctatttctttgattgcaagcttcccacgtgttagaagtttgacaagcaacattaagttgatattggattcattgagaacttccacttttgtggaagtgcagggggacaagttgaggaggcgcactgagtggatgaagtggcttccgtctgttcagcttctggccaagtctggctcaatatcccctagcgaatcaagttctaataacctagcagctgattttgaaaagatcacagtggatgatgctaaagttaacgccaagcctacggcaaatgatgatgctgcaggagagtcctcaactcagtcccaagtcccaaatgatgctactactgtgagcagcaat

SEQ ID NO: 11229 - DNA, 1533 bp, Artificial sequence
  miR resistant mutant
atggttaccaccaccgttgattcttcctctaaccatcactcacccactgctgctgatacctctaataatttcccgcaaaaaaccatgccatctccgtgggctcaggtcgttcgcggtgccgacgctgagccaaatgatcagagcccacccagctcttcctcttcctcgtccctcgattccattaattctaacggtcccgccgttcaaacaagcgatatcgccgtgaaacctgcgtggaagaaaccggaggccaatggcgtcgccgaagttgggcctgtaatgggcgctcattcttggcccgatttatccgagtccaccaagcccaccgctaaattgacatctgactcctctgttaagactgctgctgatgaagagtcaaccaccactcctcagggtcctgttacttcagacccccctcagaaacaagccactgctaatgcaaaacctagtcctactcctgcaatgaactatggtatggctaatagacaaagatcaatgaagcagcgtggaggggcaaatggcaataatgttgggtctggtcctgttcagaacaacttctctggtactaccccaaatcttcctccaccaccacctccgcccccctttcctgttcttctgatgcctccaagtacatttgcccatgggataccaggggctcctgttcctactccaagggatccttacaggaacaataactgggatgcaagacctcaacatgggggttttatgccaccaatgaatgagcatcggagtccctctcacaggggcaatgctgggcaccatccacgtggagaaggtccctatcacaacagttatggcaacaggcgcgatcaggaccgtgtaggttatgcaaatactagagatgctcatgtaaatcaacagaggatgcctccaaggggattaatgaggcccccaccacctaatcctgctccatttatggggcctcagcctatgcgaccccttgcaaaccctgctgggtttcctgaatactattatttcccaacacttcaatttgaaccctttgggggcatgccatttttcacacatgcacctcctcctgcgatgttctacccggttgcagaaactcctctcaccaatacaatagccaaccaaattgattattactttagtgatgctaatttagtgaaggatgagtatttaaggtccaacatggatgaacagggatgggttcctatttctttgattgcaagcttcccacgtgttagaagtttgacaagcaacattaagttgatattggattcattgagaacttccacttttgtggaagtgcagggggacaagttgaggaggcgcactgagtggatgaagtggcttccgtctgttcagcttctggccaagtctggctcaatatcccctagcgaatcaagttctaataacctagcagctgattttgaaaagatcacagtggatgatgctaaagttaacgccaagcctacggcaaatgatgatgctgcaggagagtcctcaactcagtcccaagtcccaaatgatgctactactgtgagcagcaat

SEQ ID NO: 11230 - DNA, 606 bp, Artificial sequence
  miR resistant mutant
atgaagaagctctaccgtaaaggaaccgtccacccctctccctcgccgtcgccgccaaccatctccgaccacctatccttcctccccgccgccatcctcaccctcacattaagtttaagtccaaaagatcaagaagtcctcgcatacctcatctcatgctcctcttcctcatcctccaccaccaacttttccggcaaccatcgccggaaccctaaggttgtcgtggacggcgatcaccctcctgtcttcaactgcagctgcttccgctgctacatgagctactgggtccgctggaactcctctcccaaccaccaactcatacacgaaatcatcgacaccttcgaagactctctggctcacaccacaaaaccttctagaaaggataagagaaacaagaggggctccaaaaccaagccttccgagttgactcgctccgagtttccctcttcgccgccggaatcggtgccggagagtagcagtagcagcgccggtgccggtgaggttgaggctggtcagggcggtgatggtggcggcgatgaggagaaagggtcggtgagaaggtttgttagtttcattggagaaaggatttggggcgcttgggctcag

SEQ ID NO: 11231 - DNA, 606 bp, Artificial sequence
  miR resistant mutant
atgaagaagctctaccgtaaaggaaccgtccacccctctccctcgccgtcgccgccaaccatctccgaccacctatccttcctccccgccgccatcctcaccctcactttaagtttaagtccaaaagatcaagaagtcctcgcatacctcatctcatgctcctcttcctcatcctccaccaccaacttttccggcaaccatcgccggaaccctaaggttgtcgtggacggcgatcaccctcctgtcttcaactgcagctgcttccgctgctacatgagctactgggtccgctggaactcctctcccaaccaccaactcatacacgaaatcatcgacaccttcgaagactctctggctcacaccacaaaaccttctagaaaggataagagaaacaagaggggctccaaaaccaagccttccgagttgactcgctccgagtttccctcttcgccgccggaatcggtgccggagagtagcagtagcagcgccggtgccggtgaggttgaggctggtcagggcggtgatggtggcggcgatgaggagaaagggtcggtgagaaggtttgttagtttcattggagaaaggatttggggcgcttgggctcag

SEQ ID NO: 11232 - DNA, 969 bp, Artificial sequence
  miR resistant mutant
atggaaagtggattacctttgcttaattatctcttgcagcagactctcagaaccatttgcacttctcccaattcttccactccttctaagtgggtatatgctgtcttctggaggatattacctcgcaactttcctccaccaaggtgggaatttggaggaacagcattagacttaagtaagggcaataaaaggaactggatccttgtctgggaagatgggttctgcgattttaacgaatgcgagcaaaggaagagtggtagtggttacttgaacggtagatttggagctgacgtattcttcaaaatgtcgcatgaggtttacaattatggagagggactcgtgggaaaagttgccgcagataatagtcacaaatgggtttacaatgagagtcacaatgagtgtgaatctagctatattgcttcatggaatgcttcagtcgaacctcaaccaaaggcgtgggagtttcagttcaattcaggcattcagagtatagtcataatcgccgtcagagaaggcgtagtgcaattgggttcttttaacaagatatcagaggacctgaatctggtgatcagcatacagaggcaattcagctaccttcagagcatacctggtgtgtttggtattcaaagaccatacctacctcttcaacatccatacattgtgaagccaagtttcatagaaaacaatgcaatgactctatatgatatggggtggaacaccaaccctcagaatggagcaccaggcccatctctttgttcaggttctccttctctaccactaccaaccatgccctgtagttttggagctttgctatcaaagttaccatctggaatcccaccctataattccactcaagtccttgatgcagggacacaaagcaccattgagagagtgaagatagaggattgtgaatttcatcctacccttgatgacgatcacaaaggaagaaaggtcggttccctgaacaag

SEQ ID NO: 11233 - DNA, 969 bp, Artificial sequence
  miR resistant mutant
atggaaagtggattacctttgcttaattatctcttgcagcagactctcagaaccatttgcacttctcccaattcttccactccttctaagtgggtatatgctgtcttctggaggatattacctcgcaactttcctccaccaaggtgggaatttggaggaactgcattagacttaagtaagggcaataaaaggaactggatccttgtctgggaagatgggttctgcgattttaacgaatgcgagcaaaggaagagtggtagtggttacttgaacggtagatttggagctgacgtattcttcaaaatgtcgcatgaggtttacaattatggagagggactcgtgggaaaagttgccgcagataatagtcacaaatgggtttacaatgagagtcacaatgagtgtgaatctagctatattgcttcatggaatgcttcagtcgaacctcaaccaaaggcgtgggagtttcagttcaattcaggcattcagagtatagtcataatcgccgtcagagaaggcgtagtgcaattgggttcttttaacaagatatcagaggacctgaatctggtgatcagcatacagaggcaattcagctaccttcagagcatacctggtgtgtttggtattcaaagaccatacctacctcttcaacatccatacattgtgaagccaagtttcatagaaaacaatgcaatgactctatatgatatggggtggaacaccaaccctcagaatggagcaccaggcccatctctttgttcaggttctccttctctaccactaccaaccatgccctgtagttttggagctttgctatcaaagttaccatctggaatcccaccctataattccactcaagtccttgatgcagggacacaaagcaccattgagagagtgaagatagaggattgtgaatttcatcctacccttgatgacgatcacaaaggaagaaaggtcggttccctgaacaag

SEQ ID NO: 11234 - DNA, 2853 bp, Artificial sequence
  miR resistant mutant
atggggaaaaaatcgagtccggcggagggggaagaagcggtgccggagcatctgcggtgcagccgtacggacgggcggcaatggcggtgccggcggcgagtgaaggaaaacctaaagctgtgcgagattcactacgtgcaagctcggcgtcggcagcacaagaagacgctgaagcttaagagaaagaggcaaaacgacgccgttgaggttcagattggggccaagcgggaccgaaaatcgagagaggcattggtcaataggaggaaccaattggagctcataaggatggttctgcagagggaggttgagaagaagaagaagaagcaatcgcaattgaatttgaatttgcatttgcatttcaatcacgagttgaagaaggaactgccgaatggggttatggctattgcgtccaatatggcatcttctcgttacttcaggtccaagaatgctgagaggggctctgttagtaagttgcaggttgtgcagtgtggacaaagcataaagaaggggaggaggaagaagtgtcattggtgtcagagaagtgattcttggagtcttgtaatgtgttcaagctgccagagagagtttttctgcatggagtgcattaaacaacggtattttgctactcaaaatgaggttaagatggcatgtccagtttgtcgaggaacttgcacctgtaaagattgcttgtcaagtcaatacgaagagagtgaaagtaaggaatatttggctggtaaaaacagagttgataggatattgcattttcattatttggtctgtatgctccttcctgtactaaaacaaataaaagaagaccatcatgtaggcgtagaaaaaacagcaaaaatcaaaggtgggaaaagaacttctgatattatcatcaagcctgtcgattttgtctgcaacgagaaaaattactgcaattactgcaaaacacccattttggatcttcatagaagctgccttagttgttcctacagtctttgcttaagctgttctcaggcattaagtcaaggaagcacctctgaagaaatcaactcttctatatccaacctacctgacaaaataaatgcatgcatttttagtgaaggtcaccttttggatgataaggtcatttctaatggcaatttaactgatacctcaacattagttgagtggacaaattgtaatggtgctgacattgtgtcatgcccacctacaaagcttggtgattgtggtgatagccaccttgatttgaaatatgtctttcccttaagttggatcaaagaaatggaagtaaaggcagaagaaatagtttgcagctatgactttcctgaaactttggatagaagttcaagctgctcactgtgtgttgacaaagatcataaaactagcagatacaagcagttaccagaagcagctcaaagagaagattctaatgataatttcttgttttatcctacaattttggacatcagttgcaatcattttgaacactttcggaaacactggggaataggccatcctgtagtagtgcgagatgtgctccaaagtatgccaaaccttagttgggatccactggtcatgttctgtacttatcttgagaggagcatgacaagatatgagaataataaggacttacttgaagcttgtttggattggtttgaggtggagattaacgttagtcagtactttactgggtctcttaaatgtcaacctcagaaaaataattggcatgagatgctgaaacttaaaggatggttgtcttcccaactattcaaagaacaatttccagctcattttgctgaagtaattgattctcttccaattcaagaatacatgaatccctggtctggtcttctgaatttagctgcaaatttgccacaggggagtacaaaacatgacataggacctcatgtttatatttcatatggctgtgctgatgaagaagctgattccgtgacaaatctttgttacgactcatatgatatggttaatattatggcacataccatggacatccctctctctacagatcagcttgctaaaataagtaagttgttgaaaaaacacaaaactctatgtcagaaggtgtcatcatctaaaactactagtgagcattcagaagacagggaacaaaatgaaatgcatggtatggtaagagaaggaactgactttctaaggagagtcaatagaacagcttccatctctactgaagccaaaccgatatctaatcagaagttagacaccaatatttctgatgatgaagaatgtggttccgattctgaaactgaaaaggcacagtcaagcctcccatttcagcgacgcgttctaagcactgaaatgtctccagatcataatcctagaaatccctttgaaaactcaaacagtgataaaaggaagaagtttactgagaattctggtgctcattgggatgtctttcgaagacaggatgtgcccaagctcttagaatacctcaaaagacactctgatgaattttcttataatagtgaatgtcacgagaagatggttcatccaattctggatcagagcttctttcttgacaatactcacaagatgagacttaaggaggagtttaaaattgaaccatggacttttgagcaacatgttggagaagctgtcatcattccttctggatgtccataccagattaggaatcctaagtgttgtgtacatgtggaattggaatttgtgtcccctgagaatgtctctgagtgtatccaattgattgatgaggtccggctgcttccagaagaccataaagcaaaaggagaaaagctggaggtgaaaaaaatggccctttatagcatgagtacagcaatagaagaaatacgtgagcttacctgcaaaaca

SEQ ID NO: 11235 - DNA, 2853 bp, Artificial sequence
  miR resistant mutant
atggggaaaaaatcgagtccggcggagggggaagaagcggtgccggagcatctgcggtgcagccgtacggacgggcggcaatggcggtgccggcggcgagtgaaggaaaacctaaagctgtgcgagattcactacgtgcaagctcggcgtcggcagcacaagaagacgctgaagcttaagagaaagaggcaaaacgacgccgttgaggttcagattggggccaagcgggaccgaaaatcgagagaggcattggtcaataggaggaaccaattggagctcataaggatggttctgcagagggaggttgagaagaagaagaagaagcaatcgcaattgaatttgaatttgcatttgcatttcaatcacgagttgaagaaggaactgccgaatggggttatggctattgcgtccaatatggcatcttctcgttacttcaggtccaagaatgctgagaggggctctgttagtaagttgcaggttgtgcagtgtggacaaagcataaagaaggggaggaggaagaagtgtcattggtgtcagagaagtgattcttggagtcttgtaatgtgttcaagctgccagagagagtttttctgcatggagtgcattaaacaacggtattttgctactcaaaatgaggttaagatggcatgtccagtttgtcgaggaacttgcacctgtaaagattgcttgtcaagtcaatacgaagagagtgaaagtaaggaatatttggctggtaaaaacagagttgataggatattgcattttcattatttggtctgtatgctccttcctgtactaaaacaaataaaagaagaccatcatgtaggcgtagaaaaaacagcaaaaatcaaaggtgggaaaagaacttctgatattatcatcaagcctgtcgattttgtctgcaacgagaaaaattactgcaattactgcaaaacacccattttggatcttcatagaagctgccttagttgttcctacagtctttgcttaagctgttctcaggcattaagtcaaggaagcacctctgaagaaatcaactcttctatatccaacctacctgacaaaataaatgcatgcatttttagtgaaggtcaccttttggatgataaggtcatttctaatggcaatttaactgatacctcaacattagttgagtggacaaattgtaatggtgctgacattgtgtcatgcccacctacaaagcttggtgattgtggtgatagccaccttgatttgaaatatgtctttcccttaagttggatcaaagaaatggaagtaaaggcagaagaaatagtttgcagctatgactttcctgaaactttggatagaagttcaagctgctcactgtgtgttgacaaagatcataaaactagcagatacaagcagttaccagaagcagctcaaagagaagattctaatgataatttcttgttttatcctacaattttggacatcagttgcaatcattttgaacactttcggaaacactggggaataggccatcctgtagtagtgcgagatgtgctccaaagtatgccaaaccttagttgggatccactggtcatgttctgtacttatcttgagaggagcatgacaagatatgagaataataaggacttacttgaagcttgtttggattggtttgaggtggagattaacgttagtcagtactttactgggtctcttaaatgtcaacctcagaaaaataattggcatgagatgctgaaacttaaaggatggttgtcttcccaactattcaaagaacaatttccagctcattttgctgaagtaattgattctcttccaattcaagaatacatgaatccctggtctggtcttctgaatttagctgcaaatttgccacaggggagtacaaaacatgacataggacctcatgtttatatttcatatggctgtgctgatgaagaagctgattccgtgacaaatctttgttacgactcatatgatatggttaatattatggcacataccatggacatccctctctctacagatcagcttgctaaaataagtaagttgttgaaaaaacacaaaactctatgtcagaaggtgtcatcatctaaaactactagtgagcattcagaagacagggaacaaaatgaaatgcatggtatggtaagagaaggaactgactttctaaggagagtcaatagaacagcttccatctctactgaagccaaaccgatatctaatcagaagttagacaccaatatttctgatgatgaagaatgtggttccgattctgaaactgaaaaggcacaatcaagcctcccatttcaacgacgcgttctaagcactgaaatgtctccagatcataatcctagaaatccctttgaaaactcaaacagtgataaaaggaagaagtttactgagaattctggtgctcattgggatgtctttcgaagacaggatgtgcccaagctcttagaatacctcaaaagacactctgatgaattttcttataatagtgaatgtcacgagaagatggttcatccaattctggatcagagcttctttcttgacaatactcacaagatgagacttaaggaggagtttaaaattgaaccatggacttttgagcaacatgttggagaagctgtcatcattccttctggatgtccataccagattaggaatcctaagtgttgtgtacatgtggaattggaatttgtgtcccctgagaatgtctctgagtgtatccaattgattgatgaggtccggctgcttccagaagaccataaagcaaaaggagaaaagctggaggtgaaaaaaatggccctttatagcatgagtacagcaatagaagaaatacgtgagcttacctgcaaaaca

SEQ ID NO: 11236 - DNA, 978 bp, Artificial sequence
  miR resistant mutant
atggaccctaatccccgcactatccgcagcctagtctcgaagctcagctccgtctccgaagccgcccgcatcgacgccctctcccagctccgcctcatgtcaaaacaatcccccgaaacgcgccccatcatcgcccaagcaggcgcaatcccctacatcgcagaaaccctctattcctcttctcacccctcccaagaagacgccgctaccacactcctcaatttaagtataacattgaaagaacccctcatgtccacacgtggcgtcctcgacgccatcgcccacgtcatctctcaccaccacaccacctcctctccccctgcggttcagtccgccgccgccaccatccacagcctcctctcctcggtcgactcctaccgccccgttgtcggctccaagcgcgagattgtctactccctcatcgacatcctccgctgccacctctcgtctcctccccgcactatcaaggattcgttaaaggcgttattcgccatcgcgcttcatccgattaacagatctacgatgattaaccttggtgcggttcccgcgcttttttcgctggtgttgaaggacggtagggttgggattgtggaggacgcgacggcggtgatcgcgcaggtcgcgggatgcgaggacgccgtggatgcctttcgcaaggcctccggtggtgtcggcgtccttgccgacctcctcgacctcgccaccgccgccagcatgcgcaccaaggagaacgccgtctcggcgctgctcaatttggtgcggtgcgggggcgacaaggtcgccgccgacgtgcgcgacgtcgtggcgtttggagcgctagatggaattgcggatgtgagggatgggggtagtgtaaaggggaagaacaaggctgctgaattgatgaaggttttgctcggtcaaaacaatggcgatgttgttgtgtttaacagtgatacttgttcttcgtttggttccaccaggaatcatgattcggaa

SEQ ID NO: 11237 - DNA, 978 bp, Artificial sequence
  miR resistant mutant
atggaccctaatccccgcactatccgcagcctagtctcgaagctcagctccgtctccgaagccgcccgcatcgacgccctctcccagctccgcctcatgtcaaaacaatcccccgaaacgcgccccatcatcgcccaagcaggcgcaatcccctacatcgcagaaaccctctattcctcttctcacccctcccaagaagacgccgctaccacactcctcaacttaagtataacattgaaagaacccctcatgtccacacgtggcgtcctcgacgccatcgcccacgtcatctctcaccaccacaccacctcctctccccctgcggttcagtccgccgccgccaccatccacagcctcctctcctcggtcgactcctaccgccccgttgtcggctccaagcgcgagattgtctactccctcatcgacatcctccgctgccacctctcgtctcctccccgcactatcaaggattcgttaaaggcgttattcgccatcgcgcttcatccgattaacagatctacgatgattaaccttggtgcggttcccgcgcttttttcgctggtgttgaaggacggtagggttgggattgtggaggacgcgacggcggtgatcgcgcaggtcgcgggatgcgaggacgccgtggatgcctttcgcaaggcctccggtggtgtcggcgtccttgccgacctcctcgacctcgccaccgccgccagcatgcgcaccaaggagaacgccgtctcggcgctgctcaatttggtgcggtgcgggggcgacaaggtcgccgccgacgtgcgcgacgtcgtggcgtttggagcgctagatggaattgcggatgtgagggatgggggtagtgtaaaggggaagaacaaggctgctgaattgatgaaggttttgctcggtcaaaacaatggcgatgttgttgtgtttaacagtgatacttgttcttcgtttggttccaccaggaatcatgattcggaa

SEQ ID NO: 11238 - DNA, 2253 bp, Artificial sequence
  miR resistant mutant
atggtcgagttagaaatatcaaggagggagtctttgcagactaaggaaaaagtcaatatgctttcttcaagaattggcaagcctttatctaagtttaatggttttcctaaagatatgatagagaaggaccgcatcaacaatgcggacttatcattgacaaaaaccattaggattccaaaaaaggaaaaaataccaccatatacatcttgggtatatgtggtcagaaatgaaagaatggccaaagatcaaacagttcttggaaaataccaaatgtattatgataaaaatagaggtgaaatgatgatatgtagtgatagtgaagaagagatggtaaatcccaaggatgttaaacacgacttcaccgaggctgaagaccaaattctatggaccacacttgcggaatatggatctactgaggagatatttagtattgttaaagagattgttaagacaactgattcacaaattcaggagaggtatgaaatactcaacaaaaaaaatatgaggagtccaagtcagaattttgaagattgtcattgtagaggatgtcaaaatcatcttgggatatgtttggaagaaaacttgaatgttattttagaaccttttgataattttttttgtcgccgatgtttgatctttgattgttctgtgcatggcatttatcaacctttaatatatcatagtgaaaaacaatcaatttggtctgaacttgaaggtgacaagaaaccatgcagcaagcagtgttacattatgttaaaagatgttaatattttgtcaaaaaatacatctcaaaggtattttcgagataaaataattacaccaatggaagaggaccctacattacctcatgacgagcctcaagattcttctaaaaggttgagaaccccaaatgatataatcactgaaattgaccttcgttacatggaactcaatttggatgctaatgatgaagaaaaccacacaacatatggtgcatctttgaaaagtcttaacgaacattcttcagggaaatcaacagttttttataactatagccacgatgagcaaggcaaaggagttatggatggagaaaaagatctcacaaatgagatagaatttaaccaattgtccatttcaagggaagtgcaagcttatgagatgacaaatgagtcaaattggagacctctagagagagatttgtatttgaagggggtagaaatgtttggaaaaaatagttgccttatagcctttaacttacttcatggtttgaagacttgcatagaagtaactaaatacatgtctgcttgtgacgagacaataacccatggatccataccaagttcaaccgtggacaaaaaggaaaagatcaatgcagagttcacagaccaagaaatggcttcaagatcacggtcgcaacgaaaaaagggcaaaccaagaaagtttaattattctcgaaaaagcgcaggattacccccacgctggagaaaaattgcttatgggcaaaatcaatataataagcaatatactccttgtgggtgtcagggaatgtgtggaaaggaatgtccttgtcttcttcatggaacttgctgtgaaaaatattgtgggtgttcaaagctttgcaacaaccgatttagaggatgtcgttgtgctaagagtcaatgcagaagccgacaatgcccatgttttgcagccaaccgcgaatgtgacccagatgtttgtcgaaattgttgggttagttgtggcgatggttcattaggggagccacctcgatgtggagatggaaaatgtggaaatatgaatcttcttctagggctaaaagagaggattcttttggcaaagtcagatgttataggatggggaactttcgcaaagaacccgattaacaagaatgtgtgcctaggagaatacacgggtgaactgatcactcctaaagaagcagaaaaacgtggaaaattatatgatcgcataaacacttcattccttttcaaccttaatgatcggtgggttattgattcttgtcgcttgggagacaagttaaaatttgcaaaccattcatcaaaacccaactgctatgcaaaggtgatgcttgttggaggagaacatcgagttggcatattttccaaggaaaacattgaagcaggtgaagagattttctatgattattggtatgatctagattgtgctccacaatgggctcttccacctgatgaggtttctaagaaagatgaatcgattgtttctcaaggcagggcaaagaaaaaccaatctcattgt

SEQ ID NO: 11239 - DNA, 2253 bp, Artificial sequence
  miR resistant mutant
atggtcgagttagaaatatcaaggagggagtctttgcagactaaggaaaaagtcaatatgctttcttcaagaattggcaagcctttatctaagtttaatggttttcctaaagatatgatagagaaggaccgcatcaacaatgcggacttatcattgacaaaaaccattaggattccaaaaaaggaaaaaataccaccatatacatcttgggtatatgtggtcagaaatgaaagaatggccaaagatcaaacagttcttggaaaataccaaatgtattatgataaaaatagaggtgaaatgatgatatgtagtgatagtgaagaagagatggtaaatcccaaggatgttaaacacgacttcaccgaggctgaagaccaaattctatggaccacacttgcggaatatggatctactgaggagatatttagtattgttaaagagattgttaagacaactgattcacaaattcaggagaggtatgaaatactcaacaaaaaaaatatgaggagtccaagtcagaattttgaagattgtcattgtagaggatgtcaaaatcatcttgggatatgtttggaagaaaacttgaatgttattttagaaccttttgataattttttttgtcgccgatgtttgatctttgattgttctgtgcatggcatttatcaacctttaatatatcatagtgaaaaacaatcaatttggtctgaacttgaaggtgacaagaaaccatgcagcaagcagtgttacattatgttaaaagatgttaatattttgtcaaaaaatacatctcaaaggtattttcgagataaaataattacaccaatggaagaggaccctacattacctcatgacgagcctcaagattcttctaaaaggttgagaaccccaaatgatataatcactgaaattgaccttcgttacatggaactcaatttggatgctaatgatgaagaaaaccacacaacatatggtgcatctttgaaaagtcttaacgaacattcttcagggaaatcaacagttttttataactatagccacgatgagcaaggcaaaggagttatggatggagaaaaagatctcacaaatgagatagaatttaaccaattgtccatttcaagggaagtgcaagcttatgagatgacaaatgagtcaaattggagacctctagagagagatttgtatttgaagggggtagaaatgtttggaaaaaatagttgccttatagcctttaacttacttcatggtttgaagacttgcatagaagtaactaaatacatgtctgcttgtgacgagacaataacccatggatccataccaagttcaaccgtggacaaaaaggaaaagatcaatgcagagttcacagaccaagaaatggcttcaagatcacggtcgcaacgaaaaaagggcaaaccaagaaagtttaattattctcgaaaatctgcaggattacccccacgctggagaaaaattgcttatgggcaaaatcaatataataagcaatatactccttgtgggtgtcagggaatgtgtggaaaggaatgtccttgtcttcttcatggaacttgctgtgaaaaatattgtgggtgttcaaagctttgcaacaaccgatttagaggatgtcgttgtgctaagagtcaatgcagaagccgacaatgcccatgttttgcagccaaccgcgaatgtgacccagatgtttgtcgaaattgttgggttagttgtggcgatggttcattaggggagccacctcgatgtggagatggaaaatgtggaaatatgaatcttcttctagggctaaaagagaggattcttttggcaaagtcagatgttataggatggggaactttcgcaaagaacccgattaacaagaatgtgtgcctaggagaatacacgggtgaactgatcactcctaaagaagcagaaaaacgtggaaaattatatgatcgcataaacacttcattccttttcaaccttaatgatcggtgggttattgattcttgtcgcttgggagacaagttaaaatttgcaaaccattcatcaaaacccaactgctatgcaaaggtgatgcttgttggaggagaacatcgagttggcatattttccaaggaaaacattgaagcaggtgaagagattttctatgattattggtatgatctagattgtgctccacaatgggctcttccacctgatgaggtttctaagaaagatgaatcgattgtttctcaaggcagggcaaagaaaaaccaatctcattgt

SEQ ID NO: 11240 - DNA, 2013 bp, Artificial sequence
  miR resistant mutant
atgtcaataatatttgaaagggggtctttggaaaccgagaaaaatgtcaatatgctttcttcaagaattcacaatcctttatgtaaattaagtggctttcctaaaggtattgtggagaagaatcaaatcaacaatgttgacttatcaccaacaaaaagcattaggattccacacacggataaattaccacaatatacatcttgggtatacgtggctagaaatgagagaatggtcgatgatcaatcggttatcgggaaataccaaatgtaccatgataaaaataaaggtgaaatggtgatatgcagtgacaatgaggaagagatagtagatcccgaggatgtcaaacatgaattcactgaggttgaagacaaatttttgcggatgacgcttgaagaatatgggtgtactgaggaggtattgaatgtcgttaaaaaatttgttaagactactaattcagaaattcaggagaggtatgaaaaactcaaggaaaagaatatggagattctagaccaacattgtgaagattgtcattgtagaggatgtgaaaatcatcttggattatgtttggaaaaaagcttgagtgttactttagaaactttcaataatcttttatgtcgacaatgtctgatctttgattgtcctatgcatggcattaataaacctttagtataccatagtgaaaaccaaccagtttggcttgaacctgaaggtgataagaaaccatgcagtgatcaatgttacctcatgttaaaggatgctaggattttgtcgaaaaattcaactcaatggtcttttcaagataaagtaattacaacaatggaagaggactcaatattgcctcgtgatgatgaagaaaaccacacagtggaagtgcaagctaatgggatgtcaagcgactcatattggagacctctggaaatggatttgtatttgaagggagtaaaaatgtttggaaaaaatagttgccttatagccattaccttacttcctggcttgaagacatgcttggaagtagctaggtacatgtttggtggtggggagttaatgaccaatggattcataccaagttcaatcatggaaaaaaatgaaaagatcaatgcagggtgcacagaccaagaaatgtcatcaagatcacgaccgcaacgaaaaaaaggaaaacctaaaaagttcaattattctcgaaagagcgcaggattacccccacgctggcgaaaaattgcttatgggcaaaacttgtgtaataagcaatatactccttgtgggtgccatggaatatgtggaaaggaatgttcctgtcttgttaatggaacttgctgtgaaaaatattgcgggtgttcaaaacactgcagtaatcgatttagaggatgccgttgcacaaaaagtcaatgcaaaagtcgatcatgtccatgttttgcagccaaccgtgaatgtgacccagatgtttgtcaaaattgttgggttagttgcggtgatgactcattggggaggctacctcgacatgaagatgctaagtgtggaaatatgaatcttcttttagggcaaaaagaaaggattcttttggcaaagtcagatgttataggatggggagcctttgcaaagaacccaattagcaaaaatgtttgcctaggagagtacacgggtgagctaatccctcctaaagaagcagaaaagcgtgggaaactatatgatcgcataaacacttccttcctttttaacctcaatgaccagtgggttattgacgcttttcgcatgggagacaagttaaaatttgcaaaccattcatcaaagcccaactgctatgcaaaggtgatgcttgttggaggagatcatcgagtcggcatatttgccagggaaaacattaaagctggtgatgagattttttatgactatggctatgatctagattctgcaccgctatgggctcttccacccaacgaggcggccaagaaagacaaattagttgtttctctgagtaggacaaagaaaaaagaaaaaaaatcagtttcatttcaa

SEQ ID NO: 11241 - DNA, 2013 bp, Artificial sequence
  miR resistant mutant
atgtcaataatatttgaaagggggtctttggaaaccgagaaaaatgtcaatatgctttcttcaagaattcacaatcctttatgtaaattaagtggctttcctaaaggtattgtggagaagaatcaaatcaacaatgttgacttatcaccaacaaaaagcattaggattccacacacggataaattaccacaatatacatcttgggtatacgtggctagaaatgagagaatggtcgatgatcaatcggttatcgggaaataccaaatgtaccatgataaaaataaaggtgaaatggtgatatgcagtgacaatgaggaagagatagtagatcccgaggatgtcaaacatgaattcactgaggttgaagacaaatttttgcggatgacgcttgaagaatatgggtgtactgaggaggtattgaatgtcgttaaaaaatttgttaagactactaattcagaaattcaggagaggtatgaaaaactcaaggaaaagaatatggagattctagaccaacattgtgaagattgtcattgtagaggatgtgaaaatcatcttggattatgtttggaaaaaagcttgagtgttactttagaaactttcaataatcttttatgtcgacaatgtctgatctttgattgtcctatgcatggcattaataaacctttagtataccatagtgaaaaccaaccagtttggcttgaacctgaaggtgataagaaaccatgcagtgatcaatgttacctcatgttaaaggatgctaggattttgtcgaaaaattcaactcaatggtcttttcaagataaagtaattacaacaatggaagaggactcaatattgcctcgtgatgatgaagaaaaccacacagtggaagtgcaagctaatgggatgtcaagcgactcatattggagacctctggaaatggatttgtatttgaagggagtaaaaatgtttggaaaaaatagttgccttatagccattaccttacttcctggcttgaagacatgcttggaagtagctaggtacatgtttggtggtggggagttaatgaccaatggattcataccaagttcaatcatggaaaaaaatgaaaagatcaatgcagggtgcacagaccaagaaatgtcatcaagatcacgaccgcaacgaaaaaaaggaaaacctaaaaagttcaattattctcgaaagtctgcaggattacccccacgctggcgaaaaattgcttatgggcaaaacttgtgtaataagcaatatactccttgtgggtgccatggaatatgtggaaaggaatgttcctgtcttgttaatggaacttgctgtgaaaaatattgcgggtgttcaaaacactgcagtaatcgatttagaggatgccgttgcacaaaaagtcaatgcaaaagtcgatcatgtccatgttttgcagccaaccgtgaatgtgacccagatgtttgtcaaaattgttgggttagttgcggtgatgactcattggggaggctacctcgacatgaagatgctaagtgtggaaatatgaatcttcttttagggcaaaaagaaaggattcttttggcaaagtcagatgttataggatggggagcctttgcaaagaacccaattagcaaaaatgtttgcctaggagagtacacgggtgagctaatccctcctaaagaagcagaaaagcgtgggaaactatatgatcgcataaacacttccttcctttttaacctcaatgaccagtgggttattgacgcttttcgcatgggagacaagttaaaatttgcaaaccattcatcaaagcccaactgctatgcaaaggtgatgcttgttggaggagatcatcgagtcggcatatttgccagggaaaacattaaagctggtgatgagattttttatgactatggctatgatctagattctgcaccgctatgggctcttccacccaacgaggcggccaagaaagacaaattagttgtttctctgagtaggacaaagaaaaaagaaaaaaaatcagtttcatttcaa

SEQ ID NO: 11242 - DNA, 1791 bp, Artificial sequence
  miR resistant mutant
atgacactaactaacatggcgcacaataacatcaactccaccaccatggatggcgtgcctcaccgagtcaacagcccgcgttacaccggttcgatgactcgtcgagctcactcattcaaacgcaacaacaacagcaataatgaaattgagctccaaataaactcacccagatcacccttggtttctgctgaaggctctgttttgaaaaggaatcagcatcatcataaggagaaaaagaacaagtttggccattgggtgttcttgctcttttgtggggtatgcttgtttctgggtcttctcaagatttgtgcttctgcctggtggttcggatctaaagtacacagtacacacgaatccattattcaggaactatctgactccatcactagtcgaaatctaatggatcaaagctcccatggttatgcatatagggagggagcaaatgaggttgaacgaactctaaagatggtaactacaggggtaattgatagccaggctggcatggctgaagaatcaggtgtctggtctagacccaactatgacaatttcacccaatgtatagacctgccaagaaatcataaaaagctagatgaaaagaccaatggctacattctagtaaatgctaatggtggcctgaatcaaatgagatttgggatatgtgatatggttgctgttgctaagattatgaaggcaacacttgttcttccttctctcgatcacacctcttactggggtgatgcaagtggcttcaaggatttatttgactggaaacattttattgagacattgaaggatgatatccacgtagttgagacattaccacctgcctatgctgaaattgaacctttctcgaaaactccaatatcttggtctaaggccagttactacaagaatgaggttcttcccctgctaaagcagcataaagtgatctatttcacccataccaattccagacttgctaataatggaattccaagctccatacaaaagctaagatgtcgtgtaaattatagagcattgaaatattcagctccgattgaagaattcggaagcaaattaatatctagaatgcgacagaatgaaaatccttatctcgcgcttcatttgaggtatgagaaggatatgcttgcatttactggctgcagtcacaatttgacagcagaagaagatgaagagctacgacagatgcggtatgaagttggtcactggaaggagaaggagattaatgggactgagaggagattgactggaggttgtccattaactcctagggaaacttccctattgcttagagcactaggttttccatcacaaaccaggatttatctggtagctggagaagcatatggtagaggaagtatgaaatatcttgaggatgctttccccaacattttcagccacagtagcttaagcagcgaggaagagttgaatcctttcaagaatcaccagaacatgttagctggcatagactatattgttgcacttcagagtgatgtatttctctatacttatgatggaaatatggcaaaggcagtacaaggccataggcacttcgaaaacttcaagaagactatcaatccagacaaggtaaattttgttaaactcgttgataagttggatgaaggaaaaatttcttggaagaagttcagctccaaggtaaaaaggctgcatgaagatcgaatcggtgctccgtatcccagggagcggggagaatttcctaagctagaggaaagtttttatgcaaatcctctgccaggatgtatatgtgaaagaaaattagatacttcacag

SEQ ID NO: 11243 - DNA, 1791 bp, Artificial sequence
  miR resistant mutant
atgacactaactaacatggcgcacaataacatcaactccaccaccatggatggcgtgcctcaccgagtcaacagcccgcgttacaccggttcgatgactcgtcgagctcactcattcaaacgcaacaacaacagcaataatgaaattgagctccaaataaactcacccagatcacccttggtttctgctgaaggctctgttttgaaaaggaatcagcatcatcataaggagaaaaagaacaagtttggccattgggtgttcttgctcttttgtggggtatgcttgtttctgggtcttctcaagatttgtgcttctgcctggtggttcggatctaaagtacacagtacacacgaatccattattcaggaactatctgactccatcactagtcgaaatctaatggatcaaagctcccatggttatgcatatagggagggagcaaatgaggttgaacgaactctaaagatggtaactacaggggtaattgatagccaggctggcatggctgaagaatcaggtgtctggtctagacccaactatgacaatttcacccaatgtatagacctgccaagaaatcataaaaagctagatgaaaagaccaatggctacattctagtaaatgctaatggtggcctgaatcaaatgagatttgggatatgtgatatggttgctgttgctaagattatgaaggcaacacttgttcttccttctctcgatcacacctcttactggggtgatgcaagtggcttcaaggatttatttgactggaaacattttattgagacattgaaggatgatatccacgtagttgagacattaccacctgcctatgctgaaattgaacctttctcgaaaactccaatatcttggtctaaggccagttactacaagaatgaggttcttcccctgctaaagcagcataaagtgatctatttcacccataccaattccagacttgctaataatggaattccaagctccatacaaaagctaagatgtcgtgtaaattatagagcattgaaatattcagctccgattgaagaattcggaagcaaattaatatctagaatgcgacagaatgaaaatccttatctcgcgcttcatttgaggtatgagaaggatatgcttgcatttactggctgcagtcacaatttgacagcagaagaagatgaagagctacgacagatgcggtatgaagttggtcactggaaggagaaggagattaatgggactgagaggagattgactggaggttgtccattaactcctagggaaacttccctattgcttagagcactaggttttccatcacaaaccaggatttatctggtagctggagaagcatatggtagaggaagtatgaaatatcttgaggatgctttccccaacattttctctcacagttctttatcttctgaggaagagttgaatcctttcaagaatcaccagaacatgttagctggcatagactatattgttgcacttcagagtgatgtatttctctatacttatgatggaaatatggcaaaggcagtacaaggccataggcacttcgaaaacttcaagaagactatcaatccagacaaggtaaattttgttaaactcgttgataagttggatgaaggaaaaatttcttggaagaagttcagctccaaggtaaaaaggctgcatgaagatcgaatcggtgctccgtatcccagggagcggggagaatttcctaagctagaggaaagtttttatgcaaatcctctgccaggatgtatatgtgaaagaaaattagatacttcacag

SEQ ID NO: 11244 - DNA, 3984 bp, Artificial sequence
  miR resistant mutant
atggattctcgattagaaggaaaatttccatccaaagctgcattctgtataactcagctttctatgaaatgtcttgcatctgagcccaaacatcggccatcaatgaaggacgttttggagaatttggagcgaattcaagctgccaatgagaaacctgtggagcctaaattccgttctactcatgccgccaaccgtcaagatttgtacggggctaagcattctgaagaatactgcgcaatgtatgatatatgcggtcaaagcagtgatggcaaggctctcaattgcccatatggttccccttctgtcaagcctgatgacctactgtctgccaaaattcaaagtttgtgccccaccataactggaaatgtttgttgcactgcggatcagtttgacacactaagagtccaggttcaacaggctgtaccaattctagtgggctgtccagcatgcttgaggaattttctaaatcttttttgtgaactttcttgctctcctaatcagagtttattcatcaacgtgacttctatttctgaggttaatggtaatatgactgtggatggcattgattattacataactgaaacttttggagaaggtctatatgaatcatgtaaggatgtaaagtttgggacaatgaatacaagggccatagattttgttggggctggagctagcaattttaaagagtggtttgcatttcttggtcagaaagttcctcctggttttcctggttctccgtattctatactttttaagacaaccattcttgactcttctcctatgaaacttatgaatgcgtctgtatattcatgtaatgacacttcgctgggctgctcttgtggtgattgtccttcatcacctgtttgctcgggttcagaaccttctccacccagaaaagatccctgctccattagaattggatctctaaaggtcagatgtgtagatttttcaatggccattttgtacattgtattggttttcgtgttgtttgggtgggcattgctgcaaaggacaagaggaaggaggagacttggatctggtgtggaaccattattggatgatatggttgatgaagggagtagttttgctaacctccaaaaggatggaactcatcctgcagaggtgcaacagatagatcctcaagggcagaatgtggtgcaattttcttttgttcaagggtgcctgtccagcttttacaggacatatggaaggtgggccactagaaaacccacaattgttctttgttcctcattgacaattgttgttttgctttgtttgggtctgcttcgttttgaggtggagacccggcctgagaagttatgggttggtcctgggagtaaggcagctgaagagaaagagttttttgatagccaccttgctccattctacagaattgaacagctcataatagcgacaatccctgaatctaagcatggcaaaccgccaagtattataacagaagaaaatattgaattgcttttcgaaatacaggaaaaggttgatggaattcgtgcaaattattctggtttgttagtatcactgagtgacatttgcttgaagcctttaggcgacgactgtgcctctcaaagcattttgcagtattttcaaatggaccctgacaattatgacaactacggaggtgttgaacatgctgagtattgttttcagcattacacttctactgaaacatgctttagtgcattcaaggctccccttgagccaactactgccttgggagggttttctggaaataattattctgaggcttctgcatttgttatcacgtaccctgtcaataatgcaattacaaaagtcggagatgagaatgggaaggcaatagcttgggaaaaagcattcatccagttggctaaggaggaattgctgccaatggtgcaatctagcaatcttaccttgtcattttcaactgaaagttcaattgaggaagaactaaagagagaaagcactgcagatgtcataacaatacttgtgagctatattgtaatgtttgcttatatatcggtgaccttgggagatagaccacctcatccgtcttctttgttcctctcgtccaaggtattgcttggtcttttgggggttttgctagttatgctttctgtccttggatcagttggatttttcagtgctattggagtaaaatcgacactaatcataatggaagtcataccttttctggttttagctgttggtgttgataacatgtgtataatcgtagatgctgtgaaacggcaaccctcaggtttaccagtagaggaacaaataagcaatgcaatgggtgaagttggaccttcaataacactggccagcttatcagaaattctagcatttgctgtaggatcatttgtttctatgccagcatgtcgtgttttctccatgattgcagctttggcggttctactggacttccttctacaaattactgcttttgtagctttggttacattagactttatgagggccaaggataataggattgactgctttccgtgcatgaagttgaatccgccctctgcggagcgaaatgaaggcgttaggcgggaaagagatggattactgacacgatatatgaaggaggttcatgcaccatttcttggactatgtggagttaaaatcttggtcattgccgtatttgctgcatttaccttagcaagcattgcattatgcacaaggattgaacctggtcttgagcaacagattgctcttccacgggattcctaccttcagggttatttcagtaacatatccgagtaccttagagttggaccacccttatattttgttgtaaaggattacaactacagtttggaatccaaacacacaaaccagctatgctccattagccactgtgattcaaattctcttttaaatgagatatctagagcatcattagtgccaacatcaagctacatagccaaaccagctgcctcatggcttgatgattttcttgtatggatatcacctgaagcttttagttgctgtcgaaaattcacaaatgactcttattgtccacctgatgatcagccgccttgctgtttaccagatgaagggccatgtgggttgggtggagtgtgtaaagactgtacaacatgtttccgccactcggatttggttaatgatcgtccatctacggcacagttcagagagaagcttccctggtttcttgatgcactgccatcagctgattgtgccaagggtggtcatggagcttacaccaacagtgtagatctgaatggttatgagggtggtgtcatccaagcttctgagttccgtacttatcacacaccagttaatagacaaggtgactatgttaatgcaatacgagctgcaagggacttttcggcaagaatttcttcatctttaaagatggatatttttccgtacagcgtattctacatatttttcgaacaatacctggatatatggaagttagccctgatcaacatttccatagcactaggtgctatttttgttgtctgtctgatcatcacatccagtgtgtggagttcagtaatcatattacttgttctgatcatgataattttggatctcatgggcgtaatggcaattttgggtattcaactgaatgcggtgtctgttgtaaaccttattatgtcaataggaattgctgtggagttctgtgtgcatatagtacatgcttttacggtaagcttgggggataggagccaacgagcaaagacagcattgtgtaccatgggggcttccgtattcagtggaatcacacttacaaaattagtcggagtcctcgtcctttgcttctcaacatcacaaatttttgtggtgtattacttccaaatgtatctggccttggttctcattggcttcttacacggtcttgtgtttctacctgtggttttgagcttgtttggtcctccattaagatatacagtcattaaggagcagctagaagacatgccttctgcttcatcagaacagcctctaattaga

SEQ ID NO: 11245 - DNA, 3984 bp, Artificial sequence
  miR resistant mutant
atggattctcgattagaaggaaaatttccatccaaagctgcattctgtataactcagctttctatgaaatgtcttgcatctgagcccaaacatcggccatcaatgaaggacgttttggagaatttggagcgaattcaagctgccaatgagaaacctgtggagcctaaattccgttctactcatgccgccaaccgtcaagatttgtacggggctaagcattctgaagaatactgcgcaatgtatgatatatgcggtcaaagcagtgatggcaaggctctcaattgcccatatggttccccttctgtcaagcctgatgacctactgtctgccaaaattcaaagtttgtgccccaccataactggaaatgtttgttgcactgcggatcagtttgacacactaagagtccaggttcaacaggctgtaccaattctagtgggctgtccagcatgcttgaggaattttctaaatcttttttgtgaactttcttgctctcctaatcagagtttattcatcaacgtgacttctatttctgaggttaatggtaatatgactgtggatggcattgattattacataactgaaacttttggagaaggtctatatgaatcatgtaaggatgtaaagtttgggacaatgaatacaagggccatagattttgttggggctggagctagcaattttaaagagtggtttgcatttcttggtcagaaagttcctcctggttttcctggttctccgtattctatactttttaagacaaccattcttgactcttctcctatgaaacttatgaatgcgtctgtatattcatgtaatgacacttcgctgggctgctcttgtggtgattgtccttcatcacctgtttgctcgggttcagaaccttctccacccagaaaagatccctgctccattagaattggatctctaaaggtcagatgtgtagatttttcaatggccattttgtacattgtattggttttcgtgttgtttgggtgggcattgctgcaaaggacaagaggaaggaggagacttggatctggtgtggaaccattattggatgatatggttgatgaagggagtagttttgctaacctccaaaaggatggaactcatcctgcagaggtgcaacagatagatcctcaagggcagaatgtggtgcaattttcttttgttcaagggtgcctgtccagcttttacaggacatatggaaggtgggccactagaaaacccacaattgttctttgttcctcattgacaattgttgttttgctttgtttgggtctgcttcgttttgaggtggagacccggcctgagaagttatgggttggtcctgggagtaaggcagctgaagagaaagagttttttgatagccaccttgctccattctacagaattgaacagctcataatagcgacaatccctgaatctaagcatggcaaaccgccaagtattataacagaagaaaatattgaattgcttttcgaaatacaggaaaaggttgatggaattcgtgcaaattattctggtttgttagtatcactgagtgacatttgcttgaagcctttaggcgacgactgtgcctctcaaagcattttgcagtattttcaaatggaccctgacaattatgacaactacggaggtgttgaacatgctgagtattgttttcagcattacacttctactgaaacatgctttagtgcattcaaggctccccttgagccaactactgccttgggagggttttctggaaataattattctgaggcttctgcatttgttatcacgtaccctgtcaataatgcaattacaaaagtcggagatgagaatgggaaggcaatagcttgggaaaaagcattcatccagttggctaaggaggaattgctgccaatggtgcaatctagcaatcttaccttgtcattttcaactgaaagttcaattgaggaagaactaaagagagaaagcactgcagatgtcataacaatacttgtgagctatattgtaatgtttgcttatatatcggtgaccttgggagatagaccacctcatccgtcttctttgttcctctcgtccaaggtattgcttggtcttttgggggttttgctagttatgctttctgtccttggatcagttggatttttcagtgctattggagtaaaatcgacactaatcataatggaagtcataccttttctggttttagctgttggtgttgataacatgtgtataatcgtagatgctgtgaaacggcaaccctcaggtttaccagtagaggaacaaataagcaatgcaatgggtgaagttggaccttcaataacactggccagcttatcagaaattctagcatttgctgtaggatcatttgtttctatgccagcatgtcgtgttttctccatgattgcagctttggcggttctactggacttccttctacaaattactgcttttgtagctttggttacattagactttatgagggccaaggataataggattgactgctttccgtgcatgaagttgaatccgccctctgcggagcgaaatgaaggcgttaggcgggaaagagatggattactgacacgatatatgaaggaggttcatgcaccatttcttggactatgtggagttaaaatcttggtcattgccgtatttgctgcatttaccttagcaagcattgcattatgcacaaggattgaacctggtcttgagcaacagattgctcttccacgggattcctaccttcagggttatttcagtaacatatccgagtaccttagagttggaccacccttatattttgttgtaaaggattacaactacagtttggaatccaaacacacaaaccagctatgctccattagccactgtgattcaaattctcttttaaatgagatatctagagcatcattagtgccaacatcaagctacatagccaaaccagctgcctcatggcttgatgattttcttgtatggatatcacctgaagcttttagttgctgtcgaaaattcacaaatgactcttattgtccacctgatgatcagccgccttgctgtttaccagatgaagggccatgtgggttgggtggagtgtgtaaagactgtacaacatgtttccgccactcggatttggttaatgatcgtccatctacggcacagttcagagagaagcttccctggtttcttgatgcactgccatcagctgattgtgccaagggtggtcatggagcttacaccaacagtgtagatctgaatggttatgagggtggtgtcatccaagcttctgagttccgtacttatcacacaccagttaatagacaaggtgactatgttaatgcaatacgagctgcaagggacttttcggcaagaatttcttcatctttaaagatggatatttttccgtactcagtattctacatatttttcgaacaatacctggatatatggaagttagccctgatcaacatttccatagcactaggtgctatttttgttgtctgtctgatcatcacatccagtgtgtggagttcagtaatcatattacttgttctgatcatgataattttggatctcatgggcgtaatggcaattttgggtattcaactgaatgcggtgtctgttgtaaaccttattatgtcaataggaattgctgtggagttctgtgtgcatatagtacatgcttttacggtaagcttgggggataggagccaacgagcaaagacagcattgtgtaccatgggggcttccgtattcagtggaatcacacttacaaaattagtcggagtcctcgtcctttgcttctcaacatcacaaatttttgtggtgtattacttccaaatgtatctggccttggttctcattggcttcttacacggtcttgtgtttctacctgtggttttgagcttgtttggtcctccattaagatatacagtcattaaggagcagctagaagacatgccttctgcttcatcagaacagcctctaattaga

SEQ ID NO: 11246 - DNA, 1191 bp, Artificial sequence
  miR resistant mutant
atggaagaacccgtgaaggaacagcccctctctgctgggaactctgcgcgacccaagcttcagagatacgcgcttcgttcgtcctctaaatccaaggaaaacaagcaagacaccgcacccgatctctccatttcttctgaatctaagagggggttaagtactccacacgtaagcagaagtgtaggtggtcttgatttctctggcaacaaggataagtctactagtgctaaaccaccaagaaggctctccaatcctgtgaaagcagcatctccaacacccaatccaaaactagttggcaacattaccccaatctcagagagcagaacaatgaggtctggtaaaggtcaagtgtctcaaagcagaagccagacaccggcctctgacatttccagaacatcgagcagaatgaagttcaatctcttatcttcctcttcatattggctaaaccagatcaagctctctgagtctgctgataagcacacagtttcacttggattcttcaaacttgcctcggaggcaagatgtgagccgttccagaagatgaaagatgagctaaagtcttatgtgcaacgacatcagcttgctgaacttggagaagtgaaagagctgcttcaaacctatgacattgctgaaaatatagagcagccacaagtgtctgagagcatttcacaggtgccagaagagggaactcgatcctctgatgatgaagaagttcactgcagttctgcatccaccatggagactgtaaaactgaaacccgaacccttggacactgaatccactgaacctgctcctgttataatagagtcaaccaagaaggaaactagccaaaagaaaaatcccttggacactgaatcaactcaacctactcctgttaaaatagagtcaatcaagaaggaaagtagccaaaagaataaccctggatccaggttgagagaaaatctcaagaagaactctgcaaattcaagacctgcttctgacaatgggagttctaggttgtttaaaaaaccagaaaaaccaactaagcaactaaccaataagggaaaaagcgaggtcaagaaagaaggaaagaaatctgatgttattaaagctccaatcagccctacgcatgctgaaaataataatgcacagggaaacaaagaaaatatggatgttcagaccactgatgagatgagtttgacagaaatcgcg

SEQ ID NO: 11247 - DNA, 1191 bp, Artificial sequence
  miR resistant mutant
atggaagaacccgtgaaggaacagcccctctctgctgggaactctgcgcgacccaagcttcagagatacgcgcttcgttcgtcctctaaatccaaggaaaacaagcaagacaccgcacccgatctctccatttcttctgaatctaagagggggttaagtactccacacgtaagcagaagtgtaggtggtcttgatttctctggcaacaaggataagtctactagtgctaaaccaccaagaaggctctccaatcctgtgaaagcagcatctccaactcccaatccaaaactagttggcaacattaccccaatctcagagagcagaacaatgaggtctggtaaaggtcaagtgtctcaaagcagaagccagacaccggcctctgacatttccagaacatcgagcagaatgaagttcaatctcttatcttcctcttcatattggctaaaccagatcaagctctctgagtctgctgataagcacacagtttcacttggattcttcaaacttgcctcggaggcaagatgtgagccgttccagaagatgaaagatgagctaaagtcttatgtgcaacgacatcagcttgctgaacttggagaagtgaaagagctgcttcaaacctatgacattgctgaaaatatagagcagccacaagtgtctgagagcatttcacaggtgccagaagagggaactcgatcctctgatgatgaagaagttcactgcagttctgcatccaccatggagactgtaaaactgaaacccgaacccttggacactgaatccactgaacctgctcctgttataatagagtcaaccaagaaggaaactagccaaaagaaaaatcccttggacactgaatcaactcaacctactcctgttaaaatagagtcaatcaagaaggaaagtagccaaaagaataaccctggatccaggttgagagaaaatctcaagaagaactctgcaaattcaagacctgcttctgacaatgggagttctaggttgtttaaaaaaccagaaaaaccaactaagcaactaaccaataagggaaaaagcgaggtcaagaaagaaggaaagaaatctgatgttattaaagctccaatcagccctacgcatgctgaaaataataatgcacagggaaacaaagaaaatatggatgttcagaccactgatgagatgagtttgacagaaatcgcg

SEQ ID NO: 11248 - DNA, 1809 bp, Artificial sequence
  miR resistant mutant
atgggcacttctccgagccgcgagggcctcgaagtcaccgactcagattccgactacgaacacgaagaagaagaaacagagcactacgaacacgccaaaacccactccaccgagctcgatgacttggatgcgaaactcaaagccttaaaactcaaataccaaacgccctcttcctcctcctcaaaatcacttccccaaaacgctgttaagctctacctccacatcggcgccacaacaccaaatgcaaaatggatcctctccgacaaacgcacctcctacgcctttctcaaagactcagacgacgaaaacgacgccgtttggttcctcactgtaggttccaaggtccgcgctagggtttcctccgaaatgcaattgaagatgttcggcgaccagcgccgcgttgatttcgtagccgacggcgtctgggccctcaaattcccctccgacgacacctaccgccgattcgtcactgaatttcaaaactgcgtcttcgagaacgtgtatggaatcgaatgcacggaagaaaacaaggtcaaaatcttcggtaaagagttcatcggctgggtgaagccggaagccgccgacgattccgtctgggaggacgccttcgccgcagatccgtcgccttcgcggcggagagacgacctaatggaggaattcgaagaggccgcgaacggtggggtccaaaccctaaccctaggcgcgttggataatagtttcatggtgaacgacgccggcgtccacgtgtaccgcaacttcaaccgcgggatccacggcaagggcgtcgccgtgaagttcgccggcggtgacgccacgccgaacaaggctttgttgatgcgtgcggaaacgaacatgatgctgatgagtcccttaaaagacggaaagccccacgcttcgaagcttcaccagctcgacattgaaacggggaagattgttacggagtggaagtttggaaaagacggagttgacttaacaatgagggatatcaccaatgacaccaaagggtcgcagttggacccttcggagtcaacgtttttggggctggatgataaccggttgtgtcaatgggacatgagggatagaaagggaattgttcagaacattgccacggcgagttcttcgcctgttttgcattggagccagggacatcagttttccgcagggtctaactttcagtcctttgcgaccaccggtgatgggtccattgtcgtggggtctcttgatgggaagataaggttgtactcgaagacctcgatgaggatggcgaagacggcgtttcccggtctctgttcgccgattactagtgttgatgttacctatgatggcaagtgggtgcttggtaccacggatacttacttggtgctcatttgcaccttgtttacggataaagatgggatgacgaagaccgggtttagtgggagaatggggaacaggatacctgctccgaggctcttgaagctgactcctctggattcgcatttggctggtgcgaacaataagtttcacagtggccatttttcgtgggtcactgagaatggtaaacaagaacgccacctcgttgcgactgtgggcaagtttagtgtgatatgggattttcagcgggtgaagaacagtgcacatgaatgttacaggaatcaagaagggctgaagagctgttactgttataagatagtgttgaaggatgagtcaattgtagaatcacggtttatgcacgacaaatttgcggttagtgattctccagaagctccgttggtggtggctactcctatgaaagtcagctccatcagcctgtctggaaagcgacatggt

SEQ ID NO: 11249 - DNA, 1809 bp, Artificial sequence
  miR resistant mutant
atgggcacttctccgagccgcgagggcctcgaagtcaccgactcagattccgactacgaacacgaagaagaagaaacagagcactacgaacacgccaaaacccactccaccgagctcgatgacttggatgcgaaactcaaagccttaaaactcaaataccaaacgccctcttcctcctcctcaaaatcacttccccaaaacgctgttaagctctacctccacatcggcgccaccaccccaaatgcaaaatggatcctctccgacaaacgcacctcctacgcctttctcaaagactcagacgacgaaaacgacgccgtttggttcctcactgtaggttccaaggtccgcgctagggtttcctccgaaatgcaattgaagatgttcggcgaccagcgccgcgttgatttcgtagccgacggcgtctgggccctcaaattcccctccgacgacacctaccgccgattcgtcactgaatttcaaaactgcgtcttcgagaacgtgtatggaatcgaatgcacggaagaaaacaaggtcaaaatcttcggtaaagagttcatcggctgggtgaagccggaagccgccgacgattccgtctgggaggacgccttcgccgcagatccgtcgccttcgcggcggagagacgacctaatggaggaattcgaagaggccgcgaacggtggggtccaaaccctaaccctaggcgcgttggataatagtttcatggtgaacgacgccggcgtccacgtgtaccgcaacttcaaccgcgggatccacggcaagggcgtcgccgtgaagttcgccggcggtgacgccacgccgaacaaggctttgttgatgcgtgcggaaacgaacatgatgctgatgagtcccttaaaagacggaaagccccacgcttcgaagcttcaccagctcgacattgaaacggggaagattgttacggagtggaagtttggaaaagacggagttgacttaacaatgagggatatcaccaatgacaccaaagggtcgcagttggacccttcggagtcaacgtttttggggctggatgataaccggttgtgtcaatgggacatgagggatagaaagggaattgttcagaacattgccacggcgagttcttcgcctgttttgcattggagccagggacatcagttttccgcagggtctaactttcagtcctttgcgaccaccggtgatgggtccattgtcgtggggtctcttgatgggaagataaggttgtactcgaagacctcgatgaggatggcgaagacggcgtttcccggtctctgttcgccgattactagtgttgatgttacctatgatggcaagtgggtgcttggtaccacggatacttacttggtgctcatttgcaccttgtttacggataaagatgggatgacgaagaccgggtttagtgggagaatggggaacaggatacctgctccgaggctcttgaagctgactcctctggattcgcatttggctggtgcgaacaataagtttcacagtggccatttttcgtgggtcactgagaatggtaaacaagaacgccacctcgttgcgactgtgggcaagtttagtgtgatatgggattttcagcgggtgaagaacagtgcacatgaatgttacaggaatcaagaagggctgaagagctgttactgttataagatagtgttgaaggatgagtcaattgtagaatcacggtttatgcacgacaaatttgcggttagtgattctccagaagctccgttggtggtggctactcctatgaaagtcagctccatcagcctgtctggaaagcgacatggt

SEQ ID NO: 11250 - DNA, 801 bp, Artificial sequence
  miR resistant mutant
atgaatcgcaaccacgatcccaatcctttcgaagaagaagaagtcaatccattttcgaatggtactggatcaaaatcacgtgttccctcagtggcttctgaaccactaggctttggtcaaagacatgatgctactgttgatattcctttggagacttcaaatggggactccaagaaaaaaagtcaagagctagcagtgtgggaagctgatttgaaaaggagagagaaggatataaaaagaagggaagattctgttgctaaagctggtgtgcctgttgatgataagaattggcctcccttctttcccataatacatcacgacattgccaatgagattccagttcatgctcagagattgcaatattcagcctttgctagttggttgggaatcgttctctgcttagtttttaatgtagttgcagtgattgtctgttggatcagaggcgggggtgttaaaatatttttccttgcagtgatttatgcgctgcttgggattcccctttcatatgtgctttggtacaggcccctctatcgtgctatgaggactgatagtgcactgaagttcagttggtttttcatgttctacttgcttcatatagcattttgcatctttgctgcaattgcacctccagttgtttttcatggaaagtcattaacgggcatccttgcagcgattgatgtgttctcagaccatgtattggttgggatattctatttgattggatttggtctgttttgcttggaggctcttctaagcttgtgggtaattcagagaatatacatgtttttccgggggcacaag

SEQ ID NO: 11251 - DNA, 801 bp, Artificial sequence
  miR resistant mutant
atgaatcgcaaccacgatcccaatcctttcgaagaagaagaagtcaatccattttcgaatggtactggatcaaaatcacgtgttccctcagtggcttctgaaccactaggctttggtcaaagacatgatgctactgttgatattcctttggagacttcaaatggggactccaagaaaaaaagtcaagagctagcagtgtgggaagctgatttgaaaaggagagagaaggatataaaaagaagggaagattctgttgctaaagctggtgtgcctgttgatgataagaattggcctccattctttccaataatacatcacgacattgccaatgagattccagttcatgctcagagattgcaatattcagcctttgctagttggttgggaatcgttctctgcttagtttttaatgtagttgcagtgattgtctgttggatcagaggcgggggtgttaaaatatttttccttgcagtgatttatgcgctgcttgggattcccctttcatatgtgctttggtacaggcccctctatcgtgctatgaggactgatagtgcactgaagttcagttggtttttcatgttctacttgcttcatatagcattttgcatctttgctgcaattgcacctccagttgtttttcatggaaagtcattaacgggcatccttgcagcgattgatgtgttctcagaccatgtattggttgggatattctatttgattggatttggtctgttttgcttggaggctcttctaagcttgtgggtaattcagagaatatacatgtttttccgggggcacaag

SEQ ID NO: 11252 - DNA, 801 bp, Artificial sequence; identical to SEQ ID NO: 11251
  miR resistant mutant

SEQ ID NO: 11253 - DNA, 801 bp, Artificial sequence; identical to SEQ ID NO: 11251
  miR resistant mutant

SEQ ID NO: 11254 - DNA, 666 bp, Artificial sequence
  miR resistant mutant
atggcgcacgatacatcatctgattctgaaaatgaaattattggagcacgggcaaagctctttggacatgaaaaaccgattcatgaagttcttggaggaggaaaagtggcagatatgttattatggagggacagatatgtatcaggtgcgcttttgggtgggatgactgtgatatggtttctatttgagatcgttgagtacaatttcgtggcactcctttgtcacatttccatcaccaccatgcttgttctattcatatggtccacggttgcagatatatttaaatggaaaggtccccagatcccaaacattgttttacaggaatctttcttccatgatcttgcttccatcctccacaaaagatttaaccagttattaccaatgctcctccacatttcatgtggaatagacctgccaatctttcttctgaacattgtaagcttatacatattaagcgtaattggaagctacttcagttttgtcaatctgctatatattgggtttctctgcatgcaaacgctgccaattgtgtatgaacggtatgaggaagaaatcaacaattgggtcagcgatatcataatagttataaggaaaaactataggaggtttaacaagaactacctcaacaaaattcccagaggaccagtgaaggcaaagaaaacccaa

SEQ ID NO: 11255 - DNA, 666 bp, Artificial sequence
  miR resistant mutant
atggcgcacgatacatcatctgattctgaaaatgaaattattggagcacgggcaaagctctttggacatgaaaaaccgattcatgaagttcttggaggaggaaaagtggcagatatgttattatggagggacagatatgtatcaggtgcgcttttgggtgggatgactgtgatatggtttctatttgagatcgttgagtacaatttcgtggcactcctttgtcacatttccatcaccaccatgcttgttctattcatatggtccacggttgcagatatatttaaatggaaaggtccccagatcccaaacattgttttacaggaatctttcttccatgatcttgcttccatcctccacaaaagatttaaccagttattaccaatgctcctccacatttcatgtggaatagacctgccaatctttcttctgaacattgttagcttatacatattaagcgttattggaagctacttcagttttgtcaatctgctatatattgggtttctctgcatgcaaacgctgccaattgtgtatgaacggtatgaggaagaaatcaacaattgggtcagcgatatcataatagttataaggaaaaactataggaggtttaacaagaactacctcaacaaaattcccagaggaccagtgaaggcaaagaaaacccaa

SEQ ID NO: 11256 - DNA, 666 bp, Artificial sequence; identical to SEQ ID NO: 11255
  miR resistant mutant

SEQ ID NO: 11257 - DNA, 666 bp, Artificial sequence; identical to SEQ ID NO: 11255
  miR resistant mutant

SEQ ID NO: 11258 - DNA, 1737 bp, Artificial sequence
  miR resistant mutant
atggattccccccactttccttcatttgcatctctcagagttcttctgtttggtttctgcgttataactttgtttcctgagtttgtagtgagcataacaaggcactacacatttaatgtggagtacctgaacgtcactagattgtgccacacaaggaacattctgagtgtgaatgggaaattcccaggacctcgcttggtggcaagggaaggtgatagggttgtggttaaggtggttaaccatgtctcaaacaatgtatccattcattggcatggcatccgtcagataacaactgggtgggctgatggaccagcatatgtgacacagtgccccatacaaaccaaccagtcatacacatacaacttcaccatagttgggcagagagggactctgctttggcatgctcacatatcatggctgagagcaaccatctatggacccatcatcatcctccccaagcacaatgagtcttttccattcgagaagccacacaaagaaatccccatactttttggggaatggtttaatgttgacccagaagcagtcataagtcaagccttgcagacaggagggggacccaatgtttcagatgcatacaccatcaatggacttcccgggcctttgtataattgttcttctaaagatacatacacattaaaggtgaagccaggcaagacatatctgctacgcttgataaacgcagccttaaatgaagagcttttcttcagcatagccaaccacaccctaactgtggttgaagcagatgccagatacaccaaaccatttgacacagacacactcctcatagcccctggccaaaccacaaacgtgcttctcaaaaccaagccatattttcccaatgccacattccaaatgtctgctaggccttatttcacaggccgtggcacctttgacaactccacaactgcaggtaccctaatctacaagcaacccttgaaaaattccagtgtaaaaaatctcacccttctcaaaccaactttgccaccaataaatgccacaagctttgtggcaaacttcacagcaaaattcagaagcttggctagtgccaaattccctgccaaggtacctcaaaaagtggacagaaaatttttcttcactgtggggctagggactagtccttgccccaaaaacacaacatgccaagggccaagtaataacaccaagttcgcagcctcggttaacaacatttcttttgcacttccatcatctgtttccatcatgcaggcctactattcaggccaggccaatggggttttcaagactgattttcctgccacccctttgaaccctttcaattacaccggaacgcctccgaacaacacaatggtcaccaatgacacaaagctggtggtgctcaaattcaacaccagtgtggaggtggtgctgcaggatactagtattcttggtgctgagagtcaccctttgcatcttcatggctacgacttctttattgttgggcaagggtttggaaactatgaccccaacaatgaccctgcaaagtttaacctgattgaccctgttgagaggaacactgttggtgttcctgctggtggctggattgcttttagattccttgcagacaacccaggggtgtggttcatgcactgtcacttggacctccacacaagttggggattgagaatggcatggctagtactagatgggcctgggcccaagcagaagcttcaaccacccccttctgatcttccaaaatgc

SEQ ID NO: 11259 - DNA, 1737 bp, Artificial sequence
  miR resistant mutant
atggattccccccactttccttcatttgcatctctcagagttcttctgtttggtttctgcgttataactttgtttcctgagtttgtagtgagcataacaaggcactacacatttaatgtggagtacctgaacgtcactagattgtgccacacaaggaacattctgagtgtgaatgggaaattcccaggacctcgcttggtggcaagggaaggtgatagggttgtggttaaggtggttaaccatgtctcaaacaatgtatccattcattggcatggcatccgtcagataacaactgggtgggctgatggaccagcatatgtgacacagtgccccatacaaaccaaccagtcatacacatacaacttcaccatagttgggcagagagggactctgctttggcatgctcacatatcatggctgagagcaaccatctatggacccatcatcatcctccccaagcacaatgagtcttttccattcgagaagccacacaaagaaatccccatactttttggggaatggtttaatgttgacccagaagcagtcataagtcaagccttgcagacaggagggggacccaatgtttcagatgcatacaccatcaatggacttcccgggcctttgtataattgttcttctaaagatacatacacattaaaggtgaagccaggcaagacatatctgctacgcctaataaacgcagccttaaatgaagagcttttcttcagcatagccaaccacaccctaactgtggttgaagcagatgccagatacaccaaaccatttgacacagacacactcctcatagcccctggccaaaccacaaacgtgcttctcaaaaccaagccatattttcccaatgccacattccaaatgtctgctaggccttatttcacaggccgtggcacctttgacaactccacaactgcaggtaccctaatctacaagcaacccttgaaaaattccagtgtaaaaaatctcacccttctcaaaccaactttgccaccaataaatgccacaagctttgtggcaaacttcacagcaaaattcagaagcttggctagtgccaaattccctgccaaggtacctcaaaaagtggacagaaaatttttcttcactgtggggctagggactagtccttgccccaaaaacacaacatgccaagggccaagtaataacaccaagttcgcagcctcggttaacaacatttcttttgcacttccatcatctgtttccatcatgcaggcctactattcaggccaggccaatggggttttcaagactgattttcctgccacccctttgaaccctttcaattacaccggaacgcctccgaacaacacaatggtcaccaatgacacaaagctggtggtgctcaaattcaacaccagtgtggaggtggtgctgcaggatactagtattcttggtgctgagagtcaccctttgcatcttcatggctacgacttctttattgttgggcaagggtttggaaactatgaccccaacaatgaccctgcaaagtttaacctgattgaccctgttgagaggaacactgttggtgttcctgctggtggctggattgcttttagattccttgcagacaacccaggggtgtggttcatgcactgtcacttggacctccacacaagttggggattgagaatggcatggctagtactagatgggcctgggcccaagcagaagcttcaaccacccccttctgatcttccaaaatgc

SEQ ID NO: 11260 - DNA, 1845 bp, Artificial sequence
  miR resistant mutant
atgcaattaaagatatttctctatttaaggttatttttgtgttctatgctaaaagctaaactaccaaacatcaatgtctcagtaaaaggggaaatgggtattgcttatctcaacatgccaggcttcatgagggcaatgtttattatgttatgtgctatgatgatattgccagaactaacacatgcaaagcatgcaagagtaactaggcactacaagtttaatatcaaaatgcaaaacttcacaaggctttgccaaacaaagagcattgtaactgtcaatggacgatttcctggtcctagaatcatagcaagagaaggagacagaattgtggttaaagtcgttaaccacgttcaatacaatgtcacccttcattggcatggaattcgccaactaaaaagtgcatgggcagatggaccagcctatatcacacagtgtccaattcagacaggtcaaagttttgtgtacaacttcacagtcattggccaaagaggaacattgtggtggcatgcacatatctcatggcttagaacaactctctatggtcccattgtcattcttcccaaaagacatgtcccttacccattccctcaacctttcagagaagtccccatcatattgggggagtggtggaaagcagacacagaagcagttataaaccaagcaatgcaaacaggattggcaccaaatatctcagatgttcacaccatcaatggtcttccaggtcctgtctccaactgcgcagccaaagaaacattccagctcaaggtgaagcctggaaaaacatatctgcttagattaataaatgcagccttaaacgatgagatgttcttcagcatagccaaccacacccttaccatggttgaagctgatgcagtgtatgtaaagcccttcagcacaaagattgttctgatcacacctggtcaaaccgtcaacgtccttctcaaggccaaatccaaggctccaaatggcacatttgccatatccacaaggccctatgctacaggtccagcttcttttgataacaccacagccacagggttccttgagtacaagaaaacttcacatgcaagcaacaagtcaaacaccaagaagcttcctcttcttagagcagtgttccctaaattcaatgacactgtctttgcaatgaacttccacaacaaggttcgtagcttggccaatgcaagattcccagcaaaagttccaaaaaccgtagacaggcacttcttcttcactgttggcttaggaatcagcaaatgctcaaaaaatcaacaatgccaagggcctaacaacacaagggtagctgctgctgttaacaatgtgacatttgtgacaccaaacattgctttactccaagcacattttttcaacaagtccaaaggagtgtacaccacagatttcccttccaaccctcctttcaagttcaactacactggcactccaccaagcaacatctttgtgagtagtggcactaagacagtggtgttgccatacaacaccagtgtggagttggtacttcaagacacaagcattattggagctgagagtcaccctcttcaccttcatggcttcaacttcttcattgttggccaaggaaatgggaactttgaccccaaaaaggaccccataaagttcaaccttgttgaccctgctgaaaggaacactgctggtgtgccatctggagggtgggttgctgttcgctttcttgctgataatccaggtgtttggttcatgcattgccaccttgaagtgcatactagttggggcttgaaaatggcatggatagtccaagatggtaaacggcgcaatcagaagctgccacctccaccttctgatcttccaaaatgt

SEQ ID NO: 11261 - DNA, 1845 bp, Artificial sequence
  miR resistant mutant
atgcaattaaagatatttctctatttaaggttatttttgtgttctatgctaaaagctaaactaccaaacatcaatgtctcagtaaaaggggaaatgggtattgcttatctcaacatgccaggcttcatgagggcaatgtttattatgttatgtgctatgatgatattgccagaactaacacatgcaaagcatgcaagagtaactaggcactacaagtttaatatcaaaatgcaaaacttcacaaggctttgccaaacaaagagcattgtaactgtcaatggacgatttcctggtcctagaatcatagcaagagaaggagacagaattgtggttaaagtcgttaaccacgttcaatacaatgtcacccttcattggcatggaattcgccaactaaaaagtgcatgggcagatggaccagcctatatcacacagtgtccaattcagacaggtcaaagttttgtgtacaacttcacagtcattggccaaagaggaacattgtggtggcatgcacatatctcatggcttagaacaactctctatggtcccattgtcattcttcccaaaagacatgtcccttacccattccctcaacctttcagagaagtccccatcatattgggggagtggtggaaagcagacacagaagcagttataaaccaagcaatgcaaacaggattggcaccaaatatctcagatgttcacaccatcaatggtcttccaggtcctgtctccaactgcgcagccaaagaaacattccagctcaaggtgaagcctggaaaaacatatctgcttcgtttaataaatgcagccttaaacgatgagatgttcttcagcatagccaaccacacccttaccatggttgaagctgatgcagtgtatgtaaagcccttcagcacaaagattgttctgatcacacctggtcaaaccgtcaacgtccttctcaaggccaaatccaaggctccaaatggcacatttgccatatccacaaggccctatgctacaggtccagcttcttttgataacaccacagccacagggttccttgagtacaagaaaacttcacatgcaagcaacaagtcaaacaccaagaagcttcctcttcttagagcagtgttccctaaattcaatgacactgtctttgcaatgaacttccacaacaaggttcgtagcttggccaatgcaagattcccagcaaaagttccaaaaaccgtagacaggcacttcttcttcactgttggcttaggaatcagcaaatgctcaaaaaatcaacaatgccaagggcctaacaacacaagggtagctgctgctgttaacaatgtgacatttgtgacaccaaacattgctttactccaagcacattttttcaacaagtccaaaggagtgtacaccacagatttcccttccaaccctcctttcaagttcaactacactggcactccaccaagcaacatctttgtgagtagtggcactaagacagtggtgttgccatacaacaccagtgtggagttggtacttcaagacacaagcattattggagctgagagtcaccctcttcaccttcatggcttcaacttcttcattgttggccaaggaaatgggaactttgaccccaaaaaggaccccataaagttcaaccttgttgaccctgctgaaaggaacactgctggtgtgccatctggagggtgggttgctgttcgctttcttgctgataatccaggtgtttggttcatgcattgccaccttgaagtgcatactagttggggcttgaaaatggcatggatagtccaagatggtaaacggcgcaatcagaagctgccacctccaccttctgatcttccaaaatgt

SEQ ID NO: 11262 - DNA, 1728 bp, Artificial sequence
  miR resistant mutant
atggatttcccccactttccttcatttgcatctctcagagttcttctgttttgtttctgcgttatgacattgtttcctgagtttgtagtgagcataacaaggcactacacctttaacgtcgagtacctgaacgtcactagattgtgccacacaaggaatattctgagtgtgaatggaaaattcccaggacctcgcttggtggcaagggaaggcgatagggttgtggttaaggtggtcaaccatgtctcaaacaatgtaaccattcattggcatggcatccgtcaaatgacaactgggtgggctgatggaccagcatatgtgacacagtgtcctatacaaaccaaccagtcatacacatacaacttcaccatcgttgggcagagagggactctgctttggcatgctcacatatcatggctaagagcaaccatttatggacccatcatcatcctccccaagcagaacgagtcttatccattcgagaagccacacaaagaaatccccattctttttggggaatggtttaatgttgacccagaagctgttataagtcaagccttgcagacaggagggggacccaatgtttcagatgcatacaccattaatggacttcccgggcctttgtataattgttcttctaaagatacatacacactaaaggtgaagccaggcaagacatatctgctacgcttgataaacgcagccttaaatgaagagcttttcttcagcatagctaaccacaccctaactgtggttgaagcggatgccaaatacaccaaaccatttgacacagacacactcctcatagcccctggccaaaccacaaacgtgtttctcaaaaccaagccatattttcccaatgccacattccaaatggctgctaggccttatttcacaggccgtggcacctttgacaactccacaaccgcaggtaccctcatctacaagcaacattccaatgtcaaaaatctcacccttctcaaaccaactttgccaccaataaacgccacaagctttgtggcaaacttcactgcaaaattcagaagcttggcaagtgctaaattccctgtcaaggtacctcaaaaagtggacagaaaatttttcttcactgtggggctagggactaatccttgccccaaaaacacaacatgccaagggccaagtaataacaccaaatttgcagcctcagtgaacaacatttcttttgcacttccatcatctgtttccatcatgcaggcatactattctagccaggccaatggggttttcaagactgattttcctgccacccctttgaaccctttcaactacacaggaacacctccaaacaacacaatggtcaccaatgacacaaagctggtggtgctcaagtttaacaccagtgtggagttggtgctgcaggacactagtattcttggggctgagagccatcccttgcatcttcatggttatgacttctttgttgtggggcaagggtttggaaactatgatcccaacaatgaccctgcaaggtttaatctgattgaccctgttgagaggaacactgctggtgttcctgctggtggttggattgctattcgattctttgcagacaacccaggggtgtggttcatgcactgtcacttggacctccacacaagttggggattgagaatggcatggctagtactagatggacctgagcccaaccagaagcttcaaccacccccttctgatcttccaaaatgt

SEQ ID NO: 11263 - DNA, 1728 bp, Artificial sequence
  miR resistant mutant
atggatttcccccactttccttcatttgcatctctcagagttcttctgttttgtttctgcgttatgacattgtttcctgagtttgtagtgagcataacaaggcactacacctttaacgtcgagtacctgaacgtcactagattgtgccacacaaggaatattctgagtgtgaatggaaaattcccaggacctcgcttggtggcaagggaaggcgatagggttgtggttaaggtggtcaaccatgtctcaaacaatgtaaccattcattggcatggcatccgtcaaatgacaactgggtgggctgatggaccagcatatgtgacacagtgtcctatacaaaccaaccagtcatacacatacaacttcaccatcgttgggcagagagggactctgctttggcatgctcacatatcatggctaagagcaaccatttatggacccatcatcatcctccccaagcagaacgagtcttatccattcgagaagccacacaaagaaatccccattctttttggggaatggtttaatgttgacccagaagctgttataagtcaagccttgcagacaggagggggacccaatgtttcagatgcatacaccattaatggacttcccgggcctttgtataattgttcttctaaagatacatacacactaaaggtgaagccaggcaagacatatctgctacgcctaataaacgcagccttaaatgaagagcttttcttcagcatagctaaccacaccctaactgtggttgaagcggatgccaaatacaccaaaccatttgacacagacacactcctcatagcccctggccaaaccacaaacgtgtttctcaaaaccaagccatattttcccaatgccacattccaaatggctgctaggccttatttcacaggccgtggcacctttgacaactccacaaccgcaggtaccctcatctacaagcaacattccaatgtcaaaaatctcacccttctcaaaccaactttgccaccaataaacgccacaagctttgtggcaaacttcactgcaaaattcagaagcttggcaagtgctaaattccctgtcaaggtacctcaaaaagtggacagaaaatttttcttcactgtggggctagggactaatccttgccccaaaaacacaacatgccaagggccaagtaataacaccaaatttgcagcctcagtgaacaacatttcttttgcacttccatcatctgtttccatcatgcaggcatactattctagccaggccaatggggttttcaagactgattttcctgccacccctttgaaccctttcaactacacaggaacacctccaaacaacacaatggtcaccaatgacacaaagctggtggtgctcaagtttaacaccagtgtggagttggtgctgcaggacactagtattcttggggctgagagccatcccttgcatcttcatggttatgacttctttgttgtggggcaagggtttggaaactatgatcccaacaatgaccctgcaaggtttaatctgattgaccctgttgagaggaacactgctggtgttcctgctggtggttggattgctattcgattctttgcagacaacccaggggtgtggttcatgcactgtcacttggacctccacacaagttggggattgagaatggcatggctagtactagatggacctgagcccaaccagaagcttcaaccacccccttctgatcttccaaaatgt

SEQ ID NO: 11264 - DNA, 1506 bp, Artificial sequence
  miR resistant mutant
atggaaaagatgttagggagaaattgtgggaagttgaagaccaagattgtgtgcactttgggaccatcaagtaggtcagtggagatgctggagaagcttctgaaggcagggatgaacgtggctcgcttcaacttctctcatggcactcactcttaccaccaagagacccttgataatctcagaactgcaatgaacaacaccggcattctctgtgctgtcatgttggacaccaagggtccagagatcagaactgggtttttgaatgaagggaagccaatacaaatccataggggacaagaaatcacaatcacaactgattacagcataaagggtgatgagaacatgatcagcatgagctacaagaagttggcacaccatttgagtccagggagtaatattctgtgtgctgatgggacaattagtttcactgtgctagaatgtgacaaagagaatggcttggttcgatgtcattgcgaaaattctgcagttctgggggagaggaagaatgttaaccttcctggagtggttgttgatcttccaatcttgacagagaaggacaaggaggacattttggagtggggggttcctaataagattgatatcattgctctctcttttgttagaaaaggttcagaccttgtggaggtcagaaatctacttggaaagcatgcaaaaagcatacttctcatgtccaaggttgaaaatcaagagggtgttgcaaattttgatgaaatactggaaaattcagatgcattcatggtggcaagaggtgacctgggaatggaaattccaattgagaagatctttctagctcagaaagttatgatacacaagtcaaacattaaaggcaagcctgtggtgacagccacccagatgttagagtccatgatcaaatctcctcggcctacacgagccgaggccaccgatgttgccaatgcagtccttgatggcacagactgtgttatgcttagcggggaaactgctgcaggagcctatccagacattgctgtccaaaccatggccagaatctgttcagaggcagagagtttcatagactatggtgacctattcaagagagtgatggaaacagctccaactccaatgagtcctttggagagcatggcttcagcggcagttaggactgcaaactgtataaacgcagccttaatattagttctaactagaggaggaaccacttcaaaacttgtggcaaagtatagacccagcatgcctattctgtcactggtggttcctgagataacaacagattcttttgaatggttctgcagtcaggaagcccctgcaaggcatagccttatctaccggggactaatacctgttttgggcacaggttcttttggagattccatgactgaatcaacagaagaaaccatacagcttgctctttcatatgcaaagaaaaatgacttgtgcaagcctggagactctgttgtagcacttcaccgtcttgagtctggtactgtcatcaagatattggatgtttgt

SEQ ID NO: 11265 - DNA, 1506 bp, Artificial sequence
  miR resistant mutant
atggaaaagatgttagggagaaattgtgggaagttgaagaccaagattgtgtgcactttgggaccatcaagtaggtcagtggagatgctggagaagcttctgaaggcagggatgaacgtggctcgcttcaacttctctcatggcactcactcttaccaccaagagacccttgataatctcagaactgcaatgaacaacaccggcattctctgtgctgtcatgttggacaccaagggtccagagatcagaactgggtttttgaatgaagggaagccaatacaaatccataggggacaagaaatcacaatcacaactgattacagcataaagggtgatgagaacatgatcagcatgagctacaagaagttggcacaccatttgagtccagggagtaatattctgtgtgctgatgggacaattagtttcactgtgctagaatgtgacaaagagaatggcttggttcgatgtcattgcgaaaattctgcagttctgggggagaggaagaatgttaaccttcctggagtggttgttgatcttccaatcttgacagagaaggacaaggaggacattttggagtggggggttcctaataagattgatatcattgctctctcttttgttagaaaaggttcagaccttgtggaggtcagaaatctacttggaaagcatgcaaaaagcatacttctcatgtccaaggttgaaaatcaagagggtgttgcaaattttgatgaaatactggaaaattcagatgcattcatggtggcaagaggtgacctgggaatggaaattccaattgagaagatctttctagctcagaaagttatgatacacaagtcaaacattaaaggcaagcctgtggtgacagccacccagatgttagagtccatgatcaaatctcctcggcctacacgagccgaggccaccgatgttgccaatgcagtccttgatggcacagactgtgttatgcttagcggggaaactgctgcaggagcctatccagacattgctgtccaaaccatggccagaatctgttcagaggcagagagtttcatagactatggtgacctattcaagagagtgatggaaacagctccaactccaatgagtcctttggagagcatggcttcagcggcagttaggactgcaaattgtataaatgcagccttaatattagttctaactagaggaggaaccacttcaaaacttgtggcaaagtatagacccagcatgcctattctgtcactggtggttcctgagataacaacagattcttttgaatggttctgcagtcaggaagcccctgcaaggcatagccttatctaccggggactaatacctgttttgggcacaggttcttttggagattccatgactgaatcaacagaagaaaccatacagcttgctctttcatatgcaaagaaaaatgacttgtgcaagcctggagactctgttgtagcacttcaccgtcttgagtctggtactgtcatcaagatattggatgtttgt

SEQ ID NO: 11266 - DNA, 1668 bp, Artificial sequence
  miR resistant mutant
atggcagcgtttgggattcgaatcatgctattgatggcagcttgcttgcttccactatctgtggaagctatggttcgccactacaagttcaatgtggtgctgaagaatgccacaagattgtgttcaacaaagccaattgtcaccgtaaatggaaagttcccaggtcccaccatctatgctagggaagatgacactgtactggttaaggtggtcaatcatgtcaagtacaatgttagcatccactggcatggggtcagacaattgagaacaggttgggctgatgggccagcatacataacccagtgtccaattcaaccgggccaggcttttatctacaactttacccttacaggccaaagaggcacactttggtggcatgcacatatcctctggcttagggccactgtccatggtgccttggtcatcttgcctaagcttggagttccttaccctttccccaaaccaaatatggaacaagttatgatattgagtgaatggtggaaatcagatactgaggctgtaataaatgaagctttgaaatctggtttggcaccaaatgtctccaatgctcacacaatcaatggccacccaggacctgtccaaggttgtgcttcacaagaaggatttaagttggatgtccaaccaggaaacacctacttgctacgcataataaacgcagccttaaacgaagagctattcttcaaaattgctggccatgaactcactgttgttgaggttgatgcagtctacacaaaaccattcaaaactgataccattgtcatagcacctggccagaccacaaatgtgcttctaacaaccaaacatgcagcaggcaaatacttggttgcagcctctccttttatggatgctcccattgcagttgacaacaagactgccactgccacattacactactcaggcacccttggttccaccatcaccaccctcacttccatgcctcccaaaaatgctacccctcttgccaccagtttcactgactcactcagaagcttgaactccaaaaagtatcctgctagagtgcctttgaagattgaccacaacttgctcttcactgttagtcttggaattaacccttgtgctacttgtgtgaataacagcagggtggtggcagatatcaacaatgttacctttgtgatgcctaaaatttctcttctccaagcacatttcttcaaaattaagggagttttcactgatgattttcctggaaatcctcctgtggtttataacttcacagggacacagccatcaaatttgaggaccatgaaaggaacaagggtgtatagacttgcttacaattctacagttcaattagtcttgcaagatactggaatgataacacctgagaaccaccccattcatctccatggctttaatttctttgtagttggtaggggacagagaaatttcaaccccacaaaagaccccaagaaatttaaccttgtagatcctgtggagagaaatacagttggagtcccagctggagggtggactgctatcagattcaggactgataatccaggtgtttggtttatgcattgtcatttggaaattcatacaacatggggactgaagatggcttttgttgtggataatggtaaaggaccaaatgaatctctattaccacctccaagtgacctccccaagtgt

SEQ ID NO: 11267 - DNA, 1668 bp, Artificial sequence
  miR resistant mutant
atggcagcgtttgggattcgaatcatgctattgatggcagcttgcttgcttccactatctgtggaagctatggttcgccactacaagttcaatgtggtgctgaagaatgccacaagattgtgttcaacaaagccaattgtcaccgtaaatggaaagttcccaggtcccaccatctatgctagggaagatgacactgtactggttaaggtggtcaatcatgtcaagtacaatgttagcatccactggcatggggtcagacaattgagaacaggttgggctgatgggccagcatacataacccagtgtccaattcaaccgggccaggcttttatctacaactttacccttacaggccaaagaggcacactttggtggcatgcacatatcctctggcttagggccactgtccatggtgccttggtcatcttgcctaagcttggagttccttaccctttccccaaaccaaatatggaacaagttatgatattgagtgaatggtggaaatcagatactgaggctgtaataaatgaagctttgaaatctggtttggcaccaaatgtctccaatgctcacacaatcaatggccacccaggacctgtccaaggttgtgcttcacaagaaggatttaagttggatgtccaaccaggaaacacctacttgctacgcatcatcaacgcagccttaaacgaagagctattcttcaaaattgctggccatgaactcactgttgttgaggttgatgcagtctacacaaaaccattcaaaactgataccattgtcatagcacctggccagaccacaaatgtgcttctaacaaccaaacatgcagcaggcaaatacttggttgcagcctctccttttatggatgctcccattgcagttgacaacaagactgccactgccacattacactactcaggcacccttggttccaccatcaccaccctcacttccatgcctcccaaaaatgctacccctcttgccaccagtttcactgactcactcagaagcttgaactccaaaaagtatcctgctagagtgcctttgaagattgaccacaacttgctcttcactgttagtcttggaattaacccttgtgctacttgtgtgaataacagcagggtggtggcagatatcaacaatgttacctttgtgatgcctaaaatttctcttctccaagcacatttcttcaaaattaagggagttttcactgatgattttcctggaaatcctcctgtggtttataacttcacagggacacagccatcaaatttgaggaccatgaaaggaacaagggtgtatagacttgcttacaattctacagttcaattagtcttgcaagatactggaatgataacacctgagaaccaccccattcatctccatggctttaatttctttgtagttggtaggggacagagaaatttcaaccccacaaaagaccccaagaaatttaaccttgtagatcctgtggagagaaatacagttggagtcccagctggagggtggactgctatcagattcaggactgataatccaggtgtttggtttatgcattgtcatttggaaattcatacaacatggggactgaagatggcttttgttgtggataatggtaaaggaccaaatgaatctctattaccacctccaagtgacctccccaagtgt

SEQ ID NO: 11268 - DNA, 3066 bp, Artificial sequence
  miR resistant mutant
atggagagtgtgaatgatctgatccaagaggccaagctccgcactctctggtgggcactctgtatattcgccgtttcctatttcctaactcatactagtaaatcaatgtggatgaatgtacccatgtcgatcctatttgttgtggggctgcgcattcttttcaatagggtggagtttcgttggaagcttcaacagcctagaccgcagacctatctatctcatttggagaaaaagcagttgtctctcaatgatccatgcctcactagtttgccttcccctgcaaaatggaagaggaaaattgattctcctgctgtggaggctgcaatgagtgatttcattgataagattttgaaggattttgtggttgatttgtggtactcagagatttctccagataaggagtttccggagcagatacgggcaataatcatggatgttctagctgaaatatcaggaagggttaaagagataaacctggttgacctgctgacaagggatttagtagatttaataggtgttcacatagaacttttcagaagaaatcaagctgttataggtgttaatattatgaaaacattatcttctgaggagcggaatgacagattaaaattccatctgttgaattctaaggagcttcatccggcactaatatctcctgagagtgagtacaaggttcttcagcggctaatgagtgctgttttagctacagtactaagacaacgagaagctcagtgtcctgtgattcgttctatatctcgggaattattaacttgcttggtaatgcagcctattatgaatttggcaagccctgggtatattaatgaactgattgaatctcttctacttctctttaatgatgatggtacggaagggatgggcagtgatcagtcaactaatgtagcaagtctccatcatggtcattctgttgccagtaagggtggacacaacaatctcacagcctctaataagcatccatctttaaatcaaggaactgatatgatattggctaaaatgagtgatcagggagggacatcgttacaagatagcactctccatcaagagtctaaacaagttgggcctgctgattgggcacgaatgttggaggttacaactcagaggagaactgaaattcttatgccggagaatcttgagaacatgtggacaaagggaaggaattacaaaaggaaagagaacaaaattatcaaagctggctctaaggatctttctgcaaagagtccctctacagacagttcacggcctcatagaaaattggctcaggaaacatcagcaagtaaacgtggaaagtatgaagttgcagatgggaagtcttctctgccgccattgcctgccataggttcagatcccctgcaaaatgttggaagtgcaaaaaattcagaatctcctaaaaaccctggcaaggaattgtctattgtgggagatcttgcttctgatgcttatagaagtccactaaagaggtcgagtagtgcttcttccttaggaatcctatctaataaagaagactccagaatttcagagtttttcaaccctgaacttgagaggcacagtgaaggatttcggggaaagagttcttctaatatgattgttaggaaagaagggtcattagttcctaagcttcggtgtcgggttgtgggagcatattttgagaaaattgggtccacatgttttgctgtttattcaattgcagtgactgacgcacaaaataaaacttggtttgtaaaaagaagatacaggaattttgagcgattgcaccggcatcttaaagatattcccaattacacattgcaattgcctcctaaaaggatattttcctcaagcacagatgatgcctttgtccaccagagatgtatacagttagataaatatcttcaggatctcctgtcaatagctaatgtagccgaacaacatgaagtatgggatttcttcagtgtttcctcaaagaactactcatttgggaaatctccttcagtgatgaagaccttggcagtcaatgtagatgatgctatggatgatattgtacgccagtttaaaggtgtttcagatggtttaaggcgaaaagttgttggttcatcatccctcatcaatgagggatctgctacatctaataccccatggaatttgtcctggaatgctgatgaaatcgacaaaagcattccaaggcaaagtactgcagaaagtgttagctctgataatgaggaaggtgaaaggaacaattttgaccgtgagaatattgatagagaagcagcacaagatagtggattgcattcttacaatgcattgatctcaaagggttactcatcacgaataagcaattgggatgaagagtccaggaacttggattttgatagaaagcatgatatggtggttgaagctagggctggcaatggtattcctgctacaaatttcattctgattcatgataatttggaggatccagttggagtgccacctgagtggactccacctaatgttagtgtccccattttgaatttggttgacaacatatttcaacttaataaaagaggctggataagaagacaggtctattggatttcaaaacagatattacagttggtgatggaagatgcaatcgatgattggctcctgagacagattcattggctccggagagaggaaactgtttcccaagggattcggtgggtccaagatgtcctatggcctggtggtacattttttttaagagttgggactccccagataattagtgacagtgataaaaaatcttctccaacaatgagcagatctggtggaagcaacatcacgaaatctgagtcagggtcttttgagcaagagctcgaggctgctcgtagagcaagtgacatcaagaaactgctgtttgatggagctccaacaactttagtcagcttaatcggccataagcagtacagacgttgcgcccgggatatatactactttagtcagtctaatgtatgtgtgaagcaacttgcttatgcaattttggaacttgcacttgtctccatcttccccgagattcggaatgttgtgaagagtattcaccaacctgta

SEQ ID NO: 11269 - DNA, 3066 bp, Artificial sequence
  miR resistant mutant
atggagagtgtgaatgatctgatccaagaggccaagctccgcactctctggtgggcactctgtatattcgccgtttcctatttcctaactcatactagtaaatcaatgtggatgaatgtacccatgtcgatcctatttgttgtggggctgcgcattcttttcaatagggtggagtttcgttggaagcttcaacagcctagaccgcagacctatctatctcatttggagaaaaagcagttgtctctcaatgatccatgcctcactagtttgccttcccctgcaaaatggaagaggaaaattgattctcctgctgtggaggctgcaatgagtgatttcattgataagattttgaaggattttgtggttgatttgtggtactcagagatttctccagataaggagtttccggagcagatacgggcaataatcatggatgttctagctgaaatatcaggaagggttaaagagataaacctggttgacctgctgacaagggatttagtagatttaataggtgttcacatagaacttttcagaagaaatcaagctgttataggtgttaatattatgaaaacattatcttctgaggagcggaatgacagattaaaattccatctgttgaattctaaggagcttcatccggcactaatatctcctgagagtgagtacaaggttcttcagcggctaatgagtgctgttttagctacagtactaagacaacgagaagctcagtgtcctgtgattcgttctatatctcgggaattattaacttgcttggtaatgcagcctattatgaatttggcaagccctgggtatattaatgaactgattgaatctcttctacttctctttaatgatgatggtacggaagggatgggcagtgatcagtcaactaatgtagcaagtctccatcatggtcattctgttgccagtaagggtggacacaacaatctcacagcctctaataagcatccatctttaaatcaaggaactgatatgatattggctaaaatgagtgatcagggagggacatcgttacaagatagcactctccatcaagagtctaaacaagttgggcctgctgattgggcacgaatgttggaggttacaactcagaggagaactgaaattcttatgccggagaatcttgagaacatgtggacaaagggaaggaattacaaaaggaaagagaacaaaattatcaaagctggctctaaggatctttctgcaaagagtccctctacagacagttcacggcctcatagaaaattggctcaggaaacatcagcaagtaaacgtggaaagtatgaagttgcagatgggaagtcttctctgccgccattgcctgccataggttcagatcccctgcaaaatgttggaagtgcaaaaaattcagaatctcctaaaaaccctggcaaggaattgtctattgtgggagatcttgcttctgatgcttatagaagtccactaaagaggtcgagtagtgcttcttccttaggaatcctatctaataaagaagactccagaatttcagagtttttcaaccctgaacttgagaggcacagtgaaggatttcggggaaagagttcttctaatatgattgttaggaaagaagggtcattagttcctaagcttcggtgtcgggttgtgggagcatattttgagaaaattgggtccacatgttttgctgtttattcaattgcagtgactgacgcacaaaataaaacttggtttgtaaaaagaagatacaggaattttgagcgattgcaccggcatcttaaagatattcccaattacacattgcaattgcctcctaaaaggatattttcctcaagcacagatgatgcctttgtacaccagagatgtatacagttagataaatatcttcaggatctcctgtcaatagctaatgtagccgaacaacatgaagtatgggatttcttcagtgtttcctcaaagaactactcatttgggaaatctccttcagtgatgaagaccttggcagtcaatgtagatgatgctatggatgatattgtacgccagtttaaaggtgtttcagatggtttaaggcgaaaagttgttggttcatcatccctcatcaatgagggatctgctacatctaataccccatggaatttgtcctggaatgctgatgaaatcgacaaaagcattccaaggcaaagtactgcagaaagtgttagctctgataatgaggaaggtgaaaggaacaattttgaccgtgagaatattgatagagaagcagcacaagatagtggattgcattcttacaatgcattgatctcaaagggttactcatcacgaataagcaattgggatgaagagtccaggaacttggattttgatagaaagcatgatatggtggttgaagctagggctggcaatggtattcctgctacaaatttcattctgattcatgataatttggaggatccagttggagtgccacctgagtggactccacctaatgttagtgtccccattttgaatttggttgacaacatatttcaacttaataaaagaggctggataagaagacaggtctattggatttcaaaacagatattacagttggtgatggaagatgcaatcgatgattggctcctgagacagattcattggctccggagagaggaaactgtttcccaagggattcggtgggtccaagatgtcctatggcctggtggtacattttttttaagagttgggactccccagataattagtgacagtgataaaaaatcttctccaacaatgagcagatctggtggaagcaacatcacgaaatctgagtcagggtcttttgagcaagagctcgaggctgctcgtagagcaagtgacatcaagaaactgctgtttgatggagctccaacaactttagtcagcttaatcggccataagcagtacagacgttgcgcccgggatatatactactttagtcagtctaatgtatgtgtgaagcaacttgcttatgcaattttggaacttgcacttgtctccatcttccccgagattcggaatgttgtgaagagtattcaccaacctgta

SEQ ID NO: 11270 - DNA, 1662 bp, Artificial sequence
  miR resistant mutant
atgtggataagaatcatacttctagtagcggcttgcatgcttcctctttcagtggaagccatggttcgccactacaagttcaacgtggtggtaaagaatgtcacaagattgtgttcaacaaagcccatagtaaccgtaaatgggaagttccctggccccacaatatatgctagggaagatgacactgttttggtaaaggtggttaaccatgttaaatacaatgttagcatccactggcatggggtgagacaattgcagacgggttgggccgatgggcctgcatacataactcaatgcccaattcaaccgggccaggcctttgtgtacaacttcaccctcacagggcagagagggacactttggtggcatgcacatatcctttggcttaggtcaactgttcatggtgccttggtcattttgcctaagcttggagttccttacccttttcccaaaccccacacggaaaaagtcatcatattgagtgaatggtggaaatcagatactgaagctgtaataaatgaagctttgaaatctgggtcggctccaaatgtctctgatgctcacacaatcaatggtcatcctggatctgtacaaaattgtgcatcacaagggggatacaaactccaagttcaacctggaaacacctacttgctacgcatcataaatgcagccttaaacgaagagttgttctttaaaattgctggtcaccaactgacagttgttgaggttgatgctgtctacacaaaaccttttaaaactgacactatagttatagcacctggccaaaccacaaatgtgcttctaaaagcaaaccgtgctgctggcaaatacttagtagcagccactcccttcatggattctcctattacagtggacaatgtgactgccactgccacattacactacacaggctcacttggttccaccatcacaaccctcacttcattgcctcccaaaaatgccacaccagttgctacaaacttcactgactcactcagaagcctaaactccaaaaagtaccctgctagagtgcctcaaaaggttgaccattccttgttcttcactgtcagccttggagtcaacccttgccccacatgtgccaatggtagtaaagtggttgcagccatcaacaatgtgacctttgttatgcctaaagtttctctcctccaagcacatttcttcaacataagtggagttttcacagatgattttcctgggaagcctccagtggtttatgacttcacagggacacaacagccaacaaatttgaggactaatagagggacaagggtatatagacttgcctataactccacagttcaattagtcttgcaagatactggaatgataacacctgagaaccatcctattcatctccatggattcaacttcttcgtggttggtaggggacaagggaatttcaaccccaaaaaggacaccaaaaagtttaatcttgtggatcctgtggagagaaacacagttggtgttccatctggggggtggactgctatcagattcagggctgataatccaggtgtttggtttatgcattgccatttagaaattcatacaacatggggattgaagatggcatttgtggtagacaatggtaaaggaccaaatgagtctctactaccacctccaagtgatcttcccaagtgt

SEQ ID NO: 11271 - DNA, 1662 bp, Artificial sequence
  miR resistant mutant
atgtggataagaatcatacttctagtagcggcttgcatgcttcctctttcagtggaagccatggttcgccactacaagttcaacgtggtggtaaagaatgtcacaagattgtgttcaacaaagcccatagtaaccgtaaatgggaagttccctggccccacaatatatgctagggaagatgacactgttttggtaaaggtggttaaccatgttaaatacaatgttagcatccactggcatggggtgagacaattgcagacgggttgggccgatgggcctgcatacataactcaatgcccaattcaaccgggccaggcctttgtgtacaacttcaccctcacagggcagagagggacactttggtggcatgcacatatcctttggcttaggtcaactgttcatggtgccttggtcattttgcctaagcttggagttccttacccttttcccaaaccccacacggaaaaagtcatcatattgagtgaatggtggaaatcagatactgaagctgtaataaatgaagctttgaaatctgggtcggctccaaatgtctctgatgctcacacaatcaatggtcatcctggatctgtacaaaattgtgcatcacaagggggatacaaactccaagttcaacctggaaacacctacttgctaagaatcataaatgcagccttaaacgaagagttgttctttaaaattgctggtcaccaactgacagttgttgaggttgatgctgtctacacaaaaccttttaaaactgacactatagttatagcacctggccaaaccacaaatgtgcttctaaaagcaaaccgtgctgctggcaaatacttagtagcagccactcccttcatggattctcctattacagtggacaatgtgactgccactgccacattacactacacaggctcacttggttccaccatcacaaccctcacttcattgcctcccaaaaatgccacaccagttgctacaaacttcactgactcactcagaagcctaaactccaaaaagtaccctgctagagtgcctcaaaaggttgaccattccttgttcttcactgtcagccttggagtcaacccttgccccacatgtgccaatggtagtaaagtggttgcagccatcaacaatgtgacctttgttatgcctaaagtttctctcctccaagcacatttcttcaacataagtggagttttcacagatgattttcctgggaagcctccagtggtttatgacttcacagggacacaacagccaacaaatttgaggactaatagagggacaagggtatatagacttgcctataactccacagttcaattagtcttgcaagatactggaatgataacacctgagaaccatcctattcatctccatggattcaacttcttcgtggttggtaggggacaagggaatttcaaccccaaaaaggacaccaaaaagtttaatcttgtggatcctgtggagagaaacacagttggtgttccatctggggggtggactgctatcagattcagggctgataatccaggtgtttggtttatgcattgccatttagaaattcatacaacatggggattgaagatggcatttgtggtagacaatggtaaaggaccaaatgagtctctactaccacctccaagtgatcttcccaagtgt

SEQ ID NO: 11272 - DNA, 1677 bp, Artificial sequence
  miR resistant mutant
atggactcttgggttagaatgctgtttctcattgcttgcattgttccagctttagtcgagtgcaaagtgaggcactacaaattcaatgtggtactgaagaatactactaggttatgttcaagcaaaccaattgtcaccgttaatgggaaatttccaggacccactctttacgctagggaagatgatacagtgctagtcaaagtcaataaccttgtcaaccacaatgtcaccatccactggcatggtgtgagacaacttagaactggttgggctgatgggcctgcatacatcacacagtgcccaattctgtcaggacaatcatatttgtacaacttcacccttacaggacaaagaggaacacttctttggcatgctcatgttaactggctaaggtcaactctccatggtgccatagttatcttgccaaagaggggtgtgccataccctttcccaaaaccagataaagagttggttgtaatattaggagaatggtggaaatctgatacagaagatgttatcaatgaagctctcaagtcaggattagcaccaaatgtctcagatgctcataccattaatggccttccagggattgtgtctgtggccaattgttctacacaagatgtgtacaagcttcctgtggaaagtggcaagacctacctattgcgcataataaacgcagccttaaacgaggagctcttcttcaaaattgctggccatccattcactgtggttgaagttgatgcctcatatgtaaagcccttcaagacagacactctttcgatagcccctggtcaaaccaccaatgcccttttaactgctgaccaaaactctggcaaatacacaattgtagcctctactttcatggattctccagttgtagctgtggataacttgactgcaacagccacattgcactacactggcactcttgccaccactcctacacttctcaccacccctcctccaagaaatgccacccaagttgctaacaacttcaccaattctctcaaaagccttaattctaagaaatacccagcaaaagtcccacaaaaagttgatcattcacttctcctcactgttggtttggggattaacccttgtccatcttgcacagctggcaatgggagtagagtagtggctgctgtcaacaatgtgacatttgtgatgccaaccactgcactgcttcaggctcattacttcaacatcaagggggtgttcaccactgatttccctggcaacccttctcatgtttacaactacacggcgactccgccggcggcagcttggcagaccacaaatggcaccaaggcttacaggctggcattcaactccacagttcaggttgttttgcaggatactggggtcattgctcctgagagccacccggttcatcttcatgggttcaacttctttgttgttggctctggtgtaggaaattatgatcccaaaacggatcaaaataactttaatcttgcggatcctgttgagaggaacacaattggagtgcctactggagggtgggttgctttcagattcagagcagataacccagtgtggttcttgcactgccatttcgaggtgcatacaacatgggggttgaagatggcattcttggtggacaatggtaaaggtcctaatgaatcactgctacccccaccaaaagatcttccaaaatgt

SEQ ID NO: 11273 - DNA, 1677 bp, Artificial sequence
  miR resistant mutant
atggactcttgggttagaatgctgtttctcattgcttgcattgttccagctttagtcgagtgcaaagtgaggcactacaaattcaatgtggtactgaagaatactactaggttatgttcaagcaaaccaattgtcaccgttaatgggaaatttccaggacccactctttacgctagggaagatgatacagtgctagtcaaagtcaataaccttgtcaaccacaatgtcaccatccactggcatggtgtgagacaacttagaactggttgggctgatgggcctgcatacatcacacagtgcccaattctgtcaggacaatcatatttgtacaacttcacccttacaggacaaagaggaacacttctttggcatgctcatgttaactggctaaggtcaactctccatggtgccatagttatcttgccaaagaggggtgtgccataccctttcccaaaaccagataaagagttggttgtaatattaggagaatggtggaaatctgatacagaagatgttatcaatgaagctctcaagtcaggattagcaccaaatgtctcagatgctcataccattaatggccttccagggattgtgtctgtggccaattgttctacacaagatgtgtacaagcttcctgtggaaagtggcaagacctacctattgcgcatcatcaacgcagccttaaacgaggagctcttcttcaaaattgctggccatccattcactgtggttgaagttgatgcctcatatgtaaagcccttcaagacagacactctttcgatagcccctggtcaaaccaccaatgcccttttaactgctgaccaaaactctggcaaatacacaattgtagcctctactttcatggattctccagttgtagctgtggataacttgactgcaacagccacattgcactacactggcactcttgccaccactcctacacttctcaccacccctcctccaagaaatgccacccaagttgctaacaacttcaccaattctctcaaaagccttaattctaagaaatacccagcaaaagtcccacaaaaagttgatcattcacttctcctcactgttggtttggggattaacccttgtccatcttgcacagctggcaatgggagtagagtagtggctgctgtcaacaatgtgacatttgtgatgccaaccactgcactgcttcaggctcattacttcaacatcaagggggtgttcaccactgatttccctggcaacccttctcatgtttacaactacacggcgactccgccggcggcagcttggcagaccacaaatggcaccaaggcttacaggctggcattcaactccacagttcaggttgttttgcaggatactggggtcattgctcctgagagccacccggttcatcttcatgggttcaacttctttgttgttggctctggtgtaggaaattatgatcccaaaacggatcaaaataactttaatcttgcggatcctgttgagaggaacacaattggagtgcctactggagggtgggttgctttcagattcagagcagataacccagtgtggttcttgcactgccatttcgaggtgcatacaacatgggggttgaagatggcattcttggtggacaatggtaaaggtcctaatgaatcactgctacccccaccaaaagatcttccaaaatgt

SEQ ID NO: 11274 - DNA, 1752 bp, Artificial sequence
  miR resistant mutant
atgatcaaacctattccttcatcaccttcactttttgtggcattcctctttgccaccagcttcctttggtcttttcccgaatttgttctcgctacttcaaagcatggaagtgctacaaggcactacaagtttgatataaggttgagaaacgttacgaggctgtgccacacgaagagcatggttaccgtgaacggaaagttccctgggcctagagttgttgcaagagaaggtgacagaatagtggtaaaggtggttaatcatgttcccaacaatgtcagcatacactggcatggagtgagacagcttcaaagtggatgggcagatggtccatcttacataactcaatgcccgattcaaactggccagaattatgtgtacaacttcaccattgttggacaaagaggaaccttattctggcatgctcacttttcatggttaagagccactctctatggacccctaatcctcctacctaggcgcaacgaatcttacccatttgagaaaccctacaaggaagttcccatcatctttggtgagtggtggaacgctgatccagaggctgttattgcacaagcccttcagacaggggctggcccaaatgtctctgatgcctacacttttaacggacttcctggacccttttacaattgctccaataacgacacggacactttcaggttaaaggtgaaaccagggaagacatatcttcttagactaataaacgcagccttaaacgatgaactctttttcagcattgcaaaccacaccttggtaactgttgaagctgatgctacttacgttaaacctttcgagtcagacatcatagtcctggggccaggacaaacctcaaacgttctgttaaagacaaaagctgagtacccaaatgccaatttcttgatgctagcaagaccatatttcactggcatgggaactttcgacaattccacagttgctggctttctagagtataagaataaaccacttgctgctcccaaaaatattaatattcccactttgaaaccatttcttccagccatcaatgacacttccttcgttgccaactttagtaacaaattcttcagtttgaaccctgcaaaggtgcctcaaatagttgacaagagcttcttcttcacaattggacttggaacaagtccttgtcccaaaaaccaaacatgccaaggaccgaacaacagttcaaagtttgcagcctcaatgaacaacatatctttcactcttccttccatagcacttcttgagcaacatttctttgggcaagctaataatggcatttacaccactgatttccctgccatgccactcatgccattcaactacacggggactccaccgaacaacactttggtcggtaatggaacaaagactgtggtgataccctttaacacaagcgtgcaagtggtgcttcaggacactagcattttgggagctgagagccaccccttgcaccttcatggctttaatttctatgttgtgggtcaaggctttgggaactttaatcctaacactgaccctcaaatattcaatctttttgaccccgttgaaaggaacactgttggtgtgccctctggtggttgggttgcaatccgattccttgctgacaatccaggtgtttggctgatgcattgccactttgatgtccaccttagttgggggttgaggatggcttggattgttgaggatgggaagctacctaatcagaagttgcctcctccaccagctgatctccccaagtgt

SEQ ID NO: 11275 - DNA, 1752 bp, Artificial sequence
  miR resistant mutant
atgatcaaacctattccttcatcaccttcactttttgtggcattcctctttgccaccagcttcctttggtcttttcccgaatttgttctcgctacttcaaagcatggaagtgctacaaggcactacaagtttgatataaggttgagaaacgttacgaggctgtgccacacgaagagcatggttaccgtgaacggaaagttccctgggcctagagttgttgcaagagaaggtgacagaatagtggtaaaggtggttaatcatgttcccaacaatgtcagcatacactggcatggagtgagacagcttcaaagtggatgggcagatggtccatcttacataactcaatgcccgattcaaactggccagaattatgtgtacaacttcaccattgttggacaaagaggaaccttattctggcatgctcacttttcatggttaagagccactctctatggacccctaatcctcctacctaggcgcaacgaatcttacccatttgagaaaccctacaaggaagttcccatcatctttggtgagtggtggaacgctgatccagaggctgttattgcacaagcccttcagacaggggctggcccaaatgtctctgatgcctacacttttaacggacttcctggacccttttacaattgctccaataacgacacggacactttcaggttaaaggtgaaaccagggaagacatatcttcttcgtctaataaacgcagccttaaacgatgaactctttttcagcattgcaaaccacaccttggtaactgttgaagctgatgctacttacgttaaacctttcgagtcagacatcatagtcctggggccaggacaaacctcaaacgttctgttaaagacaaaagctgagtacccaaatgccaatttcttgatgctagcaagaccatatttcactggcatgggaactttcgacaattccacagttgctggctttctagagtataagaataaaccacttgctgctcccaaaaatattaatattcccactttgaaaccatttcttccagccatcaatgacacttccttcgttgccaactttagtaacaaattcttcagtttgaaccctgcaaaggtgcctcaaatagttgacaagagcttcttcttcacaattggacttggaacaagtccttgtcccaaaaaccaaacatgccaaggaccgaacaacagttcaaagtttgcagcctcaatgaacaacatatctttcactcttccttccatagcacttcttgagcaacatttctttgggcaagctaataatggcatttacaccactgatttccctgccatgccactcatgccattcaactacacggggactccaccgaacaacactttggtcggtaatggaacaaagactgtggtgataccctttaacacaagcgtgcaagtggtgcttcaggacactagcattttgggagctgagagccaccccttgcaccttcatggctttaatttctatgttgtgggtcaaggctttgggaactttaatcctaacactgaccctcaaatattcaatctttttgaccccgttgaaaggaacactgttggtgtgccctctggtggttgggttgcaatccgattccttgctgacaatccaggtgtttggctgatgcattgccactttgatgtccaccttagttgggggttgaggatggcttggattgttgaggatgggaagctacctaatcagaagttgcctcctccaccagctgatctccccaagtgt

SEQ ID NO: 11276 - DNA, 1752 bp, Artificial sequence
  miR resistant mutant
atgggttgtgcttatctcaacatgccaggcttcatgagggcaatgtttgttgtgttatgtgcgctgatgatattgccggagctaacacatgcaaagcatgcaagagtcactaggcactacaagtttaatatcaaaatgcaaaacttcacaaggctttgccaaacaaagaacattgtaactgtcaatggacgatttcctggtcctagaatcatagcaagagaaggtgacagaattatggttaaagtggttaaccacgttcaatacaatgttacccttcattggcatggaattcgccaactgaaaagtgcatgggcagatggacctgcctatatcacacagtgtccaattcagacaggccaaagttttgtgtacaacttcacagtcattggtcaaagaggaacactatggtggcatgcacatatctcatggcttagaacaactctctatggtcccattgtcattcttcccaaaagacatgtcccttacccattccctcaacccttcagagaagtccccatcatattgggggagtggtggaaagcagacacagaagctgttataaatcaagcaatgcagacaggattggcaccaaatgtctcagatgctcacactatcaatggtcttcccggtcctgtctccaactgcgcagccaaagaaacattcaagctcaaggtgaagcctggaaaaacatatctgcttagattaataaatgcagccttaaacgatgaaatgttcttcagcatagccaaccacaccctcaccatggtggaagctgatgcggtgtatgtaaagcccttcagcacaaaggttgttctgatcacacctggtcaaaccgtcaacgtccttctcaaggccaaatccaaggcaccaaatgccacatttgccatatccacaaggccctatgctacaggtccagctgcttttgacaacaccacagccacagggttccttgagtacaagaaaccttcacttgcaagcagcaagtcaaacaccaagaagcttccacttcttagagcagtgttccctaaattcaatgacactgtctttgcaatgaacttccacaacaaggttcgtagcttggccagtgcaagattcccagcaaaagttccaaaaaccgtggacaggcgcttcttcttcactgttggcttaggaataagccagtgctcaaaaaaccaacaatgccaagggcctaacaacacaagggtagctgcagcagttaacaatgtgacatttgtgacaccaaacattgccttactccaagcacattttttcaacaagtccaagggagtgtacaccactgatttccctgctaaccctcctttcaagttcaactacactggcactccaccaagcaatatctttgtgagtagtggcactaaggcagtggtgctgccatacaacaccagtgtggagttggtacttcaggacacaagcattattggagctgagagtcaccctcttcaccttcatggcttcaacttcttcattgttggccaaggaaatggaaactttgaccccaaaaaggaccccaaaaagttcaacctggttgaccctgctgagaggaacactgctggtgtgccatctggtgggtgggttgctgtgcgctttcttgctgacaatccaggtgtttggttcatgcattgccaccttgaagtgcacactagttggggattgaaaatggcatggatagtccaagatggtaaacggcgcaatcagaagctgccacctccaccctctgatcttcccaaatgt

SEQ ID NO: 11277 - DNA, 1752 bp, Artificial sequence
  miR resistant mutant
atgggttgtgcttatctcaacatgccaggcttcatgagggcaatgtttgttgtgttatgtgcgctgatgatattgccggagctaacacatgcaaagcatgcaagagtcactaggcactacaagtttaatatcaaaatgcaaaacttcacaaggctttgccaaacaaagaacattgtaactgtcaatggacgatttcctggtcctagaatcatagcaagagaaggtgacagaattatggttaaagtggttaaccacgttcaatacaatgttacccttcattggcatggaattcgccaactgaaaagtgcatgggcagatggacctgcctatatcacacagtgtccaattcagacaggccaaagttttgtgtacaacttcacagtcattggtcaaagaggaacactatggtggcatgcacatatctcatggcttagaacaactctctatggtcccattgtcattcttcccaaaagacatgtcccttacccattccctcaacccttcagagaagtccccatcatattgggggagtggtggaaagcagacacagaagctgttataaatcaagcaatgcagacaggattggcaccaaatgtctcagatgctcacactatcaatggtcttcccggtcctgtctccaactgcgcagccaaagaaacattcaagctcaaggtgaagcctggaaaaacatatctgcttcgtttaataaatgcagccttaaacgatgaaatgttcttcagcatagccaaccacaccctcaccatggtggaagctgatgcggtgtatgtaaagcccttcagcacaaaggttgttctgatcacacctggtcaaaccgtcaacgtccttctcaaggccaaatccaaggcaccaaatgccacatttgccatatccacaaggccctatgctacaggtccagctgcttttgacaacaccacagccacagggttccttgagtacaagaaaccttcacttgcaagcagcaagtcaaacaccaagaagcttccacttcttagagcagtgttccctaaattcaatgacactgtctttgcaatgaacttccacaacaaggttcgtagcttggccagtgcaagattcccagcaaaagttccaaaaaccgtggacaggcgcttcttcttcactgttggcttaggaataagccagtgctcaaaaaaccaacaatgccaagggcctaacaacacaagggtagctgcagcagttaacaatgtgacatttgtgacaccaaacattgccttactccaagcacattttttcaacaagtccaagggagtgtacaccactgatttccctgctaaccctcctttcaagttcaactacactggcactccaccaagcaatatctttgtgagtagtggcactaaggcagtggtgctgccatacaacaccagtgtggagttggtacttcaggacacaagcattattggagctgagagtcaccctcttcaccttcatggcttcaacttcttcattgttggccaaggaaatggaaactttgaccccaaaaaggaccccaaaaagttcaacctggttgaccctgctgagaggaacactgctggtgtgccatctggtgggtgggttgctgtgcgctttcttgctgacaatccaggtgtttggttcatgcattgccaccttgaagtgcacactagttggggattgaaaatggcatggatagtccaagatggtaaacggcgcaatcagaagctgccacctccaccctctgatcttcccaaatgt

SEQ ID NO: 11278 - DNA, 1767 bp, Artificial sequence
  miR resistant mutant
atggagcctgccaaaaccattcacaacaatgtcaaatactcccccatcttcttagccatctttgttctgatcttagcttcagcattgtcttcagcaaatgccaaaattcacgagcacgagtttgttgttgaagcaactccagtgaagaggctgtgcaaaacccacaacagcatcaccgtgaatggacaatacccgggcccaacgttggaaatcaacaatggagacactttggtcgtcaaagtcactaacaaagctcgttacaatgtgaccattcattggcacggtgttaggcaaatgagaacagggtgggcagatggaccagaatttgtgacttcagtgcccgattgtccaggaggaagttacacctaccgttttaccgttcaaggacaagaaggcacactttggtggcacgctcatagctcatggttaagggccaccgtttacggtgctttaatcattcgtcctagggaaggagaaccctaccctttccccaagcctaagcgcgagacacccattcttcttggggaatggtgggacgcaaaccctattgatgttgtgaggcaggccacacgaactgggggagccccaaacgtgtctgatgcatacactatcaatggtcaacctggtgatctttacaagtgctccagcaaagacaccaccattgtcccaatacatgccggcgagaccaaccttcttagagtaataaacgcagccttaaaccaacctctcttcttcaccgtcgcaaaccacaaactcacagtggttggtgccgacgcctcctacctcaaacccttcaccaccaaagtcctcatactgggccccgggcaaaccaccgacgtcttaatcaccggcgaccagccaccttcccgctactacatggcggcgcgtgcgtaccaatccgcccaaaacgctgccttcgacaacaccactacaaccgccatactcgaatacaaatcaccgaatcaccacaataagcattctcaccatcgtgccaaaggagtaaagaacaaaaccaaacctataatgcctccactccctgcttacaacgacacaaacgcagtcacttccttcagcaaaagcttcagaagccctagaaaagttgaagtacccactgaaattgaccagagcctcttcttcactgtgggtttaggtatcaagaagtgccccaaaaacttcggaccaaagaggtgtcagggacccattaatgggacgaggttcactgcgagcatgaacaacgtgtctttcgttctcccgaacaacgtgtccatcttgcaggctcaccacctcggaatccctggagtgttcaccactgattttccggggaagccgccggtgaagtttgattacaccggcaatgtgagccgttcgctgtggcaacctgttcccgggacaaaggcacacaagttggagtttgggtcgagggtgcagattgtgttgcaggatactagcattgtcactcctgagaaccaccctatccatcttcatgggtacgatttctacattgttgcagagggtttcgggaacttcgacccaaagaaagatacggcgaaattcaaccttgttgatccacctttgagaaacacagtggctgtgcctgtaaatggatgggcagttattcgatttgtggctgataacccaggtgcatggcttttgcattgtcacttggacgttcacattggatggggtttggctacggtgttgttggtggagaatggagttgggaagttgcaatccatagagcctcctcctgtggatcttcctctttgt

SEQ ID NO: 11279 - DNA, 1767 bp, Artificial sequence
  miR resistant mutant
atggagcctgccaaaaccattcacaacaatgtcaaatactcccccatcttcttagccatctttgttctgatcttagcttcagcattgtcttcagcaaatgccaaaattcacgagcacgagtttgttgttgaagcaactccagtgaagaggctgtgcaaaacccacaacagcatcaccgtgaatggacaatacccgggcccaacgttggaaatcaacaatggagacactttggtcgtcaaagtcactaacaaagctcgttacaatgtgaccattcattggcacggtgttaggcaaatgagaacagggtgggcagatggaccagaatttgtgacttcagtgcccgattgtccaggaggaagttacacctaccgttttaccgttcaaggacaagaaggcacactttggtggcacgctcatagctcatggttaagggccaccgtttacggtgctttaatcattcgtcctagggaaggagaaccctaccctttccccaagcctaagcgcgagacacccattcttcttggggaatggtgggacgcaaaccctattgatgttgtgaggcaggccacacgaactgggggagccccaaacgtgtctgatgcatacactatcaatggtcaacctggtgatctttacaagtgctccagcaaagacaccaccattgtcccaatacatgccggcgagaccaaccttcttcgtgtaataaacgcagccttaaaccaacctctcttcttcaccgtcgcaaaccacaaactcacagtggttggtgccgacgcctcctacctcaaacccttcaccaccaaagtcctcatactgggccccgggcaaaccaccgacgtcttaatcaccggcgaccagccaccttcccgctactacatggcggcgcgtgcgtaccaatccgcccaaaacgctgccttcgacaacaccactacaaccgccatactcgaatacaaatcaccgaatcaccacaataagcattctcaccatcgtgccaaaggagtaaagaacaaaaccaaacctataatgcctccactccctgcttacaacgacacaaacgcagtcacttccttcagcaaaagcttcagaagccctagaaaagttgaagtacccactgaaattgaccagagcctcttcttcactgtgggtttaggtatcaagaagtgccccaaaaacttcggaccaaagaggtgtcagggacccattaatgggacgaggttcactgcgagcatgaacaacgtgtctttcgttctcccgaacaacgtgtccatcttgcaggctcaccacctcggaatccctggagtgttcaccactgattttccggggaagccgccggtgaagtttgattacaccggcaatgtgagccgttcgctgtggcaacctgttcccgggacaaaggcacacaagttggagtttgggtcgagggtgcagattgtgttgcaggatactagcattgtcactcctgagaaccaccctatccatcttcatgggtacgatttctacattgttgcagagggtttcgggaacttcgacccaaagaaagatacggcgaaattcaaccttgttgatccacctttgagaaacacagtggctgtgcctgtaaatggatgggcagttattcgatttgtggctgataacccaggtgcatggcttttgcattgtcacttggacgttcacattggatggggtttggctacggtgttgttggtggagaatggagttgggaagttgcaatccatagagcctcctcctgtggatcttcctctttgt

SEQ ID NO: 11280 - DNA, 1752 bp, Artificial sequence
  miR resistant mutant
atgaccacaactattccttcatcacattcattttttgtggcattcctctttgccaccagcttcctttggtcttttcccgaatttgctctcgctacttcaaagcatggaagtgtcacaaggcactacaagtttgatataaggctgagaaacattacgaggctgtgccacacgaagagcatggttaccgtgaacggaaagttccctgggcctagagttgttgcaagagaaggtgacagaatagtggtaaaggtggttaatcatgttcccaacaatgtcagcatacactggcatggagtgagacagcttcaaagtggatgggcagatggtccatcttacataactcaatgccccattcaaactggccagagttatgtgtacaacttcacaattgttggacaaagaggaaccctcttctggcatgctcacatttcatggttaagagccactctctatggacccctaatcctcctccctaggcgcaacgaatcttacccatttgagaaaccctacaaggaagttcccatcctctttggtgagtggtggaatgctgatccagaggctgttattgcacaagcccttcagacaggggctggcccaaatgtctctgatgcctacacttttaacggtcttcctggacccctctacaattgctccaacaacgacacgttcaggttaaaggtgaagccagggaagacatatcttcttagactaataaacgcagccttaaacgatgaactctttttcagcattgcaaaccacaccttggtaactgttgaagctgatgctacttacgttaaacctttcgagtcagagatcatcgtaatagggccaggacaaacctcaaactttctgttaaagacaaaacctgagtacccaaatgtcaatttcttgatgctagcaagaccatatttcactggcatgggaactttcgacaattccacagttgctggcattcttgagtacaagaaaccgcttgttgctccaaaaaacactattcccactttgaaaccctctcttccagccatcaatgacacttccttcgttgccaacttcagtagtaaattcctcagtttgaacactgacaagtaccctgcaaaggtgcctcaaaccgttgacaagagcttcttcttcacaattggacttggaacaagtccttgccccaaaaaccaaacatgccaaggaccaaacaacagttcaaagtttgcagcctcaatgaacaatatatccttcactcttccttccatagcacttcttcagcaacatttcttcggccaagctaataatggcatttacaccactgatttccctgccatgccactcatgccattcaactacacggggaccccaccgaacaacacaagggtcagtaatggaacaaagactgtggtgataccctttaacacaagggtgcaagtggtgctccaagacactagcattttgggagctgagagccaccctttgcaccttcatggctttaacttctatgttgtgggtcaaggctttgggaactttaatcctaacactgaccctccaaaattcaaccttgttgaccccgttgaaaggaacactgttggtgtgccctctggtggttgggttgcaatcagattccttgctgacaacccaggtgtttggctaatgcattgccattttgatgtccaccttagttgggggttgaggatggcttggattgttgaggatgggaagctacctaatcagaagttgcctcctccaccagctgatctccctaagtgt

SEQ ID NO: 11281 - DNA, 1752 bp, Artificial sequence
  miR resistant mutant
atgaccacaactattccttcatcacattcattttttgtggcattcctctttgccaccagcttcctttggtcttttcccgaatttgctctcgctacttcaaagcatggaagtgtcacaaggcactacaagtttgatataaggctgagaaacattacgaggctgtgccacacgaagagcatggttaccgtgaacggaaagttccctgggcctagagttgttgcaagagaaggtgacagaatagtggtaaaggtggttaatcatgttcccaacaatgtcagcatacactggcatggagtgagacagcttcaaagtggatgggcagatggtccatcttacataactcaatgccccattcaaactggccagagttatgtgtacaacttcacaattgttggacaaagaggaaccctcttctggcatgctcacatttcatggttaagagccactctctatggacccctaatcctcctccctaggcgcaacgaatcttacccatttgagaaaccctacaaggaagttcccatcctctttggtgagtggtggaatgctgatccagaggctgttattgcacaagcccttcagacaggggctggcccaaatgtctctgatgcctacacttttaacggtcttcctggacccctctacaattgctccaacaacgacacgttcaggttaaaggtgaagccagggaagacatatcttcttcgtctaataaacgcagccttaaacgatgaactctttttcagcattgcaaaccacaccttggtaactgttgaagctgatgctacttacgttaaacctttcgagtcagagatcatcgtaatagggccaggacaaacctcaaactttctgttaaagacaaaacctgagtacccaaatgtcaatttcttgatgctagcaagaccatatttcactggcatgggaactttcgacaattccacagttgctggcattcttgagtacaagaaaccgcttgttgctccaaaaaacactattcccactttgaaaccctctcttccagccatcaatgacacttccttcgttgccaacttcagtagtaaattcctcagtttgaacactgacaagtaccctgcaaaggtgcctcaaaccgttgacaagagcttcttcttcacaattggacttggaacaagtccttgccccaaaaaccaaacatgccaaggaccaaacaacagttcaaagtttgcagcctcaatgaacaatatatccttcactcttccttccatagcacttcttcagcaacatttcttcggccaagctaataatggcatttacaccactgatttccctgccatgccactcatgccattcaactacacggggaccccaccgaacaacacaagggtcagtaatggaacaaagactgtggtgataccctttaacacaagggtgcaagtggtgctccaagacactagcattttgggagctgagagccaccctttgcaccttcatggctttaacttctatgttgtgggtcaaggctttgggaactttaatcctaacactgaccctccaaaattcaaccttgttgaccccgttgaaaggaacactgttggtgtgccctctggtggttgggttgcaatcagattccttgctgacaacccaggtgtttggctaatgcattgccattttgatgtccaccttagttgggggttgaggatggcttggattgttgaggatgggaagctacctaatcagaagttgcctcctccaccagctgatctccctaagtgt

SEQ ID NO: 11282 - DNA, 1671 bp, Artificial sequence
  miR resistant mutant
atggattctcattgggttcgaatggtgcttctcattgcttgcattcttccagctttggttgaatgcagagtgaggcactacaaatttcatgtggtgtctaaacaaaccaatagattgtgttcaagcaaatctattgtcaccattaatgggaagttcccaggacccacactttacgctagggaagatgatacagtgctggtcaaagtcattaaccaagtcaaccacaacgttaccatccattggcatggtgtgaggcaattgagaactggttgggctgatggacctgcatatgtcacacagtgcccaattcaaccagggcaaacctatctgtacaatttcaccctcaccgggcaaagaggaacacttctttatcatgcacatgttaactggctaaggtcaactctccatggtgccttagttatcttgccaaagagaggtgtgccttatcccttcccaaagccagatgatgaattggttgtggtattaggagaatggtggaaatccgatactgaagctattatcaatgaagctctcaaatcaggattggcaccaaatgtctcagatgctcatactattaatggccttccaggggcagttaccaattgttctacacaagatgtttacaacctacccgtggagagtggaaagacctacctgttgcgcataataaacgcagccttaaacgaagagctcttcttcaaaattgctggccacaagctcacagtggtagaagttgatgccacatatgtaaagcccttcaagattgaaacaattttgatagcccctggtcaaaccaccaatgttcttttaaatgctgaccaaaaatttggcaagtacttggtagcagcttctcctttcatggatgctcctattgctgtggacaacttgactgccacagcaacattgcactacacaggaactcttgctgccactcccacaattctcaccaccccacctcccaaaaattctacacaaattgccaacaacttcatctcctctcttagaggccttaactccaagaaataccctgtcaatgtcccattaactgttgatcactcacttttcttcactgttgggttggggattagcccttgtccatcttgcaaagctgcaaatggaagcagggttgtggctgctatcaacaatgtgacatttattatgccaaccattgccttacttcaagcacattatttcaacataaaaggggtgttcaccactgatttccctgccaatccaccccatttgttcaactactcaggtcctggaccagccaatttgaacaccgaaactggcacaaaggtttatcgggtaccattcaatgccacagttcaggttgtgctgcaagatactggaatcattgcacctgagaaccacccagttcatcttcatgggttcaatttctttgttgttggaagaggagtaggaaatttcaaccccaaaattgaccctaagaactttaaccttgttgatcctgttgaaaggaacactattggagtaccagctggagggtggactgcatttagatttagagcagataatccaggagtttggttcatgcactgccacttggaggtacacacaacatgggggctaaagatggcctttttggtggacaatggcaaaggtccaaagcaatcagtgataccaccacctaaagatcttcccaaatgc

SEQ ID NO: 11283 - DNA, 1671 bp, Artificial sequence
  miR resistant mutant
atggattctcattgggttcgaatggtgcttctcattgcttgcattcttccagctttggttgaatgcagagtgaggcactacaaatttcatgtggtgtctaaacaaaccaatagattgtgttcaagcaaatctattgtcaccattaatgggaagttcccaggacccacactttacgctagggaagatgatacagtgctggtcaaagtcattaaccaagtcaaccacaacgttaccatccattggcatggtgtgaggcaattgagaactggttgggctgatggacctgcatatgtcacacagtgcccaattcaaccagggcaaacctatctgtacaatttcaccctcaccgggcaaagaggaacacttctttatcatgcacatgttaactggctaaggtcaactctccatggtgccttagttatcttgccaaagagaggtgtgccttatcccttcccaaagccagatgatgaattggttgtggtattaggagaatggtggaaatccgatactgaagctattatcaatgaagctctcaaatcaggattggcaccaaatgtctcagatgctcatactattaatggccttccaggggcagttaccaattgttctacacaagatgtttacaacctacccgtggagagtggaaagacctacctgttgcgcattattaacgcagccttaaacgaagagctcttcttcaaaattgctggccacaagctcacagtggtagaagttgatgccacatatgtaaagcccttcaagattgaaacaattttgatagcccctggtcaaaccaccaatgttcttttaaatgctgaccaaaaatttggcaagtacttggtagcagcttctcctttcatggatgctcctattgctgtggacaacttgactgccacagcaacattgcactacacaggaactcttgctgccactcccacaattctcaccaccccacctcccaaaaattctacacaaattgccaacaacttcatctcctctcttagaggccttaactccaagaaataccctgtcaatgtcccattaactgttgatcactcacttttcttcactgttgggttggggattagcccttgtccatcttgcaaagctgcaaatggaagcagggttgtggctgctatcaacaatgtgacatttattatgccaaccattgccttacttcaagcacattatttcaacataaaaggggtgttcaccactgatttccctgccaatccaccccatttgttcaactactcaggtcctggaccagccaatttgaacaccgaaactggcacaaaggtttatcgggtaccattcaatgccacagttcaggttgtgctgcaagatactggaatcattgcacctgagaaccacccagttcatcttcatgggttcaatttctttgttgttggaagaggagtaggaaatttcaaccccaaaattgaccctaagaactttaaccttgttgatcctgttgaaaggaacactattggagtaccagctggagggtggactgcatttagatttagagcagataatccaggagtttggttcatgcactgccacttggaggtacacacaacatgggggctaaagatggcctttttggtggacaatggcaaaggtccaaagcaatcagtgataccaccacctaaagatcttcccaaatgc

SEQ ID NO: 11284 - DNA, 2778 bp, Artificial sequence
  miR resistant mutant
atggcttcaagattctggacccagggtggaagtgattccgaggaggaggagagtgattatgatgaggaggttgataccacagtgggtgaagcttctggtcaagcagtgacaagcaggtacctgcaggataatgcaagtgacagtgatgactctgatggccaaaagcgcgttgtgaggtctgcaaaagataagcgttttgaggagatggcttccactgtcgaccagatgaagaatgccatgaagatcaatgattgggtgagcttgcaagagagttttgacaagattaacaaacagcttgagaaggtcatgcgtgtcactgagtctgaaagggtccccaatctttacatcaaggctctcgtgatgttggaagatttcttggctcaggctttggctaataaggatgccaagaagaaaatgagcagtagcaatgctaaagccttgaactcaatgaagcagaagctgaagaagaataataagcagtatgaggacttgattaataagtgcagggagaaccctgagagcgaggaggaaaaagaagaagaggagagcgatgaagagtatgacagtgatggtgagattattgatccggatcagcttcaaaaacccgaagcaaaatctgattcggaagcctctcaatatgaagatgaaaagccagatgctggtgaaggtccttgggaccaaaagcttagcaagaaggacaggcttttggatagacagttcatgaaaaaccctagtgagatcacgtgggatgcggttaacaagaagtttaaagaggttgtggctgccaggggaagaaagggaactggtaggtttgaacaggttgagcagctcaccttcttaacaaaagttgctaagacacctgcacagaagctggaaattctgttcagtgtggtttctgctcagtttgatgttaatccgggcctcaatgggcatatgcccatcaatgtatggaaaaaatgtgtacagaacatgctgatcattcttgatattttggtgcagtacccaaacataatggttgatgattccgtggaaccggatgagaatgaaactcagaaaggtgctgaacataatggaacaattcgggtttggggtaacttagttgcttttttagaaagaattgatgtcgagtttttcaagagcctgcaatgtatcgacccacacacaagagactatgttgagagacttagggatgagcccacgtttctggttcttgcccagaatgtccaggaatatcttgaaagagttggaaatttcaaagccgcttctaaggttgccttgaggagggttgagctcatttactacaaaccccaagaggtttatgatgccatgagaaaattgactgaattgacagaagatggagataatggaggggaggcaagtgagaaggaatttgaggaatcaaggattcctactgcatttgtagttaccccagaggttgttacacggaaacccaccttccctgagaatagcaggaccctaatggatatattggtatctatgatatacaaatatggagatgagcgaactaaagcacgtgcaatgctctgtgatatatatcatcatgctcttcttgatgagttttcaatagcccgtgatctgcttcttatgagccatttgcaagacagtgttcagcatatggacatttcaacgcagatactttttaacagggccatgtcacagttaggtttatgtgcttttcgggttggactgatttctgaagcacatggctgtctgtctgaactctactctggtggaagggtgaaggagttgctggcacaaggcgtttcacaaagtcgttatcatgagaagactcctgaacaggaaaggttggaaagaagacgacagatgccgtatcatatgcacatcaatctagagctcctagaggcagtacatctcgtatctgctatgctgctggaagtgcccaatatggcagccaatgttcatgatgccaaacggaaggtcattagtaagactttccgtcgcttgcttgaggtaagtgagaaacaaacatttactggtccaccggaaaatgtcagagatcatgttatggctgccacaaggattcttcgcaagggagacttccagaaggcttttgacattattgtgtctcttgatgtatggaaatttgtgagaaatcgagacacggtacttgaaatgctaaaggacaaaatcaaggaggaggcattgaggacatacctctttaccttttcttcatcttatgaatcgttgagcctggatcagctcacaaaattttttgatctctctgtttcgcgcactcatagcattgtcagtaggatgatgatcaatgaggagcttcatgcaagctgggaccagccaactgggtgcattcttttccaagatgtcgaacactccaggctgcaggcattggtattccaattgacagagaaattatctgtccttgcagagagtaatgaaaaagcaacagaggccagggtaggtggtggtggattggatctgcctctaaggcggagagatggccaggactatgctgccgccgctgctgccggcagtggaacagcctctacaggtggtaggtggcaagacctgtccccttctcagccaaggcaaggcagtgggcgtgcagggtatggtggaagaccaatgacattaggccaagcagctgggagtggctattcaaggggacgaggaagaggttcgtatggaggttcagggaggacttctcaaaggggttcagcattgaggggaccccagggcgatggacctgctcgcatggttagccttaagggagttcgtgct

SEQ ID NO: 11285 - DNA, 2778 bp, Artificial sequence
  miR resistant mutant
atggcttcaagattctggacccagggtggaagtgattccgaggaggaggagagtgattatgatgaggaggttgataccacagtgggtgaagcttctggtcaagcagtgacaagcaggtacctgcaggataatgcaagtgacagtgatgactctgatggccaaaagcgcgttgtgaggtctgcaaaagataagcgttttgaggagatggcttccactgtcgaccagatgaagaatgccatgaagatcaatgattgggtgagcttgcaagagagttttgacaagattaacaaacagcttgagaaggtcatgcgtgtcactgagtctgaaagggtccccaatctttacatcaaggctctcgtgatgttggaagatttcttggctcaggctttggctaataaggatgccaagaagaaaatgagcagtagcaatgctaaagccttgaactcaatgaagcagaagctgaagaagaataataagcagtatgaggacttgattaataagtgcagggagaaccctgagagcgaggaggaaaaagaagaagaggagagcgatgaagagtatgacagtgatggtgagattattgatccggatcagcttcaaaaacccgaagcaaaatctgattcggaagcctctcaatatgaagatgaaaagccagatgctggtgaaggtccttgggaccaaaagcttagcaagaaggacaggcttttggatagacagttcatgaaaaaccctagtgagatcacgtgggatgcggttaacaagaagtttaaagaggttgtggctgccaggggaagaaagggaactggtaggtttgaacaggttgagcagctcaccttcttaacaaaagttgctaagacacctgcacagaagctggaaattctgttcagtgtggtttctgctcagtttgatgttaatccgggcctcaatgggcatatgcccatcaatgtatggaaaaaatgtgtacagaacatgctgatcattcttgatattttggtgcagtacccaaacataatggttgatgattccgtggaaccggatgagaatgaaactcagaaaggtgctgaacataatggaacaattcgggtttggggtaacttagttgcttttttagaaagaattgatgtcgagtttttcaagagcctgcaatgcatcgacccacacacaagagactatgttgagagacttagggatgagcccacgtttctggttcttgcccagaatgtccaggaatatcttgaaagagttggaaatttcaaagccgcttctaaggttgccttgaggagggttgagctcatttactacaaaccccaagaggtttatgatgccatgagaaaattgactgaattgacagaagatggagataatggaggggaggcaagtgagaaggaatttgaggaatcaaggattcctactgcatttgtagttaccccagaggttgttacacggaaacccaccttccctgagaatagcaggaccctaatggatatattggtatctatgatatacaaatatggagatgagcgaactaaagcacgtgcaatgctctgtgatatatatcatcatgctcttcttgatgagttttcaatagcccgtgatctgcttcttatgagccatttgcaagacagtgttcagcatatggacatttcaacgcagatactttttaacagggccatgtcacagttaggtttatgtgcttttcgggttggactgatttctgaagcacatggctgtctgtctgaactctactctggtggaagggtgaaggagttgctggcacaaggcgtttcacaaagtcgttatcatgagaagactcctgaacaggaaaggttggaaagaagacgacagatgccgtatcatatgcacatcaatctagagctcctagaggcagtacatctcgtatctgctatgctgctggaagtgcccaatatggcagccaatgttcatgatgccaaacggaaggtcattagtaagactttccgtcgcttgcttgaggtaagtgagaaacaaacatttactggtccaccggaaaatgtcagagatcatgttatggctgccacaaggattcttcgcaagggagacttccagaaggcttttgacattattgtgtctcttgatgtatggaaatttgtgagaaatcgagacacggtacttgaaatgctaaaggacaaaatcaaggaggaggcattgaggacatacctctttaccttttcttcatcttatgaatcgttgagcctggatcagctcacaaaattttttgatctctctgtttcgcgcactcatagcattgtcagtaggatgatgatcaatgaggagcttcatgcaagctgggaccagccaactgggtgcattcttttccaagatgtcgaacactccaggctgcaggcattggtattccaattgacagagaaattatctgtccttgcagagagtaatgaaaaagcaacagaggccagggtaggtggtggtggattggatctgcctctaaggcggagagatggccaggactatgctgccgccgctgctgccggcagtggaacagcctctacaggtggtaggtggcaagacctgtccccttctcagccaaggcaaggcagtgggcgtgcagggtatggtggaagaccaatgacattaggccaagcagctgggagtggctattcaaggggacgaggaagaggttcgtatggaggttcagggaggacttctcaaaggggttcagcattgaggggaccccagggcgatggacctgctcgcatggttagccttaagggagttcgtgct

SEQ ID NO: 11286 - DNA, 1137 bp, Artificial sequence
  miR resistant mutant
atgtctacagctggtcaggtcatcaagtgcagagctgcggtggcatgggaagcagggaagccactatcgatagaaaccatagaagtggcaccaccccagaaaggtgaagtgcgtttgaagatattatttaatagtttatgtcgtacagatgtttactggtgggatgctaagggccagactccgctgtttcctcgtatcttaggccacgaagcttcggggattgtggagagcgtgggcaagggtgtgacacatctgaaaccaggtgaccatgctctcccaatattcactggggagtgtggtgaatgcacctattgcaagtctgaagagagcaacctgtgtgagcttctcaggatcaacactgacagaggagtgatgctcagtgatggcaaaacaaggttctccaaaaatggacaacctatttaccacttcgttggaacctccactttcagtgaatacactgttctccatgaaggatgtgtcgccaagatcaaccctgctgcccctcttgacaaagttgctgttgtcagttgtggattctgcacaggttttggggctactgtgaatgttgcaaagccaaagcctaataatactgttgctgtatttggattaggagctgttggtcttgctgcctgtgaaggggcaagggtttctggtgcatctagaatcatcggggttgatttacttaccaatcgatttgaacaagccaaacaatttggggtcactgattttgtgaacccgaaagatcacaacaaaccagttcaagaggtcattgctgaaatgactaatggaggagtagatcgtgctattgaatgcacaggaagcatccaagcatcaatctcggcatttgaatgcactcatgatggttggggtactgctgtccttgttagtgtgccaaagaaggatgcagaattcaaaactcatcctatgaagttcatggaagggagaactcttaagggtaccttctatggtcactatagaccccgcactgacattcctggtgttgtggagaagtacctcaacaaggagctggagctggacaaatttatcactcactctgtcccattctcagagatcaacactgcatttgatcttatgctgaaaggggagggaataaggtgcctcatctgcatggaagag

SEQ ID NO: 11287 - DNA, 1137 bp, Artificial sequence
  miR resistant mutant
atgtctacagctggtcaggtcatcaagtgcagagctgcggtggcatgggaagcagggaagccactatcgatagaaaccatagaagtggcaccaccccagaaaggtgaagtgcgtttgaagatattatttaacagtttatgtcgtacagatgtttactggtgggatgctaagggccagactccgctgtttcctcgtatcttaggccacgaagcttcggggattgtggagagcgtgggcaagggtgtgacacatctgaaaccaggtgaccatgctctcccaatattcactggggagtgtggtgaatgcacctattgcaagtctgaagagagcaacctgtgtgagcttctcaggatcaacactgacagaggagtgatgctcagtgatggcaaaacaaggttctccaaaaatggacaacctatttaccacttcgttggaacctccactttcagtgaatacactgttctccatgaaggatgtgtcgccaagatcaaccctgctgcccctcttgacaaagttgctgttgtcagttgtggattctgcacaggttttggggctactgtgaatgttgcaaagccaaagcctaataatactgttgctgtatttggattaggagctgttggtcttgctgcctgtgaaggggcaagggtttctggtgcatctagaatcatcggggttgatttacttaccaatcgatttgaacaagccaaacaatttggggtcactgattttgtgaacccgaaagatcacaacaaaccagttcaagaggtcattgctgaaatgactaatggaggagtagatcgtgctattgaatgcacaggaagcatccaagcatcaatctcggcatttgaatgcactcatgatggttggggtactgctgtccttgttagtgtgccaaagaaggatgcagaattcaaaactcatcctatgaagttcatggaagggagaactcttaagggtaccttctatggtcactatagaccccgcactgacattcctggtgttgtggagaagtacctcaacaaggagctggagctggacaaatttatcactcactctgtcccattctcagagatcaacactgcatttgatcttatgctgaaaggggagggaataaggtgcctcatctgcatggaagag

SEQ ID NO: 11288 - DNA, 1038 bp, Artificial sequence
  miR resistant mutant
atgttgcggataacgagattctcggggtttttctccgccgcaatgttcgtgactgttcttgttattctctccccctccttccaatccgaagccattcgatcctcccaccgattttccttccggaaagcccctcctttccgcaatgccgccgaatgcgcttctgtttccggccaaaccaccaccgtctgcgacccttccttggtccacgtggccataaccctcgacgtcgactacctccgcggctcaatcgccgccgtgcactccatattacataatagtttatgcccggagaacatcttcttccatttcctcgtctccgacaccaacctccaaaccctagttgagtccacgttcccaaacctgaaattcaacgtctatttcttcgatccgaacatcgtcgctcacttgatctcctcctccgtgcggcaggcgctggagcagcctctcaattacgcgagaaattacctcgttgaccttctggagagttgcgtggagagggtgatttacttggactccgatctggtggtagtggatgacgtggcgaaactgtggagcgcgagtctggactcgcgtgccatcggcgcgccggagtactgccacgcgaacttcaccaagtatttcacggcggggttctggtctgagtcgaggttgtcggggacgttcgcgcagcggagggcgtgctacttcaacacgggggtgatggtgatggatctggtgaagtggaggaaggaaggatacacgaagagaattgagcgttggatggagattcagaagagtgataggatctatgagcttggttctctgccgccgtttttgctggtgttcgcgggacacgtggcacctattgagcaccggtggaaccagcacggtttgggcggggataacgtgaagggtagttgccgtgacttgcaccctggtccggttagtttgttgcattggtccggtagcggtaagccatggctccgtttaagctccaaacggccttgccctctggattctctatgggctccttttgacttgtatacacacccatcgtct

SEQ ID NO: 11289 - DNA, 1038 bp, Artificial sequence
  miR resistant mutant
atgttgcggataacgagattctcggggtttttctccgccgcaatgttcgtgactgttcttgttattctctccccctccttccaatccgaagccattcgatcctcccaccgattttccttccggaaagcccctcctttccgcaatgccgccgaatgcgcttctgtttccggccaaaccaccaccgtctgcgacccttccttggtccacgtggccataaccctcgacgtcgactacctccgcggctcaatcgccgccgtgcactccatactccataatagtctctgcccggagaacatcttcttccatttcctcgtctccgacaccaacctccaaaccctagttgagtccacgttcccaaacctgaaattcaacgtctatttcttcgatccgaacatcgtcgctcacttgatctcctcctccgtgcggcaggcgctggagcagcctctcaattacgcgagaaattacctcgttgaccttctggagagttgcgtggagagggtgatttacttggactccgatctggtggtagtggatgacgtggcgaaactgtggagcgcgagtctggactcgcgtgccatcggcgcgccggagtactgccacgcgaacttcaccaagtatttcacggcggggttctggtctgagtcgaggttgtcggggacgttcgcgcagcggagggcgtgctacttcaacacgggggtgatggtgatggatctggtgaagtggaggaaggaaggatacacgaagagaattgagcgttggatggagattcagaagagtgataggatctatgagcttggttctctgccgccgtttttgctggtgttcgcgggacacgtggcacctattgagcaccggtggaaccagcacggtttgggcggggataacgtgaagggtagttgccgtgacttgcaccctggtccggttagtttgttgcattggtccggtagcggtaagccatggctccgtttaagctccaaacggccttgccctctggattctctatgggctccttttgacttgtatacacacccatcgtct

SEQ ID NO: 11290 - DNA, 2472 bp, Artificial sequence
  miR resistant mutant
atggttctaataccttccgtgtgtcaaagtgattcaactacagctgtttacattgttactctgagacaagctcctgcttctcactatcatcatcatgagttaatcacagtgggcaacaactctaaacatggttcatctgggagaagaagaactagagttcacaaacaaagacatcagaatgtttcaaagccagttatgaaacgtggttcgtactttgcccgagttcacgactcattgttgaataaagtgtttaatggggagaaatatctgaagctctatagctatcattacttgattaatggatttgctgtgctggttacccaacaacaggcagaaaaactttcaaggagaagagaagtgtccaatgtggctttggatttttctgtgagaactgcaaccacacacactccacaatttttgggtctgccacagggagcttggttgcaagcaggtgggtttgaaactgctggagaaggaatcgctattgggtttgttgacactggcattgatcctacacaccctagttttgcagatgataaatctgaacatccattccccgttcctgctcatttctctggcgcctgtgaggttacgccagattttccgtccggttcttgcaataggaagcttgttggggctagacattttgccgcttctgctataaccagaggaatatttaactcatcccaggactatgcttctccctttgatggcgatggccacggcacgcacacagcttctgttgcagccggaaaccatggaattccagtgattgttgctggccaagtttttggaaatgctagtgggatggctcctcattcacacattgccatttacaaggcactatacaagagatttggaggatttgcagcagatgttgttgcagctattgaccaggcagctcaggatggggttgacataatatgcttgtcaatcactcctaataggcgtccttctggcatcgcaactttcttcaatccaatagatatggcattgctatcagctgtgaaagctggtatttttgtagtgcaagctgctggcaatactggaccatcacctatgagcatgtcctccttcagtccatggatttttactgttggtgccacctctcatgatcgagtttatagcaactccctatgtcttggaaataatgtgaccatacctggtgttggacttgcacctggaacatatgagaacacgatgtttaaactgattcatgcaagacatgctttgaacaaaaacacaacagttactgatgatatgtatattggtgagtgtcaagatgcaagtaagttcagtcaggatttggtccagggcaacctcctgatctgtagctattcagtccgatttgtgcttgggctctccaccattcaacaggcattagaaacagccatgaaccttagtgcagttggtgttgttttctccatggacctttttgtgactgcttttcagcttaacccagttcctatgaaaatgcctggcataataattccatctgcaaatgattccaagatattactgcaatactacaattcttcactgcaaatagatggggattcaaataaaattgttaaatttggggctgttgctagcattggtggtggattagaagccaactacaataatgaggccccaaaggttgtgtattactctgccagaggaccagatccagaggacagtcttcctcatgaagctgacattatgaaacccaatttggtagctcctggaaattttatatgggctgcttggagttctgttgccactgattctgttgaatttctaggcgagaattttgcaatgatgtctggcacaagcatggctgcacctcatgttgctggtcttgctgcactaattaagcaacagtttcccaattttagtcctgcagccattggatctgcactatccactacagcttctctgtatgacaacaatgggaggccaataatggctcagcgatcatatccctccatagaccaaaacttgagccccgccacaccattcgatatgggaagtggttttgtgaatgctactgcagcattaaatccgggattgctttttgattctagctatgatgactacatgtcattcctatgtggtatcaatggttcaactcctacagtgctaaactacaccggtcaaaattgctggacttataattcaacactatatggccctgatctgaacttgccctcaatcacaatagcaaggttgaaccaatctagagtggtacaaagaataatccaaaacattgctggaaatgaaacatacaatgttggttggagtgctccatatggcacttctatgaaagtatctcctaattatttctctcttgcaagtggggagagacttgtcttgtctgtgatcttcaatgtaaccaacaacagttctgctgctagctatgggagaattgggctgtatggtaatcaaggtcacgttgtcaacattcctgtggcagtcatttttaaaatctta

SEQ ID NO: 11291 - DNA, 2472 bp, Artificial sequence
  miR resistant mutant
atggttctaataccttccgtgtgtcaaagtgattcaactacagctgtttacattgttactctgagacaagctcctgcttctcactatcatcatcatgagttaatcacagtgggcaacaactctaaacatggttcatctgggagaagaagaactagagttcacaaacaaagacatcagaatgtttcaaagccagttatgaaacgtggttcgtactttgcccgagttcacgactcattgttgaataaagtgtttaatggggagaaatatctgaagctctatagctatcattacttgattaatggatttgctgtgctggttacccaacaacaggcagaaaaactttcaaggagaagagaagtgtccaatgtggctttggatttttctgtgagaactgcaaccacacacactccacaatttttgggtctgccacagggagcttggttgcaagcaggtgggtttgaaactgctggagaaggaatcgctattgggtttgttgacactggcattgatcctacacaccctagttttgcagatgataaatctgaacatccattccccgttcctgctcatttctctggcgcctgtgaggttacgccagattttccgtccggttcttgcaataggaagcttgttggggctagacattttgccgcttctgctataaccagaggaatatttaactcatcccaggactatgcttctccctttgatggcgatggccacggcacgcacacagcttctgttgcagccggaaaccatggaattccagtgattgttgctggccaagtttttggaaatgctagtgggatggctcctcattcacacattgccatttacaaggcactatacaagagatttggaggatttgcagcagatgttgttgcagctattgaccaggcagctcaggatggggttgacataatatgcttgtcaatcactcctaataggcgtccttctggcatcgcaactttcttcaatccaatagatatggcattgctatcagctgtgaaagctggtatttttgtagtgcaagctgctggcaatactggaccatcacctatgagcatgtcctccttcagtccatggatttttactgttggtgccacctctcatgatcgagtttatagcaactccctatgtcttggaaataatgtgaccatacctggtgttggacttgcacctggaacatatgagaacacgatgtttaaactgattcatgcaagacatgctttgaacaaaaacacaacagttactgatgatatgtatattggtgagtgtcaagatgcaagtaagttcagtcaggatttggtccagggcaacctcctgatctgtagctattcagtccgatttgtgcttgggctctccaccattcaacaggcattagaaacagccatgaaccttagtgcagttggtgttgttttctccatggacctttttgtgactgcttttcagcttaacccagttcctatgaaaatgcctggcataataattccatctgcaaatgattccaagatattactgcaatactacaattcttcactgcaaatagatggggattcaaataaaattgttaaatttggggctgttgctagcattggtggtggattagaagccaactacaataatgaggccccaaaggttgtgtattactctgccagaggaccagatccagaggacagtcttcctcatgaagctgacattatgaaacccaatttggtagctcctggaaattttatatgggctgcttggagttctgttgccactgattctgttgaatttctaggcgagaattttgcaatgatgtctggcacaagcatggctgcacctcatgttgctggtcttgctgcactaattaagcaacagtttcccaattttagtcctgcagccattggatctgcactatccactacagcttctctgtatgacaacaatgggaggccaataatggctcagcgatcatatccctccatagaccaaaacctaagccccgccacaccattcgatatgggaagtggttttgtgaatgctactgcagcattaaatccgggattgctttttgattctagctatgatgactacatgtcattcctatgtggtatcaatggttcaactcctacagtgctaaactacaccggtcaaaattgctggacttataattcaacactatatggccctgatctgaacttgccctcaatcacaatagcaaggttgaaccaatctagagtggtacaaagaataatccaaaacattgctggaaatgaaacatacaatgttggttggagtgctccatatggcacttctatgaaagtatctcctaattatttctctcttgcaagtggggagagacttgtcttgtctgtgatcttcaatgtaaccaacaacagttctgctgctagctatgggagaattgggctgtatggtaatcaaggtcacgttgtcaacattcctgtggcagtcatttttaaaatctta

SEQ ID NO: 11292 - DNA, 1113 bp, Artificial sequence
  miR resistant mutant
atgcgtgcagctgcggtggcatgggaagcagggaagccactgtcaatagaaaccatagaagtggcaccaccccagaaaggtgaagtgcgtttgaggatattatttaatagtttatgtcgtagtgatgtttattggtgggatgctaaggaccagactcctctgtttcctcgtatcttaggccacgaagcttcagggattgtggagagcgtgggcgagggtgtgacacatctgaaaccaggtgaccatgcactcccaatattcactggggagtgtggtgaatgcacttattgtaagtctgaagagagcaacctgtgtgagctactcaggatcaacactgacaggggtgttatgctgagtgatggaaaaacaaggttctccaaaaatggccaacccatttaccacttcgttggaacctccactttcagtgaatacactgttctccatgaaggatgtgtagccaagattaaccctaatgccccacttgacaaagttgctattgtcagctgtggattctgcacaggttttggggctactgtgaatgttgcaaaaccaaagcctaataatactgttgctgtctttggcttaggagctgttggtcttgctgcctgtgaaggggcaagggtttctggtgcatctagaatcatcggggttgatttacttcccaatcgatttgaacaagccaaaaaatttggggtcactgattttgtaaacccgaaagatcacaacaaaccagtccaagaggtcattgctgaaatgactaatggaggagtagatcgtgctattgaatgcactggaagcatccaagcttcaatctcagcatttgaatgcactcatgatggttggggtactgctgtccttgttggtgtgccaaagaaggatgttgaattcaaaactaatcctatgaagttcatggaagggagaactcttaagggtaccttctatggtcactacagaccccgcactgacattcctggtgttgtggagaagtacctcaacaaggagttggaactagacaaatttatcactcactctgtgccattctcaaagatcaacactgcatttgatcttatgctgaaaggggagggcataaggtgcctcatctgcatggaagag

SEQ ID NO: 11293 - DNA, 1113 bp, Artificial sequence
  miR resistant mutant
atgcgtgcagctgcggtggcatgggaagcagggaagccactgtcaatagaaaccatagaagtggcaccaccccagaaaggtgaagtgcgtttgaggatattatttaacagtttatgtcgtagtgatgtttattggtgggatgctaaggaccagactcctctgtttcctcgtatcttaggccacgaagcttcagggattgtggagagcgtgggcgagggtgtgacacatctgaaaccaggtgaccatgcactcccaatattcactggggagtgtggtgaatgcacttattgtaagtctgaagagagcaacctgtgtgagctactcaggatcaacactgacaggggtgttatgctgagtgatggaaaaacaaggttctccaaaaatggccaacccatttaccacttcgttggaacctccactttcagtgaatacactgttctccatgaaggatgtgtagccaagattaaccctaatgccccacttgacaaagttgctattgtcagctgtggattctgcacaggttttggggctactgtgaatgttgcaaaaccaaagcctaataatactgttgctgtctttggcttaggagctgttggtcttgctgcctgtgaaggggcaagggtttctggtgcatctagaatcatcggggttgatttacttcccaatcgatttgaacaagccaaaaaatttggggtcactgattttgtaaacccgaaagatcacaacaaaccagtccaagaggtcattgctgaaatgactaatggaggagtagatcgtgctattgaatgcactggaagcatccaagcttcaatctcagcatttgaatgcactcatgatggttggggtactgctgtccttgttggtgtgccaaagaaggatgttgaattcaaaactaatcctatgaagttcatggaagggagaactcttaagggtaccttctatggtcactacagaccccgcactgacattcctggtgttgtggagaagtacctcaacaaggagttggaactagacaaatttatcactcactctgtgccattctcaaagatcaacactgcatttgatcttatgctgaaaggggagggcataaggtgcctcatctgcatggaagag

SEQ ID NO: 11294 - DNA, 2472 bp, Artificial sequence
  miR resistant mutant
atggttctaataccttcctcgtgtcaaagtgatgcaactacaactgtgtacattgttactctgagacaagctcctgcttctcactatcatcaacatgagttgatcacagtgggcaacaactctagacatggttcatctgggagaagaagaactagagttcacaaaccaagacatcagaatgttacaaagccagataggaaacgtggttcatacttttcccgagttcacgactcgttgttgaataaagtgtttaatggggagaaatatctgaagctctatagctaccattatttgattaatggatttgctgtgctggttacccaacaacaggcagaaaaactgtcaaggagaagagaagtgtccaatgtggttttggatttttctgtgaggactgcaaccacacacactccacaatttttgggtctgccacagggagcttggtcgcaagcaggtgggtttgaaactgctggagaaggaatcaccattgggtttgttgacactggcattgatcctacacatcctagttttgctgacgataaatctgaacatccattccccgttcctgctcatttctctggcatctgcgaggttactccggattttccgtcccgttcttgcaataggaagcttgttggggctagacattttgctgcttctgctataaccagaggaatatttaactcatctcaggactatgcttctccctttgatggcgatggccacggcacgcatacagcttctgttgcagctggaaaccatggaattccagtggtcgttgctgggcaattttttggaaatgctagtgggatggctcctcattcacacattgccatttacaaggcactatacaagagatttggaggatttgcagcggatgttgttgcagctattgaccaggcagctcaggatagggttgacataatatgcttgtcaatcactcctaataggcgtccttctggtattgcaactttcttcaatccaatagatatggcattgctatcagctgcgaaagctggtatttttgtagtgcaagctgctggcaatactggaccatcacctatgagcatgtcctccttcagtccatggatctttactgttggtgccacctctcatgatcgagtttatatcaactccctatgtcttggaaataatgtgactatacctggtgttggacttgcacctggcacatacgagaacacattgtttaaattgattcatgcaagacatgctttgaacaaaaacacaacagttactgatgatatgtatattggtgagtgtcaagattcaagtaagttcagtcaggatttggtccagggcaacctcctgatctgtagctattcagtccaatttgtgcttgggctctccaccattcagcaggccttagaaacagccatgaatcttagtgcagttggtgttgttttctccatggatccttttgtgacttcttttcagcttaacccagttccaatgaaaatgcctggcataataattccatctgcaaatgattccaagatattactgcaatactacaattcttcactgcaaatagatggggattcaaataaaattgttaaatttggggctgttgctagtattggtggtggattagaagcgaactgcaataatgaggccccaatggttgtgtattactctgccagaggaccagatccagaggacagtcttcctcatgaagctgacattatgaaacccaatttggtagctcctggaaattttatatgggctgcttggagttctgttgccactgattctgttgaatttctaggtgagaattttgcaatgatgtctggcacaagcatggctgcacctcatgttgctggtcttgctgcactagttaagcaaaagtttcccaactttagtcctgcagccattggatctgcactttccactacagcttctctgtatgacaacaataggaggccgataatggctcagcgatcctatccctccatagaccttaacttgagccccgccacaccattcgatatgggaagtggttttgtgaatgcaactgcagcattaaatccaggattgctttttgattctggttatgatgattacatgtcattcctatgtggtatcaacggttcaactcctacagtgctaaactacactggtcaaaattgctggacttataattcaacactatatggccctgatctgaacttgccctcaatcacaatagcaaggttgaaccaatctagagtagtacaaagaacaatccaaaacattgctggaaatgaaacttacaatgttggttggagtgctccatatggaacttctatgaaagtgtttcctaatcacttctctcttgccagtggggagagactagtcttgtctgtgatcttcaatgcaaccagcaacagttctgctgccagctatgggagaattgggctgtatggtaatcaaggtcatgttgtcaacattcctgtggcagtcatttttaaaatctta

SEQ ID NO: 11295 - DNA, 2472 bp, Artificial sequence
  miR resistant mutant
atggttctaataccttcctcgtgtcaaagtgatgcaactacaactgtgtacattgttactctgagacaagctcctgcttctcactatcatcaacatgagttgatcacagtgggcaacaactctagacatggttcatctgggagaagaagaactagagttcacaaaccaagacatcagaatgttacaaagccagataggaaacgtggttcatacttttcccgagttcacgactcgttgttgaataaagtgtttaatggggagaaatatctgaagctctatagctaccattatttgattaatggatttgctgtgctggttacccaacaacaggcagaaaaactgtcaaggagaagagaagtgtccaatgtggttttggatttttctgtgaggactgcaaccacacacactccacaatttttgggtctgccacagggagcttggtcgcaagcaggtgggtttgaaactgctggagaaggaatcaccattgggtttgttgacactggcattgatcctacacatcctagttttgctgacgataaatctgaacatccattccccgttcctgctcatttctctggcatctgcgaggttactccggattttccgtcccgttcttgcaataggaagcttgttggggctagacattttgctgcttctgctataaccagaggaatatttaactcatctcaggactatgcttctccctttgatggcgatggccacggcacgcatacagcttctgttgcagctggaaaccatggaattccagtggtcgttgctgggcaattttttggaaatgctagtgggatggctcctcattcacacattgccatttacaaggcactatacaagagatttggaggatttgcagcggatgttgttgcagctattgaccaggcagctcaggatagggttgacataatatgcttgtcaatcactcctaataggcgtccttctggtattgcaactttcttcaatccaatagatatggcattgctatcagctgcgaaagctggtatttttgtagtgcaagctgctggcaatactggaccatcacctatgagcatgtcctccttcagtccatggatctttactgttggtgccacctctcatgatcgagtttatatcaactccctatgtcttggaaataatgtgactatacctggtgttggacttgcacctggcacatacgagaacacattgtttaaattgattcatgcaagacatgctttgaacaaaaacacaacagttactgatgatatgtatattggtgagtgtcaagattcaagtaagttcagtcaggatttggtccagggcaacctcctgatctgtagctattcagtccaatttgtgcttgggctctccaccattcagcaggccttagaaacagccatgaatcttagtgcagttggtgttgttttctccatggatccttttgtgacttcttttcagcttaacccagttccaatgaaaatgcctggcataataattccatctgcaaatgattccaagatattactgcaatactacaattcttcactgcaaatagatggggattcaaataaaattgttaaatttggggctgttgctagtattggtggtggattagaagcgaactgcaataatgaggccccaatggttgtgtattactctgccagaggaccagatccagaggacagtcttcctcatgaagctgacattatgaaacccaatttggtagctcctggaaattttatatgggctgcttggagttctgttgccactgattctgttgaatttctaggtgagaattttgcaatgatgtctggcacaagcatggctgcacctcatgttgctggtcttgctgcactagttaagcaaaagtttcccaactttagtcctgcagccattggatctgcactttccactacagcttctctgtatgacaacaataggaggccgataatggctcagcgatcctatccctccatagaccttaacctaagccccgccacaccattcgatatgggaagtggttttgtgaatgcaactgcagcattaaatccaggattgctttttgattctggttatgatgattacatgtcattcctatgtggtatcaacggttcaactcctacagtgctaaactacactggtcaaaattgctggacttataattcaacactatatggccctgatctgaacttgccctcaatcacaatagcaaggttgaaccaatctagagtagtacaaagaacaatccaaaacattgctggaaatgaaacttacaatgttggttggagtgctccatatggaacttctatgaaagtgtttcctaatcacttctctcttgccagtggggagagactagtcttgtctgtgatcttcaatgcaaccagcaacagttctgctgccagctatgggagaattgggctgtatggtaatcaaggtcatgttgtcaacattcctgtggcagtcatttttaaaatctta

SEQ ID NO: 11296 - DNA, 2592 bp, Artificial sequence
  miR resistant mutant
atgtgggttggtgaggaattgttgtcgtcgttgttgttgttgttcacttttgctggtgtggttttcgatccaactgggtcttcagcttttgtgcttttgtttccctataaaatccttatgggtaacattaatgtggcacatttggtggtggtggtgctgttttgctttgggctgtttttgccatgcttgtgtcaaggtaactcagatgatgctaccactgatgtgtatgttgttactctgagacatgcacctgtttctcattactatggtgagttgagaagagaggttaatggcttcaaagatgctgctgctcctgggagaactcaatttaacaaaccaagaaggtatgacaatattactaagacagataagagatatgactcttatatttcccgagttcacgattctctgttgaagaaagtgttaaatggagagaaatatctgaaactatatagctaccattacctgataaatggattcgctgtgctggttacccaacagcaggcagagaaactatcaaggagcagcgaagtgtccaatgtggttttggatttttctgtaaggactgcgactacgcatactccacagtttttgggtctgccagagggagcatggtttcaagatggtgggtttgagactgctggagaaggagttgttatagggttcgttgacactggcatagatccaacacatcctagttttgatgataacaaatatgaaaaaccgtatcccgttcctgctcatttttctggcatctgcgaggttactcgtgactttccatctggttcttgcaataggaaacttgttggggcccgtcattttgcagcttctgccataaccagaggaatatttaattcaactcaggactatgcttctccctttgatggcgatggccatggcacgcatacagcatctgttgcagcaggaaaccatgggattccagtgattgttgctggacatcactttgggaatgctagtgggatggctcctcgttcacacattgctgtttacaaggcattatacaagagctttggtggatttgctgcagatgttgttgcagctattgaccaggcagctcaggatggggttgacataataagcttgtcaattactcctaatagacgtcctcctggtgttgcaactttcttcaacccaatagacatggctttgatgtcagctgtgaagcaaggtatttttgtagtacaagcagcaggaaatactggaccatcaccaacaagcatgttctccttcagtccatggatctatactgttggtgctgcctctcatgatcgggtttatagcaacgccatatttcttggaaataatgtgaccatacctggagttggtcttgcatctggcacagatgaaagcaaactttataaactgattcatgcacatcattctttgagcaatgacacaacagttgctgatgatatctattcaattcgatttgtgctgggactctccaccatcaaacaggcctcagaaactgccaaaaaccttagtgcagctggtgttgtcttctatatggatccctttgtgattggttttcagcttaaccccgttccaatgaaaatgcctggcataataattgcttccacaaatgattccaaggttttaatgcaatactacaattcttcattggaaatagatgctgtttcaaataaaattgtgaaatttggggctgttgccagtatctgtggtggactaaaagcaaactacagtaatgttgccccaaaggttatgtattactctgccagaggaccagatccagaggacagtcttcctcatgaagctgacattttgaaacctaacttgttagctcctggaaattttatatgggctgcttggagttctgttggcactgaatcagttgaattcctaggtgaaaattttgcattgatgtctggcacaagcatggctgcaccacatgttgctggtcttgctgcactaattaggcaaaagttccccaatttcagtcctgcagccattggatctgctctttctagtacagcttctctgtatgacaagagtggtggaccaataatggctcagcgatcatatgcctctccagatctaaatcaaagcccagccacaccattcgatatgggaagtggttttgtgaatgcaagtggagcactgaacccgggtttagtttttgattctggttatgatgattacatgtcatttctatgtggtattaatggctcagctcctgtggtgctaaactacaccggtcaaaattgcgggctttataattcgactgtctatggtcctgatctgaacttgccctccatcactatatcaaagctgaaccaatctagaatagtgcagaggacagtccaaaacgttgctcaaaatgaatcttacagtgttggttggactgctccttatggggtttcagtgaaagtttctccaactcacttctgtattcccagtggtgagagccaggtcttgtctgtgctcttgaatgcaacccttaacagctctgtggccagctttgggagaattgggctgtttgggaatcaaggtcatgtggtcaacattccactttcagtcatggttaaaatctcatataacactactactagc

SEQ ID NO: 11297 - DNA, 2592 bp, Artificial sequence
  miR resistant mutant
atgtgggttggtgaggaattgttgtcgtcgttgttgttgttgttcacttttgctggtgtggttttcgatccaactgggtcttcagcttttgtgcttttgtttccctataaaatccttatgggtaacattaatgtggcacatttggtggtggtggtgctgttttgctttgggctgtttttgccatgcttgtgtcaaggtaactcagatgatgctaccactgatgtgtatgttgttactctgagacatgcacctgtttctcattactatggtgagttgagaagagaggttaatggcttcaaagatgctgctgctcctgggagaactcaatttaacaaaccaagaaggtatgacaatattactaagacagataagagatatgactcttatatttcccgagttcacgattctctgttgaagaaagtgttaaatggagagaaatatctgaaactatatagctaccattacctgataaatggattcgctgtgctggttacccaacagcaggcagagaaactatcaaggagcagcgaagtgtccaatgtggttttggatttttctgtaaggactgcgactacgcatactccacagtttttgggtctgccagagggagcatggtttcaagatggtgggtttgagactgctggagaaggagttgttatagggttcgttgacactggcatagatccaacacatcctagttttgatgataacaaatatgaaaaaccgtatcccgttcctgctcatttttctggcatctgcgaggttactcgtgactttccatctggttcttgcaataggaaacttgttggggcccgtcattttgcagcttctgccataaccagaggaatatttaattcaactcaggactatgcttctccctttgatggcgatggccatggcacgcatacagcatctgttgcagcaggaaaccatgggattccagtgattgttgctggacatcactttgggaatgctagtgggatggctcctcgttcacacattgctgtttacaaggcattatacaagagctttggtggatttgctgcagatgttgttgcagctattgaccaggcagctcaggatggggttgacataataagcttgtcaattactcctaatagacgtcctcctggtgttgcaactttcttcaacccaatagacatggctttgatgtcagctgtgaagcaaggtatttttgtagtacaagcagcaggaaatactggaccatcaccaacaagcatgttctccttcagtccatggatctatactgttggtgctgcctctcatgatcgggtttatagcaacgccatatttcttggaaataatgtgaccatacctggagttggtcttgcatctggcacagatgaaagcaaactttataaactgattcatgcacatcattctttgagcaatgacacaacagttgctgatgatatctattcaattcgatttgtgctgggactctccaccatcaaacaggcctcagaaactgccaaaaaccttagtgcagctggtgttgtcttctatatggatccctttgtgattggttttcagcttaaccccgttccaatgaaaatgcctggcataataattgcttccacaaatgattccaaggttttaatgcaatactacaattcttcattggaaatagatgctgtttcaaataaaattgtgaaatttggggctgttgccagtatctgtggtggactaaaagcaaactacagtaatgttgccccaaaggttatgtattactctgccagaggaccagatccagaggacagtcttcctcatgaagctgacattttgaaacctaacttgttagctcctggaaattttatatgggctgcttggagttctgttggcactgaatcagttgaattcctaggtgaaaattttgcattgatgtctggcacaagcatggctgcaccacatgttgctggtcttgctgcactaattaggcaaaagttccccaatttcagtcctgcagccattggatctgctctttctagtacagcttctctgtatgacaagagtggtggaccaataatggctcagcgatcatatgcctctccagatctaaatcagagcccagccacaccattcgatatgggaagtggttttgtgaatgcaagtggagcactgaacccgggtttagtttttgattctggttatgatgattacatgtcatttctatgtggtattaatggctcagctcctgtggtgctaaactacaccggtcaaaattgcgggctttataattcgactgtctatggtcctgatctgaacttgccctccatcactatatcaaagctgaaccaatctagaatagtgcagaggacagtccaaaacgttgctcaaaatgaatcttacagtgttggttggactgctccttatggggtttcagtgaaagtttctccaactcacttctgtattcccagtggtgagagccaggtcttgtctgtgctcttgaatgcaacccttaacagctctgtggccagctttgggagaattgggctgtttgggaatcaaggtcatgtggtcaacattccactttcagtcatggttaaaatctcatataacactactactagc

SEQ ID NO: 11298 - DNA, 1053 bp, Artificial sequence
  miR resistant mutant
atggatggaggctgtgtcacagacgaaaccaccacatccagcgactctctttccgttccgccgcccagccgcgtcggcagcgttgcaagcgccgtcgtcgaccccgacggttgttgcgtttccggcgaggccgaatcccggaaactcccttcgtcgaaatacaaaggcgtggtgccgcaaccgaacggtcgctggggagctcagatttacgagaagcaccagcgcgtgtggctcggcactttcaacgaggaagacgaagccgccagagcctacgacatcgccgcgctgcgcttccgcggccccgacgccgtcaccaacttcaagcctcccgccgcctccgacgacgccgagtccgagttcctcaactcgcattccaagttcgagatcgtcgacatgctccgcaagcacacctacgacgacgagctccagcagagcacgcgcggtggtaggcgccgcctcgacgctgacaccgcgtcgagcggtgtgttcgacgcgaaagcgcgtgagcagctgttcgagaaaacggttacgccgagcgacgtcgggaagctgaatcgattagtgataccgaagcagcacgcggagaagcactttccgttaagcggatccggcgacgaaagctcgccgtgcgtggcgggggcttcggcggcgaagggaatgttgttgaactttgaggacgttggagggaaagtgtggcggtttcgttactcttattggaacagtagccagagctacgtgcttaccaaaggatggagccggttcgttaaggagaagaatcttcgagccggtgacgcggttcagttcttcaagtcgaccggaccggaccggcagctatatatagactgcaaggcgaggagtggtgaggttaacaataatgctggcggtttgtttgttccgattggaccggtcgttgagccggttcagatggttcggcttttcggggtcaaccttttgaaactacccgtacccggaagcgacggagtcggaaaacgcaaagagatggaactgtttgcatttgaatgttgcaagaagttaaaagtaattggagctttg

SEQ ID NO: 11299 - DNA, 1053 bp, Artificial sequence
  miR resistant mutant
atggatggaggctgtgtcacagacgaaaccaccacatccagcgactctctttccgttccgccgcccagccgcgtcggcagcgttgcaagcgccgtcgtcgaccccgacggttgttgcgtttccggcgaggccgaatcccggaaactcccttcgtcgaaatacaaaggcgtggtgccgcaaccgaacggtcgctggggagctcagatttacgagaagcaccagcgcgtgtggctcggcactttcaacgaggaagacgaagccgccagagcctacgacatcgccgcgctgcgcttccgcggccccgacgccgtcaccaacttcaagcctcccgccgcctccgacgacgccgagtccgagttcctcaactcgcattccaagttcgagatcgtcgacatgctccgcaagcacacctacgacgacgagctccagcagagcacgcgcggtggtaggcgccgcctcgacgctgacaccgcgtcgagcggtgtgttcgacgcgaaagcgcgtgagcagctgttcgagaaaacggttacgccgagcgacgtcgggaagctgaatcgattagtgataccgaagcagcacgcggagaagcactttccgttaagcggatccggcgacgaaagctcgccgtgcgtggcgggggcttcggcggcgaagggaatgttgttgaactttgaggacgttggagggaaagtgtggcggtttcgttactcttattggaacagtagccagagctacgtgcttaccaaaggatggagccggttcgttaaggagaagaatcttcgagccggtgacgcggttcagttcttcaagtcgaccggaccggaccggcagctatatatagactgcaaggcgaggagtggtgaggttaacaataatgctggcggtttgtttgttccgattggaccggtcgttgagccggttcagatggttcggcttttcggggtcaaccttttgaaactacccgtacccggtagcgacggtgtcggtaaacgcaaagagatggaactgtttgcatttgaatgttgcaagaagttaaaagtaattggagctttg

SEQ ID NO: 11300 - DNA, 2700 bp, Artificial sequence
  miR resistant mutant
atggatttcatagggccagtgttggagctcataattcgcatgtgggactgttgtgcctgcgtccgcgagtttgaagagaacctttcttgtttgagggacatagcatctgaccttcgaggtgtttggattgatgtgagtgtgagggttgaagtggctgaggcacagtacctgaggcgtctgaatgaagtgaatgattggttggataaagttgaagccatgcaaagggaagtcgaagctattcagcagaaagtttctcaagttcaagaaacgcatagtagatgtttgggaagtttctgtcccgggaattttccaactagctgctggatgggaagggttatagctcaaaaaattggcgagattcgtgaactaattgataaagggcattttgatgtagtggctcaggaaatgccacatgctttggtagatgaaatacctctagaggccacagtaggtctagaatcaacctttgatgaacttggtgcatgttttgatgacaatcatgttggagttattggcttgtatggaatgggaggagtcggcaaaaccaccctgctcaaaaagttcaataatgagttccttcccacagcattctatgatgtggtcgtttgggttgtggtgtctaaagaagcagatgtagggaatgttcaacaaagcatactggaaaaattaaaagttcccgatggtaaatgggttggtaaggccattaatgagagagctattgttttatacaacatcttgaaaaggaagaagtttgtgttgctgctagatgatttatgggagcgcatagatcttctgaagttggggattcctcttcctgatacgaacaacggatctaaagtgatattcacaacgcgatccatggaggtttgcaggtacatggaagccaacagatgtatcaaagtagaatgtttagcaccaaaggcagcatttgaattgttcaaagagaaagtgggtgaagaaactctcaactctcatcctgaaatatttcatttggctcaaattatggccaaggggtgtgagggacttccactggctcttatcactgttggaagacctatggctagaaagtctctccctgaatggaaacgagcaatacgaactttgaagaattatccatcaaaattttcaggtatggttaaagatgtctattgtttgcttgaatttagctatgacagtttgccaagtgccatacacaagtcttgtttcttgtactgttccatcttccctgaggactatgatattagagaagatgaactcattcaactgtggattggggaaggtctcttagctgaatttggtgatgatgtctacgaagcacgtaatcaaggagaagaaatcatagcaagcttgaagtttgcttgtttgttggaggacagcgagagagaaaacaggattaagatgcatgatgtgatcagagacatggctttgtggctagcatgtgatcatggatccaacaccaggtttttggtgaaagatggtgcaagcagcagttcagctgaagcatataatcctgcaaagtggaaagaagtagagatagtatcactctggggacctagcattcaaaccttctcaggaaaaccagattgctcaaatctctcaactatgattgtcagaaataccgagctaacaaactttcctaatgagatctttctgactgcaaacactcttggagtgttagacttgtcaggtaataaaagattaaaagaactacctgcaagtattggggagttagttaacttgcagcatttggatatatcaggtactgatatacaagaattgccaagggagctccagaaattgaaaaagttgaggtgcttgctgctaaattatatttgcaataggattgtcttcccgaggagtttgatatcaagtttgttgtcattgcaagtgtttagcaaattaccttgggaagatcaatgcattcttcctgacttaagggagcctgaggaaactgttttgttgcaagaattggaatgcttggaattccttcaagacataagcattgctctcttttgcttttcttctatgcaagtattacagaaatctcccaaattacaaagattcattagactgagagtaatttctcatttcaattcaatgccacatgttatattattctcattattgagaaaaatgcaacatctagaggttttgtccatatcaatttcttcatctccaagtttagtttctgacatgaaaaaggagtctccatcgcatgattctatgtctgagtgtattccaatgagttcgaagcttactgagcataattatactgttaatcttcgtgagttatcccttgaagggtgtggcatgttcaacttgaattggctcacttgtgctccaagccttcagctccttagattatacaattgtccctcattggaagaagtcataggtgaagaatttggacatgcagtaaatgttttttcgagtcttgaaattgttgatctagattctctaccaaagttaaggagcatatgctcacaagtattgcgatttccttgtctcaaggagatctgtgtggcagattgtccaaggctgctaaagctcccttttgattccagtagtgcaaggaacagtctgaagcacatcaatggacaaaaaaattggtggcgtaatttgaagtgggaagatgaagctacaagggatctctttcgttcaaaatatgtacctttccgtagtaaaattcgccgaaaaaat

SEQ ID NO: 11301 - DNA, 2700 bp, Artificial sequence
  miR resistant mutant
atggatttcatagggccagtgttggagctcataattcgcatgtgggactgttgtgcctgcgtccgcgagtttgaagagaacctttcttgtttgagggacatagcatctgaccttcgaggtgtttggattgatgtgagtgtgagggttgaagtggctgaggcacagtacctgaggcgtctgaatgaagtgaatgattggttggataaagttgaagccatgcaaagggaagtcgaagctattcagcagaaagtttctcaagttcaagaaacgcatagtagatgtttgggaagtttctgtcccgggaattttccaactagctgctggatgggaagggttatagctcaaaaaattggcgagattcgtgaactaattgataaagggcattttgatgtagtggctcaggaaatgccacatgctttggtagatgaaatacctctagaggccacagtaggtctagaatcaacctttgatgaacttggtgcatgttttgatgacaatcatgttggagttattggcttgtatgggatggggggggtcggcaaaaccaccctgctcaaaaagttcaataatgagttccttcccacagcattctatgatgtggtcgtttgggttgtggtgtctaaagaagcagatgtagggaatgttcaacaaagcatactggaaaaattaaaagttcccgatggtaaatgggttggtaaggccattaatgagagagctattgttttatacaacatcttgaaaaggaagaagtttgtgttgctgctagatgatttatgggagcgcatagatcttctgaagttggggattcctcttcctgatacgaacaacggatctaaagtgatattcacaacgcgatccatggaggtttgcaggtacatggaagccaacagatgtatcaaagtagaatgtttagcaccaaaggcagcatttgaattgttcaaagagaaagtgggtgaagaaactctcaactctcatcctgaaatatttcatttggctcaaattatggccaaggggtgtgagggacttccactggctcttatcactgttggaagacctatggctagaaagtctctccctgaatggaaacgagcaatacgaactttgaagaattatccatcaaaattttcaggtatggttaaagatgtctattgtttgcttgaatttagctatgacagtttgccaagtgccatacacaagtcttgtttcttgtactgttccatcttccctgaggactatgatattagagaagatgaactcattcaactgtggattggggaaggtctcttagctgaatttggtgatgatgtctacgaagcacgtaatcaaggagaagaaatcatagcaagcttgaagtttgcttgtttgttggaggacagcgagagagaaaacaggattaagatgcatgatgtgatcagagacatggctttgtggctagcatgtgatcatggatccaacaccaggtttttggtgaaagatggtgcaagcagcagttcagctgaagcatataatcctgcaaagtggaaagaagtagagatagtatcactctggggacctagcattcaaaccttctcaggaaaaccagattgctcaaatctctcaactatgattgtcagaaataccgagctaacaaactttcctaatgagatctttctgactgcaaacactcttggagtgttagacttgtcaggtaataaaagattaaaagaactacctgcaagtattggggagttagttaacttgcagcatttggatatatcaggtactgatatacaagaattgccaagggagctccagaaattgaaaaagttgaggtgcttgctgctaaattatatttgcaataggattgtcttcccgaggagtttgatatcaagtttgttgtcattgcaagtgtttagcaaattaccttgggaagatcaatgcattcttcctgacttaagggagcctgaggaaactgttttgttgcaagaattggaatgcttggaattccttcaagacataagcattgctctcttttgcttttcttctatgcaagtattacagaaatctcccaaattacaaagattcattagactgagagtaatttctcatttcaattcaatgccacatgttatattattctcattattgagaaaaatgcaacatctagaggttttgtccatatcaatttcttcatctccaagtttagtttctgacatgaaaaaggagtctccatcgcatgattctatgtctgagtgtattccaatgagttcgaagcttactgagcataattatactgttaatcttcgtgagttatcccttgaagggtgtggcatgttcaacttgaattggctcacttgtgctccaagccttcagctccttagattatacaattgtccctcattggaagaagtcataggtgaagaatttggacatgcagtaaatgttttttcgagtcttgaaattgttgatctagattctctaccaaagttaaggagcatatgctcacaagtattgcgatttccttgtctcaaggagatctgtgtggcagattgtccaaggctgctaaagctcccttttgattccagtagtgcaaggaacagtctgaagcacatcaatggacaaaaaaattggtggcgtaatttgaagtgggaagatgaagctacaagggatctctttcgttcaaaatatgtacctttccgtagtaaaattcgccgaaaaaat

SEQ ID NO: 11302 - DNA, 3030 bp, Artificial sequence
  miR resistant mutant
atggaagctaaatttggagctgaggcttatcatttttacggtgtgggtgcttcctcggacctacgaggagtaggaaaacgatcctcagagtgggatttgaatgattggagatgggatggtgatctgttcatcgctagccggctgaatccggtgccggccgatggtgttggagtgggacagcaatttttccctattgggtccgggatcccggtggccggaggcccctccaacagttcttccacctctgaggaagtagatcctagggatcccaaggcgaacaaggaaggggacaagaaaaggagagttattgtgctggaggatgatgggttgaatgaggaagggggtactcttagtttaaagcttggtggccatgcttctgcagtggtggatagggaagttgggagctgggacggtacgaatgggaagaaaagtagagtgtcgggaagtacttcaaatcgagctgtttgtcaggtggaggactgcagtgctgatctgagcaaagctaaggattatcacagacggcataaagtttgtgagatgcactccaaggccagtagggcgcttgtgggaaatgcaatgcagagattctgtcaacaatgtagtaggtttcacctacttcaagagtttgatgaaggaaagagaagctgccgaagacgcttggcagggcataataaacgaagaaggaaaacaaatcatgaagctgttcctaatggaagttcattaaatgatgatcagactagtagctatctgttgataagtttattgaagatactttcaaatatgcattctgacaggtcagatcagactacagatcaggatctactaactcatattctgaggagtcttgctagtcagaatggtgaacaagggggcaagaacatagctaaccttttgcgagaaccagagaatttgttgagagaagatggttcatcaaggaagtcagagatgatgtcaactttattctccaatggttctcaaggctctccatccaatataagacaacatgaaactgtatctatggctaaaatgcagcaacaagtgatgcatgcacatgatgctggggcttctgatcagcaaattacatcttctataaagcccagcatgtcaaacagtcctccggcctactcagaagccagagacagtaccgctggacagatcaagatgaataattttgatttgaatgacatatatattgactcagatgatggtatggaagatttagaaagattgcccgtctctacaaatcttgtgactagctctcttgattacccatgggcacaacaagattcccatcaatcaagtccacctcaaacaagtggaaattctgattctgcatctgcccagtctccttccagttccagtggagaagctcagagtcgcacagatcgaattgtttttaagctcttcggtaaagagccaaatgattttcctcttgtacttagagcacagattcttgactggttatctcacagtcctactgatatggagagctacatacggcctggttgtattgttttgaccatttatctgcgtcaggctgaggcgttgtgggaggaactttgctatgatctgacttccagtttgaataggctgttggatgtctcagatgatactttttggagaaatggatgggttcacatcagggtgcagcatcagatggccttcatttttaatggtcaagttgtcatagatacctccttacctttcagaagtaacaattatagcaagattttgactgttagtccaattgctgtaccagcatcaaagagagctcaattttctgttaagggtgtcaacctgatacgccctgccactaggttaatgtgtgctttagaagggaaatatctggtctgtgaagatgatcatatgtcaatggatcaatgctccaaagaacctgatgaacttcagtgcgtccagttttcatgttctgtccctgtgatgaatggaagaggatttattgagattgaggaccagggtttgagtagcagcttttttcctttcattgttgtggaggaggatgtttgctcagaaatctgtacacttgagcctcttctagaattaagtgaaactgatccagatattgaagggacaggaaaaatcaaagccaaaaatcaagccatggattttattcatgaaatgggttggcttcttcacagaagccagttgaaattaaggatggtttctagtgtggatctctttccattgaaacggttcaagtggcttattgagttttccatggatcatgattggtgtgcagcagtgagaaaactgttgaacctactgtttgatggaactgtaaatacaggagatcatccttccttgtatcttgcgctttcagagatgggtctccttcacaaagctgtaaggagaaatagcaagcatttagtggagttgcttttgagatatgttcctgagaatatttctgataaactaggacctgaagagaaggcactggttgatggagagaatcagaccttcttgtttagacctgatgttgatggtactgctggtttgacaccactccatatagcagccgggaaagatggttctgaggatgtacttgatgctttgactaatgatccttgcatggttggaattgaagcgtggaaaaatgctcgtgacagcacaggttcgacacctgaggattatgcccgtttacgtggccattatgcttacattcacttggtgcagaaaaaaattaacaagaaacaaggagcagctcatgtggtggttgagattccaagcaatatgacagagaacaatacaaacaagaagcaaaatgagttatccactatctttgagattggaaagcctgaagtaaggcgtggccaagggcactgtaagctttgtgacaacagaatttcttgcagaactgcagtaggcaggtctatggtatacagacctgcaatgctctcaatggtggcaatagcggcagtctgtgtctgtgtggcccttctgtttaaaagctcacctgaagtcatatgtatgttccgacccttcagatgggaaaatttggactttggaacaagc

SEQ ID NO: 11303 - DNA, 3030 bp, Artificial sequence
  miR resistant mutant
atggaagctaaatttggagctgaggcttatcatttttacggtgtgggtgcttcctcggatctacgaggagtaggaaaacgatcctcagagtgggatttgaatgattggagatgggatggtgatctgttcatcgctagccggctgaatccggtgccggccgatggtgttggagtgggacagcaatttttccctattgggtccgggatcccggtggccggaggcccctccaacagttcttccacctctgaggaagtagatcctagggatcccaaggcgaacaaggaaggggacaagaaaaggagagttattgtgctggaggatgatgggttgaatgaggaagggggtactcttagtttaaagcttggtggccatgcttctgcagtggtggatagggaagttgggagctgggacggtacgaatgggaagaaaagtagagtgtcgggaagtacttcaaatcgagctgtttgtcaggtggaggactgcagtgctgatctgagcaaagctaaggattatcacagacggcataaagtttgtgagatgcactccaaggccagtagggcgcttgtgggaaatgcaatgcagagattctgtcaacaatgtagtaggtttcacctacttcaagagtttgatgaaggaaagagaagctgccgaagacgcttggcagggcataataaacgaagaaggaaaacaaatcatgaagctgttcctaatggaagttcattaaatgatgatcagactagtagctatctgttgataagtttattgaagatactttcaaatatgcattctgacaggtcagatcagactacagatcaggatctactaactcatattctgaggagtcttgctagtcagaatggtgaacaagggggcaagaacatagctaaccttttgcgagaaccagagaatttgttgagagaagatggttcatcaaggaagtcagagatgatgtcaactttattctccaatggttctcaaggctctccatccaatataagacaacatgaaactgtatctatggctaaaatgcagcaacaagtgatgcatgcacatgatgctggggcttctgatcagcaaattacatcttctataaagcccagcatgtcaaacagtcctccggcctactcagaagccagagacagtaccgctggacagatcaagatgaataattttgatttgaatgacatatatattgactcagatgatggtatggaagatttagaaagattgcccgtctctacaaatcttgtgactagctctcttgattacccatgggcacaacaagattcccatcaatcaagtccacctcaaacaagtggaaattctgattctgcatctgcccagtctccttccagttccagtggagaagctcagagtcgcacagatcgaattgtttttaagctcttcggtaaagagccaaatgattttcctcttgtacttagagcacagattcttgactggttatctcacagtcctactgatatggagagctacatacggcctggttgtattgttttgaccatttatctgcgtcaggctgaggcgttgtgggaggaactttgctatgatctgacttccagtttgaataggctgttggatgtctcagatgatactttttggagaaatggatgggttcacatcagggtgcagcatcagatggccttcatttttaatggtcaagttgtcatagatacctccttacctttcagaagtaacaattatagcaagattttgactgttagtccaattgctgtaccagcatcaaagagagctcaattttctgttaagggtgtcaacctgatacgccctgccactaggttaatgtgtgctttagaagggaaatatctggtctgtgaagatgatcatatgtcaatggatcaatgctccaaagaacctgatgaacttcagtgcgtccagttttcatgttctgtccctgtgatgaatggaagaggatttattgagattgaggaccagggtttgagtagcagcttttttcctttcattgttgtggaggaggatgtttgctcagaaatctgtacacttgagcctcttctagaattaagtgaaactgatccagatattgaagggacaggaaaaatcaaagccaaaaatcaagccatggattttattcatgaaatgggttggcttcttcacagaagccagttgaaattaaggatggtttctagtgtggatctctttccattgaaacggttcaagtggcttattgagttttccatggatcatgattggtgtgcagcagtgagaaaactgttgaacctactgtttgatggaactgtaaatacaggagatcatccttccttgtatcttgcgctttcagagatgggtctccttcacaaagctgtaaggagaaatagcaagcatttagtggagttgcttttgagatatgttcctgagaatatttctgataaactaggacctgaagagaaggcactggttgatggagagaatcagaccttcttgtttagacctgatgttgatggtactgctggtttgacaccactccatatagcagccgggaaagatggttctgaggatgtacttgatgctttgactaatgatccttgcatggttggaattgaagcgtggaaaaatgctcgtgacagcacaggttcgacacctgaggattatgcccgtttacgtggccattatgcttacattcacttggtgcagaaaaaaattaacaagaaacaaggagcagctcatgtggtggttgagattccaagcaatatgacagagaacaatacaaacaagaagcaaaatgagttatccactatctttgagattggaaagcctgaagtaaggcgtggccaagggcactgtaagctttgtgacaacagaatttcttgcagaactgcagtaggcaggtctatggtatacagacctgcaatgctctcaatggtggcaatagcggcagtctgtgtctgtgtggcccttctgtttaaaagctcacctgaagtcatatgtatgttccgacccttcagatgggaaaatttggactttggaacaagc

SEQ ID NO: 11304 - DNA, 336 bp, Artificial sequence
  miR resistant mutant
ggcatgggaggagtaggaaaaaccacacttgctcgagcaatttacaatttgattgctgatcaatttgaagtattgtgttttcttgataatgtgagagaaaactcaattaaaaatggattggtgcatctccaagagacacttctttctaaaacaattggagagaagggtattaagttaggaagtatcaacgaagcaattccaataataaagcataggctccaccgaaagaaggttcttttggttctggatgatgttgacaaaccagatcagttgcatgcaattgctggagggatggattggtttggttctggtagcaaaatcatcatcacaactagg

SEQ ID NO: 11305 - DNA, 336 bp, Artificial sequence
  miR resistant mutant
ggaatgggaggagtaggaaaaaccacacttgctcgagcaatttacaatttgattgctgatcaatttgaagtattgtgttttcttgataatgtgagagaaaactcaattaaaaatggattggtgcatctccaagagacacttctttctaaaacaattggagagaagggtattaagttaggaagtatcaacgaagcaattccaataataaagcataggctccaccgaaagaaggttcttttggttctggatgatgttgacaaaccagatcagttgcatgcaattgctggagggatggattggtttggttctggtagcaaaatcatcatcacaactagg

SEQ ID NO: 11306 - DNA, 894 bp, Artificial sequence
  miR resistant mutant
atggtgtacgtcaaggctcagaaatcaaaagcctacttcaagagatatcaagtcaagttcaagagaagaagagagggaaaaaccgattaccgtgccaggattcggttgattaatcaggacaagaacaaatataacactccgaaataccgatttgttgttcgctttagcaacaaggacattgttgcacaaataatatctgctagcattgctggcgatattgttcttgctgcagcatatgcacatgagctgccacgatatggtcttgaagtagggcttacaaattatgctgcagcttattgcactggtctcctgttggcccgaagagtcctcaaaacacttgaaatggatgaggagtatgaaggaaatgttgaggctactggagaggattattccgtggaacctgctgagagcaggaggccattccgtgctctccttgatgttggtcttattaggactacaaccggtaaccgtgtgtttggtgcccttaagggagctctggatggggggttggatattcctcacagtgacaagaggtttgctgggtttgataaggagaagaaggagttagacgccgaagtacacagaaaatatgtttttggtggacatgttgctgcctatatgaagatcttggcggaagatgaaccagagaaataccagtcacacttcagtgaatacatcaagcgtgggatagaagctgatggtattgaggcactgtataaaaatgttcatgctgccatccgggctgatcctactctcaagaaatctgataagcagaccccgaaggagcacaagaggtacaacttaaagaagctgacatatgaggagaggaaggctaagttgatttcacgtgtggcagctctcaactctgctgctgataatgatgaagatgatgag

SEQ ID NO: 11307 - DNA, 894 bp, Artificial sequence
  miR resistant mutant
atggtgtacgtcaaggctcagaaatcaaaagcctacttcaagagatatcaagtcaagttcaagagaagaagagagggaaaaaccgattaccgtgccaggattcggttgattaatcaggacaagaacaaatataacactccgaaataccgatttgttgttcgctttagcaacaaggacattgttgcacaaataatatctgctagcattgctggcgatattgttcttgctgcagcatatgcacatgagctgccacgatatggtcttgaagtagggcttacaaattatgctgcagcttattgcactggtctcctgttggcccgaagagtcctcaaaacacttgaaatggatgaggagtatgaaggaaatgttgaggctactggagaggattattccgtggaacctgctgagagcaggaggccattccgtgctctccttgatgttggtcttattaggactacaaccggtaaccgtgtgtttggtgcccttaagggagctctggatggggggttggatattcctcacagtgacaagaggtttgctgggtttgataaggagaagaaggagcttgacgccgaagtacacagaaaatatgtttttggtggacatgttgctgcctatatgaagatcttggcggaagatgaaccagagaaataccagtcacacttcagtgaatacatcaagcgtgggatagaagctgatggtattgaggcactgtataaaaatgttcatgctgccatccgggctgatcctactctcaagaaatctgataagcagaccccgaaggagcacaagaggtacaacttaaagaagctgacatatgaggagaggaaggctaagttgatttcacgtgtggcagctctcaactctgctgctgataatgatgaagatgatgag

SEQ ID NO: 11308 - DNA, 894 bp, Artificial sequence; identical to SEQ ID NO: 11307
  miR resistant mutant

SEQ ID NO: 11309 - DNA, 894 bp, Artificial sequence; identical to SEQ ID NO: 11307
  miR resistant mutant

SEQ ID NO: 11310 - DNA, 1821 bp, Artificial sequence
  miR resistant mutant
atgaaggaggcaacaatggagaaggaaatggagctttgtacaagtgaagtggaaatggcttctcaacacagtccacaaccacagaagaaaaagggtggtattgttaccatgcctttcatcatggcaaatgaagcacttgcaagcgtggcgaatatcggtcttcagccgaacatgatattgtatttgatggggagttacaggtttcatttagccaaagcaactcaggtgtttctgttatcctctgcaacaagcaatctcacgccactcataggtgctttcattgctgattcttgtcttggtcgattcctagctgttgggttaggttctgccatctctttcctgggaatggcactcttgtgtctaacagcgatgatcccacaaagcagaccaccaccatgtaaccctgcaactgaaagatgtaaaccagcaacagctggccaaatggcaatgttaatctcttcctttgctctcatgtcgattggaaatggtggcctttcatgctccatcgcatttggcgcagaccaggtgaataaaaaagataaccccaacaaccagagggccttagaaacatttttcagctggtattatgcttctacagctttttctgtcataattgccctcacagtcatagtatatatccaagatcattttggatggaaagtaggttttggagttccagcagcacttatgttcatgtccactttcttcttctttcttgcttctccgctttatgtaaagaataaaatacaaggcagcttaatcactggcttagcacaagtaattgtcgtggcctataagaaccggaagcttcctttaccacctaggaactcagctgaaatgtaccatcataggaaggactctgatcttgttgttcctactgacaaactaaggtttctgaataaagcttgcatcatcaaagatatagcctctgatggatcagcttcaaatccgtggagtctctgcacaatagatcaagtggaagaactaaaagctattattaaagttattccactgtggtctacagggatcatgatgtcagttaacattggaggctcgtttggaatactgcaagctaaatccctcaacagacatatcacttcacactttgaaattccagcaggttctttttctgtagtaatcgtatttatggtattcatatgggtggctctttatgatcgtgtcattattcctatagcatcaaagctcagaggcaaaccagttaggatcagtgccaagagaagaatgggaattgggttggttttctcttttctccacttggcaactgcagctattgtggagaatacaaggcgaaggagagcaatcagggagggacatattgatgacacaaatgcagtgttgaatatgtctgcaatgtggcttgttcctcaactttgcttgtcaggcatggctgaagcattcaatgctataggccaaaatgagttttattacactgagtttccaagaactatgtcaagtattgctgcttgcctttttggacttggaatggctgcaggaaatgtgttatctagtttgatattcagcatcgtggaaaatgttacttcaaggggaggaaagcaaggatgggttttagataatattaacaagggtagttatgacaggtactactgtgttcttgcttcactggctgctgttaatatactgtattatctagtgtgcagttgggcttatgtacccacagttgatcaactatccaatgtttctgacgaaaataattcaaatgagaaagtattaattcaattgggcaatatgagccaggtagatcttagtgaaggatttgggtcaaatgagaaaagagttaac

SEQ ID NO: 11311 - DNA, 1821 bp, Artificial sequence
  miR resistant mutant
atgaaggaggcaacaatggagaaggaaatggagctttgtacaagtgaagtggaaatggcttctcaacacagtccacaaccacagaagaaaaagggtggtattgttaccatgcctttcatcatggcaaatgaagcacttgcaagcgtggcgaatatcggtcttcagccgaacatgatattgtatttgatggggagttacaggtttcatttagccaaagcaactcaggtgtttctgttatcctctgcaacaagcaatctcacgccactcataggtgctttcattgctgattcttgtcttggtcgattcctagctgttgggttaggttctgccatctctttcctgggaatggcactcttgtgtctaacagcgatgatcccacagagcagaccaccaccatgtaaccctgcaactgaaagatgtaaaccagcaacagctggccaaatggcaatgttaatctcttcctttgctctcatgtcgattggaaatggtggcctttcatgctccatcgcatttggcgcagaccaggtgaataaaaaagataaccccaacaaccagagggccttagaaacatttttcagctggtattatgcttctacagctttttctgtcataattgccctcacagtcatagtatatatccaagatcattttggatggaaagtaggttttggagttccagcagcacttatgttcatgtccactttcttcttctttcttgcttctccgctttatgtaaagaataaaatacaaggcagcttaatcactggcttagcacaagtaattgtcgtggcctataagaaccggaagcttcctttaccacctaggaactcagctgaaatgtaccatcataggaaggactctgatcttgttgttcctactgacaaactaaggtttctgaataaagcttgcatcatcaaagatatagcctctgatggatcagcttcaaatccgtggagtctctgcacaatagatcaagtggaagaactaaaagctattattaaagttattccactgtggtctacagggatcatgatgtcagttaacattggaggctcgtttggaatactgcaagctaaatccctcaacagacatatcacttcacactttgaaattccagcaggttctttttctgtagtaatcgtatttatggtattcatatgggtggctctttatgatcgtgtcattattcctatagcatcaaagctcagaggcaaaccagttaggatcagtgccaagagaagaatgggaattgggttggttttctcttttctccacttggcaactgcagctattgtggagaatacaaggcgaaggagagcaatcagggagggacatattgatgacacaaatgcagtgttgaatatgtctgcaatgtggcttgttcctcaactttgcttgtcaggcatggctgaagcattcaatgctataggccaaaatgagttttattacactgagtttccaagaactatgtcaagtattgctgcttgcctttttggacttggaatggctgcaggaaatgtgttatctagtttgatattcagcatcgtggaaaatgttacttcaaggggaggaaagcaaggatgggttttagataatattaacaagggtagttatgacaggtactactgtgttcttgcttcactggctgctgttaatatactgtattatctagtgtgcagttgggcttatgtacccacagttgatcaactatccaatgtttctgacgaaaataattcaaatgagaaagtattaattcaattgggcaatatgagccaggtagatcttagtgaaggatttgggtcaaatgagaaaagagttaac

SEQ ID NO: 11312 - DNA, 1818 bp, Artificial sequence
  miR resistant mutant
atggagaaggaagtggagttttgttcaagtgaattggaaatggcttctcaacacattccacaaccacaaaggaaaaagggtggtattgttaccatgcctttcatcatagcaaatgaagcacttgcaagcgtggcgaaaatcggtcttctgccgaacatgatattgtatttgatggggagttacaagtttcatttagccaaagcaactcaggtgcttctcttatcctctgcaacaagcaatctcacaccactcataggtgctttcattgctgattcttgcctcggtcgattcctctctgttgggtttggttcctccatctctttcctgggaatggcactcttgtgcctaacagccatcatcccacaagcaagaccaccaccatgtaaccctgcaactgaaagatgtaaaccagcaacagctgggcaaatgacaatgttaatctcttcctttgctctcatgtccattggaaatggtggcctttcatgctccatcgcatttggcgcagaccaggtgaataaaaaagataacccaaacaaccagagggcattggaaacatttttcagctggtattatgcttctacagctttttctgttataattgccctcacagtcatagtatatatacaagatcattttggatggaaagtgggttttggagttccagcagcacttatgttcatgtccactttcttcttctttcttgcttctccactttatgtaaagaataaagtacaaggcagcttaatcactggcttagcacaagtaattgtcgtggcctataagaaccggaagcttcctttaccacctaggaactcagctgcaatgtaccatcgtaggaaggactctgatcttgttgttcctactgataaactaaggtttctgaataaagcttgcatcactaaagatccagaaaaagatatagcctctgatggatcagcttcaaatccgtggagtctctgcacaatagatcgagtggaagagctaaaagctattattaaagttattccactgtggtctacggggatcatggtgtcagttaacattggaggctcgtttggattactgcaagctaaatccctcaacagacatatcacttcacactttgaaatcccagcgggttcttttgccgtagtcattgtgtttataatatttatatgggtggctctttatgatcgtgtcattattcctatagcatcaaagctcagaggcaaaccagttaggatcagtgccaagagaagaatgggaattgggttggttttctcttttctccacttggcaactgcagctattgtggagaatgaaaggcgaaggagagcaatcagggagggacatattaatgacacacatgcagtgttgaatatgtctgcaatgtggcttgttcctcaactttgcttgtcaggcatggctgaagcattcaatgctataggccaaaatgagttttattacactgagtttccaagaactatgtcaagtattgccgcttgcctttttggacttggaatggctgcaggaaatgtgttatctagtttaatattcagcattgtggaaaatgctacttcaagaggaggaaacgagggatgggttttagataatattaacaagggtcgttatgacaggtactactgggttcttgcttcactgagtgctgttaatatactgtattatctagtatgcagttgggcttatggacccacggttgatcaactattcaaggtgtctgacgaaaatagttcaaatgagaaagaattcactcaattgggcaatatgggccaggttgatgttagtgaaggaattggctcaaatgagaaaagagttaac

SEQ ID NO: 11313 - DNA, 1818 bp, Artificial sequence
  miR resistant mutant
atggagaaggaagtggagttttgttcaagtgaattggaaatggcttctcaacacattccacaaccacaaaggaaaaagggtggtattgttaccatgcctttcatcatagcaaatgaagcacttgcaagcgtggcgaaaatcggtcttctgccgaacatgatattgtatttgatggggagttacaagtttcatttagccaaagcaactcaggtgcttctcttatcctctgcaacaagcaatctcacaccactcataggtgctttcattgctgattcttgcctcggtcgattcctctctgttgggtttggttcctccatctctttcctgggaatggcactcttgtgcctaacagccatcatcccacaagctagaccaccaccatgtaaccctgcaactgaaagatgtaaaccagcaacagctgggcaaatgacaatgttaatctcttcctttgctctcatgtccattggaaatggtggcctttcatgctccatcgcatttggcgcagaccaggtgaataaaaaagataacccaaacaaccagagggcattggaaacatttttcagctggtattatgcttctacagctttttctgttataattgccctcacagtcatagtatatatacaagatcattttggatggaaagtgggttttggagttccagcagcacttatgttcatgtccactttcttcttctttcttgcttctccactttatgtaaagaataaagtacaaggcagcttaatcactggcttagcacaagtaattgtcgtggcctataagaaccggaagcttcctttaccacctaggaactcagctgcaatgtaccatcgtaggaaggactctgatcttgttgttcctactgataaactaaggtttctgaataaagcttgcatcactaaagatccagaaaaagatatagcctctgatggatcagcttcaaatccgtggagtctctgcacaatagatcgagtggaagagctaaaagctattattaaagttattccactgtggtctacggggatcatggtgtcagttaacattggaggctcgtttggattactgcaagctaaatccctcaacagacatatcacttcacactttgaaatcccagcgggttcttttgccgtagtcattgtgtttataatatttatatgggtggctctttatgatcgtgtcattattcctatagcatcaaagctcagaggcaaaccagttaggatcagtgccaagagaagaatgggaattgggttggttttctcttttctccacttggcaactgcagctattgtggagaatgaaaggcgaaggagagcaatcagggagggacatattaatgacacacatgcagtgttgaatatgtctgcaatgtggcttgttcctcaactttgcttgtcaggcatggctgaagcattcaatgctataggccaaaatgagttttattacactgagtttccaagaactatgtcaagtattgccgcttgcctttttggacttggaatggctgcaggaaatgtgttatctagtttaatattcagcattgtggaaaatgctacttcaagaggaggaaacgagggatgggttttagataatattaacaagggtcgttatgacaggtactactgggttcttgcttcactgagtgctgttaatatactgtattatctagtatgcagttgggcttatggacccacggttgatcaactattcaaggtgtctgacgaaaatagttcaaatgagaaagaattcactcaattgggcaatatgggccaggttgatgttagtgaaggaattggctcaaatgagaaaagagttaac

SEQ ID NO: 11314 - DNA, 1833 bp, Artificial sequence
  miR resistant mutant
atggagaaggaactagaactttcttcagctcaatccagaatggattcccagcgcatttcccaaccccaaaggtgtggtaagggtggcctcgttaccatgcctttcatcatagcaaatgaagcacttgcgagggtggcaacgttggggcttctgcccaatatgatattgtatttgatgggaaactacaatcttcatttaggcaaagctaccaagatactcctcttatcagttgcaaccaccaatttcatgcctcttcccggagccttcattgctgattcttatctgggtcgcttcctcgctgttggtttaggttccttcatcacttttctgggaatgacactgttgtggctaacagccatgatcccacaagcaagaccaccaccatgtaattctgaaactgaaagatgtgaatcagcaacacctggacaaatggcaatgttaatctcttcccttgctctcatgtccattggaaatggtggcctttcatgttccctagcctttggtgctgaccaggtgaatagaaaagataaccccaataaccaaagggccttggagatgttcttcagctggtactatgcttcgtcagcgatatcagtcataattgccttcactggaattgtatatatccaagatcatcttgggtggaaattgggttttggagttccagcagcacttatgttcttgtccacttttttcttctttttggcttctccactttatgtaaagaataaaacacacaacaacttgctcactggctttgcatgtgtgattgttgtagcctataagaacaggaaacttcgattaccacataagatctcagatggaatgtatcatcgtaacaaggactctgatctagttgttccatctgataaactaaggtttctgaataaagcttgcttcattaaagactcagaaaaagatatagcctctgatgggtcagcctacaatcggtggagtctctgcacagttgatcaagtagaagaactaaaagctattattaaagttattcccctgtggtctacagggatcatgatgtatcttaacattggaggctcgtttggattgctgcaagctaaatcccttaaccgacatatcactccaaatttcgaagttccagctgggtctatgagtgtaatcatgatatttacaatatttatttggatagctctttatgatcgtgtcattattcctcttgcatcaaagcttagaggcaaaccggttaggatcagtgccaagagaagaatgggacttgggttgcttttctcttttctccacttggtaactgcagcaattgttgagactacaaggcgaaggagagcaattagtgagggacatattaacgacacacatgcagtgttgaatatgtctgcaatgtggctctttcctcaactttgcttgggtggcatagctgaagcattcaatgcaataggccaaaatgagttctattacaccgagtttcctaagactatgtcgagcattgcttcttccctttttggactaggaatggctgtgggatacgtgttatcttcattggtattcagtattgtggaaaaggttacttcaagagggggaaaagatggatgggtttcagataacattaacaagggtcgatttgacaagtactactggcttcttgccacaatgagtgctgttaatgtactgtattatctagtatgcagttgggcttatggacctacttctgatcaagaatcaaaggtaactgaagaaaatggttccaatgaggaagaattgccattaattcaatccaggactaagggtcagtttgataaggtatctcaggttagtgaagaaattttaagaacttcacataaa

SEQ ID NO: 11315 - DNA, 1833 bp, Artificial sequence
  miR resistant mutant
atggagaaggaactagaactttcttcagctcaatccagaatggattcccagcgcatttcccaaccccaaaggtgtggtaagggtggcctcgttaccatgcctttcatcatagcaaatgaagcacttgcgagggtggcaacgttggggcttctgcccaatatgatattgtatttgatgggaaactacaatcttcatttaggcaaagctaccaagatactcctcttatcagttgcaaccaccaatttcatgcctcttcccggagccttcattgctgattcttatctgggtcgcttcctcgctgttggtttaggttccttcatcacttttctgggaatgacactgttgtggctaacagccatgatcccacaagctagaccaccaccatgtaattctgaaactgaaagatgtgaatcagcaacacctggacaaatggcaatgttaatctcttcccttgctctcatgtccattggaaatggtggcctttcatgttccctagcctttggtgctgaccaggtgaatagaaaagataaccccaataaccaaagggccttggagatgttcttcagctggtactatgcttcgtcagcgatatcagtcataattgccttcactggaattgtatatatccaagatcatcttgggtggaaattgggttttggagttccagcagcacttatgttcttgtccacttttttcttctttttggcttctccactttatgtaaagaataaaacacacaacaacttgctcactggctttgcatgtgtgattgttgtagcctataagaacaggaaacttcgattaccacataagatctcagatggaatgtatcatcgtaacaaggactctgatctagttgttccatctgataaactaaggtttctgaataaagcttgcttcattaaagactcagaaaaagatatagcctctgatgggtcagcctacaatcggtggagtctctgcacagttgatcaagtagaagaactaaaagctattattaaagttattcccctgtggtctacagggatcatgatgtatcttaacattggaggctcgtttggattgctgcaagctaaatcccttaaccgacatatcactccaaatttcgaagttccagctgggtctatgagtgtaatcatgatatttacaatatttatttggatagctctttatgatcgtgtcattattcctcttgcatcaaagcttagaggcaaaccggttaggatcagtgccaagagaagaatgggacttgggttgcttttctcttttctccacttggtaactgcagcaattgttgagactacaaggcgaaggagagcaattagtgagggacatattaacgacacacatgcagtgttgaatatgtctgcaatgtggctctttcctcaactttgcttgggtggcatagctgaagcattcaatgcaataggccaaaatgagttctattacaccgagtttcctaagactatgtcgagcattgcttcttccctttttggactaggaatggctgtgggatacgtgttatcttcattggtattcagtattgtggaaaaggttacttcaagagggggaaaagatggatgggtttcagataacattaacaagggtcgatttgacaagtactactggcttcttgccacaatgagtgctgttaatgtactgtattatctagtatgcagttgggcttatggacctacttctgatcaagaatcaaaggtaactgaagaaaatggttccaatgaggaagaattgccattaattcaatccaggactaagggtcagtttgataaggtatctcaggttagtgaagaaattttaagaacttcacataaa

SEQ ID NO: 11316 - DNA, 1134 bp, Artificial sequence
  miR resistant mutant
atgcccatcttctctgcaacgttgggctccttcacttccatctcctcctccttcctctcacagtcacacctttctcctttcgtgaagacaccttgccaatggcagcatcactatcacactgctaaagtcttggtctctgcctctggcaatacccaaattgaccaaaatcccgactctggacttcttcaacgccctactcctccagacccactcgatgacgctcgtcaggctcggagatcgtcagattggaaggctgcaaagacatatcaagatagtaaagtcatttataatggtagggttgaaggttttaattctggaggcctgctggttcggttttattctgttatgggctttctcccattcccacaattgagtccagtgcatgcttctaaagaaccagagaaatctatccaagaaattgcacaaggcttaattggttcaatcatgtcggtgaaggtaattctagcagatgaggataacaagaaattgatcttctctgagaaagaggcagcatggagtaagtattcaaaacaggtcaatgtaggggacatttttgaagtaagagttggttatgttgaggactatggtgcttttgttcatttgcgcttccctgacggtctttatcaccttactggactaatacacgtctcagaagtgtcatgggatctaattcaggatgtcagagatatcttaaaagtaggtgatgaagtgagggccaaagttgttggtattgattggggaaaatcaaggattaacctatcaattagacagctagaagaagatccactcttagaaactctggacaaagtaatacctcaggatggttcagctgatcctgattctatgagtggtggtgatagcggtagcattgagcctcttccagggcttgaaacaatccttgaagagctactacaggaagatggaatatatgacgtaagaatcagccgtcaagggtttgaaaaaagagtggtctcgcaagacttgcagctttggctttctaatgcacctcccacgaaccaaaggtttactctacttgcccgggctggaagacaggtgcaggagatacatctcactacatcccttgatcaggaaggtatcaggagggcattacaacgagtattggagcgtgtcccc

SEQ ID NO: 11317 - DNA, 1134 bp, Artificial sequence
  miR resistant mutant
atgcccatcttctctgcaacgttgggctccttcacttccatctcctcctccttcctctcacagtcacacctttctcctttcgtgaagacaccttgccaatggcagcatcactatcacactgctaaagtcttggtctctgcctctggcaatacccaaattgaccaaaatcccgactctggacttcttcaacgccctactcctccagacccactcgatgacgctcgtcaggctcggagatcgtcagattggaaggctgcaaagacatatcaagatagtaaagtcatttataatggtagggttgaaggttttaattctggaggcctgctggttcggttttattctgttatgggctttctcccattcccacaattgagtccagtgcatgcttctaaagaaccagagaaatctatccaagaaattgcacaaggcttaattggttcaatcatgtcggtgaaggtaattctagcagatgaggataacaagaaattgatcttctctgagaaggaggcagcatggagtaagtattcaaaacaggtcaatgtaggggacatttttgaagtaagagttggttatgttgaggactatggtgcttttgttcatttgcgcttccctgacggtctttatcaccttactggactaatacacgtctcagaagtgtcatgggatctaattcaggatgtcagagatatcttaaaagtaggtgatgaagtgagggccaaagttgttggtattgattggggaaaatcaaggattaacctatcaattagacagctagaagaagatccactcttagaaactctggacaaagtaatacctcaggatggttcagctgatcctgattctatgagtggtggtgatagcggtagcattgagcctcttccagggcttgaaacaatccttgaagagctactacaggaagatggaatatatgacgtaagaatcagccgtcaagggtttgaaaaaagagtggtctcgcaagacttgcagctttggctttctaatgcacctcccacgaaccaaaggtttactctacttgcccgggctggaagacaggtgcaggagatacatctcactacatcccttgatcaggaaggtatcaggagggcattacaacgagtattggagcgtgtcccc

SEQ ID NO: 11318 - DNA, 2508 bp, Artificial sequence
  miR resistant mutant
atgtcttgtaaagatggtaaaggtgttatggataatggaaaatacgttcgttatacacctgaacaagttgaagctcttgagaggctttatcatgattgtcctaagccaagcagtattcgtcgtcaacagcttattcgagagtgtcctattctctctcatattgaacctaaacagatcaaagtttggttccaaaatagaagatgtagggagaagcagagaaaagaggcttcaaggttgcaagctgtgaataggaagttgagtgctatgaataagctgctgatggaagagaatgataggttgcagaaacaagtatctcatttggtgtatgaaaatggctactttcgccaacatactcaaaatactaatctggcaaccaaagatacaagctgtgattcggcggtgactagtggtcaacgcagtttgacagcccagcatccgccaagggatgcaagtcctgcagggcttttgtccattgcagaggaaactttagcagagtttctttcaaaggctactggaactgctgttgagtgggtccaaatgccaggcatgaaaccaggaccagagtctattggaatcattgcgatttctcatggttgccatggtgtggcggcaagagcatgtggcctagtggggctagaacctacaagggttgcagaaatcctcaaagatcggccctcgtggtatcgtgattgccgagctgtggatattctgaacgtgcttcccacagccaatggtggaaccatagagctgctttacatgcagctatatgcgccaactacattggctcctgctcgagacttatggttgttgcgctacacatctgttttagaagatggaagcctagtgatatgtgagaggtctcttaaaaacacacaaaatggtccaagcatgcctcctgtgcagcattttgtcagagctgagatgctgcccagtgggtacctgataaggccttgtgaaggaggtggttccatcatccacattgttgatcatatggatttggagccatggagtgttcccgaggtactgcgtccactctatgaatcatcaacaatgctggctcagaagacaacaatggtggccctacgtcacctaaggcagatttcacatgaagtttctcagtctaacgtcactggatggggtagacgaccagcagcacttcgagcacttggccaaagactgagccggggtttcaatgaggcactcaatgggtttactgatgagggatggtcaatgattggcaatgatggtgttgacgatgttactattctagtgaattcatcccctgacaaattaatgggtctgaatctttcatttgccaatggatttccatctgtcagtaatgcagtcttatgtgctaaagcttcaatgctgttacaaaatgtgcctccggccattctactaaggtttttacgggagcatagatcggagtgggcagacaacaacatggatgcttactcagctgctgccatcaaagctggtccttgtagtttctcaggatctcgggttggaaattatgggggccaagtaattcttcctctagcccacactattgagcacgaggagtttctggaagtcattaaattggaaggaattgcccattctcccgaagacgcgataatgcctagagaagtgtttcttttgcaactctgcagtggaatggatgagaatgctgttggtacctgtgctgaacttatatttgctccaattgatgcatcctttgctgatgatgccccccttctgccttctggatttcgtataattcctcttgattctggaaaggaagtggccaacaacccaaatcgcacccttgacctgacatctgcccttgatattggtcccgctggaaacaaagcttctaatgattattctggaaattctggctgtatgagatcagtgatgacaatagcatttgaatttgcttttgaaagtcatatgcaagaccatgtagcatctatggcacggcagtatgttcgcagcattatatcgtctgtccaaagggtagcattggcactttcaccttctaatttgaattcacaaggtgggctcaggacaccactgggtactcctgaagctcaaacacttgctcgttggatcagcaacagttataggtgcttcttgggtgctgagctacttaaatctaataatgaggggagcgaatcattactcaagtccttgtggcatcacactgatgcaatactctgctgcactctaaaggcattgcccgtgttcacttttgccaaccaggcagggcttgacatgctggagactaccttagttgctctgcaggatatagcattggagaaaatatttgatgaccatggccgaaagattctgtgctcggaatttcctctaattatacaacagggttttgcatgccttcaaggtggtctttgtctctcaagcatggggagacctatttcatatgaaagagtagtggcttggaaggtgctgaatgaagaagagaatgctcattgtatttgctttatgtttgtgaactggtcttttgtt

SEQ ID NO: 11319 - DNA, 2508 bp, Artificial sequence
  miR resistant mutant
atgtcttgtaaagatggtaaaggtgttatggataatggaaaatacgttcgttatacacctgaacaagttgaagctcttgagaggctttatcatgattgtcctaagccaagcagtattcgtcgtcaacagcttattcgagagtgtcctattctctctcatattgaacctaaacagatcaaagtttggttccaaaatagaagatgtagggagaagcagagaaaagaggcttcaaggttgcaagctgtgaataggaagttgagtgctatgaataagctgctgatggaagagaatgataggttgcagaaacaagtatctcatttggtgtatgaaaatggctactttcgccaacatactcaaaatactaatctggcaaccaaagatacaagctgtgattcggcggtgactagtggtcaacgcagtttgacagcccagcatccgccaagggatgcaagtcctgcagggcttttgtccattgcagaggaaactttagcagagtttctttcaaaggctactggaactgctgttgagtgggtccaaatgcctggcatgaaacctggacctgagtctattggaatcattgcgatttctcatggttgccatggtgtggcggcaagagcatgtggcctagtggggctagaacctacaagggttgcagaaatcctcaaagatcggccctcgtggtatcgtgattgccgagctgtggatattctgaacgtgcttcccacagccaatggtggaaccatagagctgctttacatgcagctatatgcgccaactacattggctcctgctcgagacttatggttgttgcgctacacatctgttttagaagatggaagcctagtgatatgtgagaggtctcttaaaaacacacaaaatggtccaagcatgcctcctgtgcagcattttgtcagagctgagatgctgcccagtgggtacctgataaggccttgtgaaggaggtggttccatcatccacattgttgatcatatggatttggagccatggagtgttcccgaggtactgcgtccactctatgaatcatcaacaatgctggctcagaagacaacaatggtggccctacgtcacctaaggcagatttcacatgaagtttctcagtctaacgtcactggatggggtagacgaccagcagcacttcgagcacttggccaaagactgagccggggtttcaatgaggcactcaatgggtttactgatgagggatggtcaatgattggcaatgatggtgttgacgatgttactattctagtgaattcatcccctgacaaattaatgggtctgaatctttcatttgccaatggatttccatctgtcagtaatgcagtcttatgtgctaaagcttcaatgctgttacaaaatgtgcctccggccattctactaaggtttttacgggagcatagatcggagtgggcagacaacaacatggatgcttactcagctgctgccatcaaagctggtccttgtagtttctcaggatctcgggttggaaattatgggggccaagtaattcttcctctagcccacactattgagcacgaggagtttctggaagtcattaaattggaaggaattgcccattctcccgaagacgcgataatgcctagagaagtgtttcttttgcaactctgcagtggaatggatgagaatgctgttggtacctgtgctgaacttatatttgctccaattgatgcatcctttgctgatgatgccccccttctgccttctggatttcgtataattcctcttgattctggaaaggaagtggccaacaacccaaatcgcacccttgacctgacatctgcccttgatattggtcccgctggaaacaaagcttctaatgattattctggaaattctggctgtatgagatcagtgatgacaatagcatttgaatttgcttttgaaagtcatatgcaagaccatgtagcatctatggcacggcagtatgttcgcagcattatatcgtctgtccaaagggtagcattggcactttcaccttctaatttgaattcacaaggtgggctcaggacaccactgggtactcctgaagctcaaacacttgctcgttggatcagcaacagttataggtgcttcttgggtgctgagctacttaaatctaataatgaggggagcgaatcattactcaagtccttgtggcatcacactgatgcaatactctgctgcactctaaaggcattgcccgtgttcacttttgccaaccaggcagggcttgacatgctggagactaccttagttgctctgcaggatatagcattggagaaaatatttgatgaccatggccgaaagattctgtgctcggaatttcctctaattatacaacagggttttgcatgccttcaaggtggtctttgtctctcaagcatggggagacctatttcatatgaaagagtagtggcttggaaggtgctgaatgaagaagagaatgctcattgtatttgctttatgtttgtgaactggtcttttgtt

SEQ ID NO: 11320 - DNA, 2532 bp, Artificial sequence
  miR resistant mutant
atggcgatggcgattgcgcagcagcatagggagagtagtagcagtggtagcatcaacaagcatcttgactccggaaaatatgtgcggtacaccgcagagcaggtcgaggctctggaacgagtctacttagagtgtccaaagcccagttctcttcggcggcagcagctgatccgggagtgtcctattctctctaatattgagcccaagcaaatcaaagtctggtttcagaatcgcagatgtcgagagaagcagagaaaagaggcttctcgactccagaccgtgaacaggaaattgacggccatgaacaagctgttgatggaggagaatgatcggctgcagaaacaagtgtcgcagctggtatgcgagaatgggtatatgcgacaacagcttcaaactgcatcagctgcaactactgatgctagctgtgaatctgtggttaccactcctcagcattctctgagagatgctaataaccctgctggactcctctccattgcagaggagactttggcagagttcctctcaaaggctacaggaactgctgtcgattgggtccagatgccaggaatgaaaccaggaccagactcggttgggatctttgccatttcacatagttgcagtggagtggcagctcgagcatgcggtcttgtaagtttagaaccctcaaagattgcagagatcctcaaagatcgtccatcttggttccgggactgtcggagccttgaagttttcaccatgtttccagctggaaatggaggaactgttgaactcttatacacacagatatatgccccaactacgctggctcctgcacgggatttctggactctaagatacaccaccagtttggacaatggcagtctcgtggtctgtgagagatcactgtctggttctggagctggtccaaacaccgctgctgctgctcagtttgtgagagctgaaatgcttcctagtggctatcttattcgtccatgtgagggtggaggatcgatcatccatattgttgaccacctgaatcttgaggcatggagtgtgccagaggtgctgcgaccactttatgaatcttcaagagttgtagctcagaaaatgactattgcagcattgcgctacatccggcaaatagctcaggagacaagtggtgaggtggtatatggtttgggcaggcagccagctgttctgcgaacttttagccaaagattgagcagaggcttcaatgatgctatcaacggatttaatgatgacggctggtcattgatgagttgtgatggtgctgaagatgtaataattgcagttaactcaaccaaaaatttgaacaccacttctaatcctgctaattccctttccttgcctgggggggttctctgtgctaaagcatccatgctgctccaaaatgttcctccggcagttctggttcgcttcctgagggagcaccggtcagagtgggctgattttagtgttgatgcctattctgctgcatcattgaaagctagcccatactcttatccagggatgaggcccacgaggtttactgggagccaaattattatgccacttggtcacacaattgaacatgaagagttgcttgaagtaattcgacttgaaggccattctcttgctcatgaagatgcttttatgtcgagggacattcatctcctgcagatatgtagtggagttgacgagaatgcagtgggagcttgttctgaacttgtttttgctccaattgatgaaatgtttccagatgatgctccactgttaccctctggttttcggatcatcccactggattcaaaatcaggtgatacacaggagacattgactactcatcggaccttggatctgacatccagtcttgaagtgggcccagcaacaaatcaggctgcaggggattcatcatcatgctataacacacgatcagtcttgactattgccttccagtttccatttgagagcaatctacaggataatgttgcaacaatggctcgtcagtatgttcggagcgtgatttcctctgtgcagagggttgccatggccatatctccttcaggattgggcccagctgtgggaccaaagctgtcagcagggtctccagaagctcttacattagcccactggatctgccagagctatagttaccatgttggggcggagttgctgagatctgattctgtgggtggcgattcggtgttaaaaaatttgtggcatcaccaggatgctattttgtgctgctcattaaagtcattgccagttttgatctttgcaaaccaggcaggacttgacatgctggagacaactttagtagctctacaagacatctcattggataagatatttgatgagtctggacgcaagggattgtgtgcagatttcgccaagataatgcaacagggttttgcttacttgccggctggaatctgcatgtcaacaatggggcgccatgtttcatatgaacaggccatcgcatggaaagtccttgctgcggaagagaacactgtccattgccttgctttctctttcatcaactggtcttttgtg

SEQ ID NO: 11321 - DNA, 2532 bp, Artificial sequence
  miR resistant mutant
atggcgatggcgattgcgcagcagcatagggagagtagtagcagtggtagcatcaacaagcatcttgactccggaaaatatgtgcggtacaccgcagagcaggtcgaggctctggaacgagtctacttagagtgtccaaagcccagttctcttcggcggcagcagctgatccgggagtgtcctattctctctaatattgagcccaagcaaatcaaagtctggtttcagaatcgcagatgtcgagagaagcagagaaaagaggcttctcgactccagaccgtgaacaggaaattgacggccatgaacaagctgttgatggaggagaatgatcggctgcagaaacaagtgtcgcagctggtatgcgagaatgggtatatgcgacaacagcttcaaactgcatcagctgcaactactgatgctagctgtgaatctgtggttaccactcctcagcattctctgagagatgctaataaccctgctggactcctctccattgcagaggagactttggcagagttcctctcaaaggctacaggaactgctgtcgattgggtccagatgcctggaatgaaacctggacctgactcggttgggatctttgccatttcacatagttgcagtggagtggcagctcgagcatgcggtcttgtaagtttagaaccctcaaagattgcagagatcctcaaagatcgtccatcttggttccgggactgtcggagccttgaagttttcaccatgtttccagctggaaatggaggaactgttgaactcttatacacacagatatatgccccaactacgctggctcctgcacgggatttctggactctaagatacaccaccagtttggacaatggcagtctcgtggtctgtgagagatcactgtctggttctggagctggtccaaacaccgctgctgctgctcagtttgtgagagctgaaatgcttcctagtggctatcttattcgtccatgtgagggtggaggatcgatcatccatattgttgaccacctgaatcttgaggcatggagtgtgccagaggtgctgcgaccactttatgaatcttcaagagttgtagctcagaaaatgactattgcagcattgcgctacatccggcaaatagctcaggagacaagtggtgaggtggtatatggtttgggcaggcagccagctgttctgcgaacttttagccaaagattgagcagaggcttcaatgatgctatcaacggatttaatgatgacggctggtcattgatgagttgtgatggtgctgaagatgtaataattgcagttaactcaaccaaaaatttgaacaccacttctaatcctgctaattccctttccttgcctgggggggttctctgtgctaaagcatccatgctgctccaaaatgttcctccggcagttctggttcgcttcctgagggagcaccggtcagagtgggctgattttagtgttgatgcctattctgctgcatcattgaaagctagcccatactcttatccagggatgaggcccacgaggtttactgggagccaaattattatgccacttggtcacacaattgaacatgaagagttgcttgaagtaattcgacttgaaggccattctcttgctcatgaagatgcttttatgtcgagggacattcatctcctgcagatatgtagtggagttgacgagaatgcagtgggagcttgttctgaacttgtttttgctccaattgatgaaatgtttccagatgatgctccactgttaccctctggttttcggatcatcccactggattcaaaatcaggtgatacacaggagacattgactactcatcggaccttggatctgacatccagtcttgaagtgggcccagcaacaaatcaggctgcaggggattcatcatcatgctataacacacgatcagtcttgactattgccttccagtttccatttgagagcaatctacaggataatgttgcaacaatggctcgtcagtatgttcggagcgtgatttcctctgtgcagagggttgccatggccatatctccttcaggattgggcccagctgtgggaccaaagctgtcagcagggtctccagaagctcttacattagcccactggatctgccagagctatagttaccatgttggggcggagttgctgagatctgattctgtgggtggcgattcggtgttaaaaaatttgtggcatcaccaggatgctattttgtgctgctcattaaagtcattgccagttttgatctttgcaaaccaggcaggacttgacatgctggagacaactttagtagctctacaagacatctcattggataagatatttgatgagtctggacgcaagggattgtgtgcagatttcgccaagataatgcaacagggttttgcttacttgccggctggaatctgcatgtcaacaatggggcgccatgtttcatatgaacaggccatcgcatggaaagtccttgctgcggaagagaacactgtccattgccttgctttctctttcatcaactggtcttttgtg

SEQ ID NO: 11322 - DNA, 2514 bp, Artificial sequence
  miR resistant mutant
atgtcctgcaaggatggtagcagaaacggaatcggaatggataacgggaagtatgtccgttacacgcctgagcaggttgaagccctagaaaggctctatcacgattgccccaaacctagttccattcgccgccagcagctcattcgcgagtgccccattctctccaacatcgaacccaagcaaatcaaggtttggttccagaacagaagatgtagagagaagcagagaaaggagtcgtcgcggctgcaagctgtcaataggaagctgactgctatgaacaagctgctgatggaagagaatgataggttgcagaagcaggtgtctcaactcgtctatgaaaatggctattttcgtcaacacacccagattactacgcaggcaaccaaagacacaaactgtgaatcagttgtgacgagtggtcagcagcacaatttgataactcaacatcccccacgggatgcaagtcctgcagggcttttgtccattgcagaagagactttagcagaatttctttctaaggctactgggactgctgttgagtgggtccaaatgccaggcatgaaaccaggaccagactccattggaatcgttgctatttctcatggttgcactggtgtggcagctagagcctgtggtctagtgggactagaacccactagggttgcagaaatcctcaaagatcagcctttgtggtttcgcgattgccgagctgttgatgttctcaatgtgctgcccacagcaaatggtggaaccattgagctgctttatatgcagctatatgcaccaaccacattggctcctgctcgagacttctggttgttgcgctacacttctgttttagaagatggaagcctagtgatctgcgagaggtctcttaaaaatactcaaaatggtccaagcatgcctcccgtgcagcattttgttagagctgagatgctgcctagtgggtacctgatcagaccttgtgaaggaggtggttcgatcatccacattgttgatcatatggatttagagccatggagtgtgccagaggtgctacgtccactgtacgaatcatcaacagtactggctcagaagacaactatggcggccctacgtcatctaaggcagatttcacatgaagtttctcagtccaacgtcactgggtggggtagacgaccggcagcactacgagctcttagccaaagattgagcaggggttttaatgaggcactcaatgggtttactgatgagggatggacaacaattggcaatgatggtgtagatgatgttactattctagtgaattcatcccctgacaagttaatgggtctgaatctttcctttgccaatggatttccgtctgttagtaatgcagtgctatgtgccaaagcatcgatgctattacagaatgtgccccctgccattctcctaaggttcctgagggagcatagatcagaatgggcagacaacaatatggatgcttacacagctgctgctattaaagtcggcccttgcagcctatcaggatctcgtgttggaaactatggaggtcaagttatactccccctagcacacacaattgagcatgaggagtttttggaagtcattaaattggaaggaatagctcattctcctgaagacacaataatgcctagagaaatgtttcttttgcaactctgcagtggaatggatgagaatgctgttggcacctgtgctgaacttatatctgctccaattgatgcttcctttgctgatgatgcccccctcctaccttctggatttcgcatcattcctcttgaatctggaaaggaagcttccagccccaatcgcacacttgaccttgcatctgcccttgacgttggtcccagtggaaaccgagcttcaaatggatgtgctaattccagctgtatgagatctgtgatgacaatagcatttgaatttgcatttgaaagccatatgcaagagcatgtagcatctatggcacgccaatatgttcggagcattatatcatcagtccaaagggtagcattagcactttctccttctcatttgagttcacatgcagggcttaggtcaccattgggtactcctgaagcgcaaacccttgctcattggatctgcaacagttataggtgctacttgggtgtggagctacttaaatctaacaacgaggggaatgaatctttgctcaagtccttgtggcatcactcagatgcaatattgtgctgcactctaaaggcattgccagtgttcactttctcgaaccaggctgggcttgacatgcttgagaccaccctagttgcattacaagatataactttagagaaaatatttgatgatcatggacgaaaaattctcttttcagagtttccacagattatccaacagggttttgcatgtcttcaaggtggcatttgtctttcaagcatggggcgacctgtctcatatgaaagagttgttgcttggaaggtgctgaatgaagaagagaatgctcattgtatttgctttatgtttgtgaactggtcttttgtt

SEQ ID NO: 11323 - DNA, 2514 bp, Artificial sequence
  miR resistant mutant
atgtcctgcaaggatggtagcagaaacggaatcggaatggataacgggaagtatgtccgttacacgcctgagcaggttgaagccctagaaaggctctatcacgattgccccaaacctagttccattcgccgccagcagctcattcgcgagtgccccattctctccaacatcgaacccaagcaaatcaaggtttggttccagaacagaagatgtagagagaagcagagaaaggagtcgtcgcggctgcaagctgtcaataggaagctgactgctatgaacaagctgctgatggaagagaatgataggttgcagaagcaggtgtctcaactcgtctatgaaaatggctattttcgtcaacacacccagattactacgcaggcaaccaaagacacaaactgtgaatcagttgtgacgagtggtcagcagcacaatttgataactcaacatcccccacgggatgcaagtcctgcagggcttttgtccattgcagaagagactttagcagaatttctttctaaggctactgggactgctgttgagtgggtccaaatgcctggcatgaaacctggacctgactccattggaatcgttgctatttctcatggttgcactggtgtggcagctagagcctgtggtctagtgggactagaacccactagggttgcagaaatcctcaaagatcagcctttgtggtttcgcgattgccgagctgttgatgttctcaatgtgctgcccacagcaaatggtggaaccattgagctgctttatatgcagctatatgcaccaaccacattggctcctgctcgagacttctggttgttgcgctacacttctgttttagaagatggaagcctagtgatctgcgagaggtctcttaaaaatactcaaaatggtccaagcatgcctcccgtgcagcattttgttagagctgagatgctgcctagtgggtacctgatcagaccttgtgaaggaggtggttcgatcatccacattgttgatcatatggatttagagccatggagtgtgccagaggtgctacgtccactgtacgaatcatcaacagtactggctcagaagacaactatggcggccctacgtcatctaaggcagatttcacatgaagtttctcagtccaacgtcactgggtggggtagacgaccggcagcactacgagctcttagccaaagattgagcaggggttttaatgaggcactcaatgggtttactgatgagggatggacaacaattggcaatgatggtgtagatgatgttactattctagtgaattcatcccctgacaagttaatgggtctgaatctttcctttgccaatggatttccgtctgttagtaatgcagtgctatgtgccaaagcatcgatgctattacagaatgtgccccctgccattctcctaaggttcctgagggagcatagatcagaatgggcagacaacaatatggatgcttacacagctgctgctattaaagtcggcccttgcagcctatcaggatctcgtgttggaaactatggaggtcaagttatactccccctagcacacacaattgagcatgaggagtttttggaagtcattaaattggaaggaatagctcattctcctgaagacacaataatgcctagagaaatgtttcttttgcaactctgcagtggaatggatgagaatgctgttggcacctgtgctgaacttatatctgctccaattgatgcttcctttgctgatgatgcccccctcctaccttctggatttcgcatcattcctcttgaatctggaaaggaagcttccagccccaatcgcacacttgaccttgcatctgcccttgacgttggtcccagtggaaaccgagcttcaaatggatgtgctaattccagctgtatgagatctgtgatgacaatagcatttgaatttgcatttgaaagccatatgcaagagcatgtagcatctatggcacgccaatatgttcggagcattatatcatcagtccaaagggtagcattagcactttctccttctcatttgagttcacatgcagggcttaggtcaccattgggtactcctgaagcgcaaacccttgctcattggatctgcaacagttataggtgctacttgggtgtggagctacttaaatctaacaacgaggggaatgaatctttgctcaagtccttgtggcatcactcagatgcaatattgtgctgcactctaaaggcattgccagtgttcactttctcgaaccaggctgggcttgacatgcttgagaccaccctagttgcattacaagatataactttagagaaaatatttgatgatcatggacgaaaaattctcttttcagagtttccacagattatccaacagggttttgcatgtcttcaaggtggcatttgtctttcaagcatggggcgacctgtctcatatgaaagagttgttgcttggaaggtgctgaatgaagaagagaatgctcattgtatttgctttatgtttgtgaactggtcttttgtt

SEQ ID NO: 11324 - DNA, 2559 bp, Artificial sequence
  miR resistant mutant
atggcactttgtatgcagagtcagcagagagattcagcatcaaacaagctgctcatggattgtggcaagtatgtgaggtacacacctgaacaggtggaggctttggagagggtgtatgttgaatgtccaaagcctagttcttccagaaggcaacaaatcattagggagtgtccactccttgctaacattgaaacaaagcagatcaaagtgtggttccagaatcgcagatgtcgtgaaaagcagcggaaggaagcctctcgtctgcagacagtgaatagaaagctgtcttcaatgaacaagttgttaatggaagagaacgaccgactgcagaagcaggtctcacagttggtttatgataatggattcatgaaacaacaaatacatactgcatctgctactactactactactactgacaatagctgtgagtctgtggtagtgagtggtcaacaccaaccgcaaaaccccaaaactcagcatccccagtgggatgccaacaacccagctggtcttcttgctattgctcaggagaccctagtggagttcctttccaaagctactggaactgctgtcaactgggtccagatgataggaatgaaaccaggaccagactctattggaattgttgctgtttcccgcaactgtagtggcgtagcggcaagagcctgtggccttgtgagcctagagcccacaaaggttgccgagattctcaaagatcgtccatcatggtatcgtgactgtcgatgcctcaatgtattgagtgtagtctccgcagggaatgggggcacaatagagcttatgtacatgcagacatatgcaccaacaacattggcagctgcaagagacttctggactctgagatactctactagtttggaagatggaagtcttgtgatttgtgagaggtccttgacttcttcaactggtggccccacagggccagctgcttcaaacttcatacgagctgaaatgcttcccagtggctatctaattagatcctgtgagggtggtggatctatcattcacattgttgatcatgttgatttagatgtttggagtgttcctgaagtacttagacccctctatgaatcaccaaaattcttggctcagaaattgactactgctgcattgcgacatgcaagacaaattgcacaggaatcaagtggagatgttcattatggtgggggtcgtcaacctgctgtcttgaggacatttagtcaaaggctttgcaaagggttcaatgatgctgtcaacgggtttgtggatgatggttggtcactgatgggtaatgatggggtggaagatgtgaccatagccataaactcgtctcccaacaagtttttcggttcccattacaatacatcaatgcttccagcatttggaggtggggtcatgtgtgccaaggcatcaatgctgctacagaatgttcctcctgctttgcttgttcgttttctgagggagcatcgttcagagtgggctaattatgaagttgatgcatactcttctgcatgtctcaaagctagtccttatgcagttccttgtgcaagacctagtggtttcccaagcagccatgtcattataccacttgctcatactattgagcatgaggagttcttggaggtagttcgtattgagggtaatgcatttccccctgatgatgtagcttgggcatgtgatatgtatctaatgcagctgtgcagtggaattgatgaaaatgcaattggagcgtgtgcacagcttgtgtttgcacctattgatgaatcatttgcagatgatgctctcttactgccttctggtttccgtatcataccattggatcctaaaacagatggtttggcttcaactaggacattggacttagcatcaacactggaaacaggatctggtaatgcccgctcagctggtgaaagtgactcgaataactacaaccttaggtcggtcctcacaattgcattccaatttacctttgagaaccatttgcgggacaatgtggctgttatggctcgccagtatgtgcgtaatgttgtgcgatctgttcagagggttgccatggcaattgctccctctaggctcagtacacagttggggccaaagtcatttcctggtccaccagaggctcttaccttagcaagatggatctgcagaagctacaggctccacacctgcacagagcttttcagcgttgagtccacatctggtgatgcaatcttgaaacaactttggcaccatccagatgcaatattgtgctgttctgtaaaaacagatgcatctccggtgttcacctttgcaaaccaagctggacttgacatgcttgaaaccactcttgttgctcttcaagacataatgctggataaagttcttgatgaagctggcaggaaggttctctgcattgagttctccaagataatgcaacagggatttgcatatctgccagcaggaatatgtgtatcaagtatgaatcgaccagtgtcttatgagcaggccattgcatggaaagttctcgatgatgatgattccaatcactgccttgccttcgtattcatgaactggtcttttgtc

SEQ ID NO: 11325 - DNA, 2559 bp, Artificial sequence
  miR resistant mutant
atggcactttgtatgcagagtcagcagagagattcagcatcaaacaagctgctcatggattgtggcaagtatgtgaggtacacacctgaacaggtggaggctttggagagggtgtatgttgaatgtccaaagcctagttcttccagaaggcaacaaatcattagggagtgtccactccttgctaacattgaaacaaagcagatcaaagtgtggttccagaatcgcagatgtcgtgaaaagcagcggaaggaagcctctcgtctgcagacagtgaatagaaagctgtcttcaatgaacaagttgttaatggaagagaacgaccgactgcagaagcaggtctcacagttggtttatgataatggattcatgaaacaacaaatacatactgcatctgctactactactactactactgacaatagctgtgagtctgtggtagtgagtggtcaacaccaaccgcaaaaccccaaaactcagcatccccagtgggatgccaacaacccagctggtcttcttgctattgctcaggagaccctagtggagttcctttccaaagctactggaactgctgtcaactgggtccagatgattggaatgaaaccaggaccagactctattggaattgttgctgtttcccgcaactgtagtggcgtagcggcaagagcctgtggccttgtgagcctagagcccacaaaggttgccgagattctcaaagatcgtccatcatggtatcgtgactgtcgatgcctcaatgtattgagtgtagtctccgcagggaatgggggcacaatagagcttatgtacatgcagacatatgcaccaacaacattggcagctgcaagagacttctggactctgagatactctactagtttggaagatggaagtcttgtgatttgtgagaggtccttgacttcttcaactggtggccccacagggccagctgcttcaaacttcatacgagctgaaatgcttcccagtggctatctaattagatcctgtgagggtggtggatctatcattcacattgttgatcatgttgatttagatgtttggagtgttcctgaagtacttagacccctctatgaatcaccaaaattcttggctcagaaattgactactgctgcattgcgacatgcaagacaaattgcacaggaatcaagtggagatgttcattatggtgggggtcgtcaacctgctgtcttgaggacatttagtcaaaggctttgcaaagggttcaatgatgctgtcaacgggtttgtggatgatggttggtcactgatgggtaatgatggggtggaagatgtgaccatagccataaactcgtctcccaacaagtttttcggttcccattacaatacatcaatgcttccagcatttggaggtggggtcatgtgtgccaaggcatcaatgctgctacagaatgttcctcctgctttgcttgttcgttttctgagggagcatcgttcagagtgggctaattatgaagttgatgcatactcttctgcatgtctcaaagctagtccttatgcagttccttgtgcaagacctagtggtttcccaagcagccatgtcattataccacttgctcatactattgagcatgaggagttcttggaggtagttcgtattgagggtaatgcatttccccctgatgatgtagcttgggcatgtgatatgtatctaatgcagctgtgcagtggaattgatgaaaatgcaattggagcgtgtgcacagcttgtgtttgcacctattgatgaatcatttgcagatgatgctctcttactgccttctggtttccgtatcataccattggatcctaaaacagatggtttggcttcaactaggacattggacttagcatcaacactggaaacaggatctggtaatgcccgctcagctggtgaaagtgactcgaataactacaaccttaggtcggtcctcacaattgcattccaatttacctttgagaaccatttgcgggacaatgtggctgttatggctcgccagtatgtgcgtaatgttgtgcgatctgttcagagggttgccatggcaattgctccctctaggctcagtacacagttggggccaaagtcatttcctggtccaccagaggctcttaccttagcaagatggatctgcagaagctacaggctccacacctgcacagagcttttcagcgttgagtccacatctggtgatgcaatcttgaaacaactttggcaccatccagatgcaatattgtgctgttctgtaaaaacagatgcatctccggtgttcacctttgcaaaccaagctggacttgacatgcttgaaaccactcttgttgctcttcaagacataatgctggataaagttcttgatgaagctggcaggaaggttctctgcattgagttctccaagataatgcaacagggatttgcatatctgccagcaggaatatgtgtatcaagtatgaatcgaccagtgtcttatgagcaggccattgcatggaaagttctcgatgatgatgattccaatcactgccttgccttcgtattcatgaactggtcttttgtc

SEQ ID NO: 11326 - DNA, 2532 bp, Artificial sequence
  miR resistant mutant
atgatgacggtgagttcagcctgcaaagatgggagcaaggtggcactggacaacggcaagtacgttaggtacacacctgaacaggttgaagcactggaaagactctaccatgaatgtcccaaaccaagttccctccgccgccaacaactcatcagagagtgtcccatcctctccaacatcgaacccaaacagataaaggtttggttccaaaaccgaaggtgcagagagaagcagcggaaagaagcatcacggctgcaagctgtgaacaggaagctaacagcaatgaataaattactgatggaggaaaacgacagattgcagaagcaggtgtcacacctcgtctatgaaaacagctttttccgccaacagacacacaacaacgctacgcttgccacaacggacacaaacacaagctgtgagtcggtggtgacgagtggtcagcggaacttgacaccgcagcagcatccgccgagggatgctagccctgcaggacttttgtccatcgcagaggagactttagcagagtttctttcaaaggccactggaactgctgtcgagtgggtccaaatgccaggaatgaaaccaggaccagactccattggaatcgttgctatttctcacggttgccctggagtggccgcacgtgcctgcggccttgttggtctagaacctgccagggttgccgaaatactcaaagataggctctcatggtttcgtgattgccgaactgtggatgttctaaatgtgatgtccactggaaatggtggaaccattgagctgctttacatgcagttgtatgcgccaacaactttggcacctggtcgtgacttctggttgctgcgctacacatcacttttagaggacggtagtcttgtggtctgtgaaagatcactaaataacactcagaatggtcctgctatgcccccagtgcagcattttgttagagcagacatgctggcaagcgggtatctgataaggccttgcgaaggagggggatcaattattcatattgttgatcatatggttctagagccatggagtgtacctgaggttttgcgcccactttatgagtcatcaatgctgcttgctcaaaggacaactatggcggccttacgtcatttgaggcagatttctcaagaggtttctcagccaagtgtaacaggatggggaagaaggcctgcagctctacgtgcgctgagccagagattgagcaagggctttaatgaagctgtcaatgggtttgcagatgatggctggtccatgttagagagtgatggcattgatgatgttacccttcttgtgaattcctcacctagcaagatgatgggagttaaccttggctataacaacaatggatttccttctgtaagcagttctttgctatgtgccaaagcatccatgttgctacagaatgtccctccagcaattcttcttagattcttgcgggagcaccgatcagaatgggcagatagcagtattgatgcttactcagctgctgccattaaagctggtccttgtagcttgccaggggcccgacccggaggttttgggggtcaggttattcttccactagcccacacaattgagcatgaagagttcatggaggttatcaagcttgaaaacatgggctattatagggacgacatgaatatacctggtgatgttttcctcttgcaactttgcagtggagtggatgagcatgcagttggcaccagcgcagaacttgtttttgctccaatcgatgcatctttctctgatgatgcgcccattttaccttctggttttcgcatcatacctcttgattctggcacagatgctgctagtccaaaccgtacacttgatctggcttctgcacttgaagttggaacaacagcaaacaaagcagctggtgacaactcaggtcattccgggagcacaaagtctgtgatgacaatagcattccagtttgcgtttgaagtccaccttcaggagaacatagcaaccatggccagacaatatgttcgtagtatcattgcatctgttcaaagggtttcattagcactttctccttcgcgctttggttctcacaatgctttccacttaccacctggcactcctgaggcacaaacacttgctcgatggatctgtaacagctaccggttctatcttggggtagaacttctaaaatgtgaaggcagtgaatccattctcaagtctctttggcatcactcagatgcagttttgtgctgctctttaaaggcattacccgttttcacgtttgcaaatcaagctggacttgacatgcttgagacaacattggttgcacttcaagacatcactctggaaaagatttttgatgacaatggaaagaaaactctgtgcaccgagttcccccagataatgcagcagggtttcatgtgtattcaaggtggtatctgtttatccagcatgggaaggccagtatcctatgagagagcagttgcatggaaagtgttaaacgaagaagaatctgctcattgcatctgttttatgttcatcaattggtcctttgtc

SEQ ID NO: 11327 - DNA, 2532 bp, Artificial sequence
  miR resistant mutant
atgatgacggtgagttcagcctgcaaagatgggagcaaggtggcactggacaacggcaagtacgttaggtacacacctgaacaggttgaagcactggaaagactctaccatgaatgtcccaaaccaagttccctccgccgccaacaactcatcagagagtgtcccatcctctccaacatcgaacccaaacagataaaggtttggttccaaaaccgaaggtgcagagagaagcagcggaaagaagcatcacggctgcaagctgtgaacaggaagctaacagcaatgaataaattactgatggaggaaaacgacagattgcagaagcaggtgtcacacctcgtctatgaaaacagctttttccgccaacagacacacaacaacgctacgcttgccacaacggacacaaacacaagctgtgagtcggtggtgacgagtggtcagcggaacttgacaccgcagcagcatccgccgagggatgctagccctgcaggacttttgtccatcgcagaggagactttagcagagtttctttcaaaggccactggaactgctgtcgagtgggtccaaatgcctggaatgaaacctggacctgactccattggaatcgttgctatttctcacggttgccctggagtggccgcacgtgcctgcggccttgttggtctagaacctgccagggttgccgaaatactcaaagataggctctcatggtttcgtgattgccgaactgtggatgttctaaatgtgatgtccactggaaatggtggaaccattgagctgctttacatgcagttgtatgcgccaacaactttggcacctggtcgtgacttctggttgctgcgctacacatcacttttagaggacggtagtcttgtggtctgtgaaagatcactaaataacactcagaatggtcctgctatgcccccagtgcagcattttgttagagcagacatgctggcaagcgggtatctgataaggccttgcgaaggagggggatcaattattcatattgttgatcatatggttctagagccatggagtgtacctgaggttttgcgcccactttatgagtcatcaatgctgcttgctcaaaggacaactatggcggccttacgtcatttgaggcagatttctcaagaggtttctcagccaagtgtaacaggatggggaagaaggcctgcagctctacgtgcgctgagccagagattgagcaagggctttaatgaagctgtcaatgggtttgcagatgatggctggtccatgttagagagtgatggcattgatgatgttacccttcttgtgaattcctcacctagcaagatgatgggagttaaccttggctataacaacaatggatttccttctgtaagcagttctttgctatgtgccaaagcatccatgttgctacagaatgtccctccagcaattcttcttagattcttgcgggagcaccgatcagaatgggcagatagcagtattgatgcttactcagctgctgccattaaagctggtccttgtagcttgccaggggcccgacccggaggttttgggggtcaggttattcttccactagcccacacaattgagcatgaagagttcatggaggttatcaagcttgaaaacatgggctattatagggacgacatgaatatacctggtgatgttttcctcttgcaactttgcagtggagtggatgagcatgcagttggcaccagcgcagaacttgtttttgctccaatcgatgcatctttctctgatgatgcgcccattttaccttctggttttcgcatcatacctcttgattctggcacagatgctgctagtccaaaccgtacacttgatctggcttctgcacttgaagttggaacaacagcaaacaaagcagctggtgacaactcaggtcattccgggagcacaaagtctgtgatgacaatagcattccagtttgcgtttgaagtccaccttcaggagaacatagcaaccatggccagacaatatgttcgtagtatcattgcatctgttcaaagggtttcattagcactttctccttcgcgctttggttctcacaatgctttccacttaccacctggcactcctgaggcacaaacacttgctcgatggatctgtaacagctaccggttctatcttggggtagaacttctaaaatgtgaaggcagtgaatccattctcaagtctctttggcatcactcagatgcagttttgtgctgctctttaaaggcattacccgttttcacgtttgcaaatcaagctggacttgacatgcttgagacaacattggttgcacttcaagacatcactctggaaaagatttttgatgacaatggaaagaaaactctgtgcaccgagttcccccagataatgcagcagggtttcatgtgtattcaaggtggtatctgtttatccagcatgggaaggccagtatcctatgagagagcagttgcatggaaagtgttaaacgaagaagaatctgctcattgcatctgttttatgttcatcaattggtcctttgtc

SEQ ID NO: 11328 - DNA, 2523 bp, Artificial sequence
  miR resistant mutant
atgtcctgcaaggatggtagcagaaacggaatcggaatggataacgggaagtatgtccgttacacgcctgagcaggttgaagccctagaaaggctctatcacgattgccccaaacctagttccattcgccgccagcagctcattcgcgagtgccccattctctccaacatcgaacccaagcaaatcaaggtttggttccagaacagaagatgtagagagaagcagagaaaggagtcgtcgcggctccaagctgtcaataggaagctgactgctatgaacaagctgctgatggaagagaatgataggttgcagaagcaggtgtctcaactcgtctatgaaaatggctattttcgtcaacacaccacccaaaatactaagcagcagccaaccaaagacacaagctgtgaatcagctgtgacgagtggtcagcagcacaatttgacaactcaacatcccccacgggatgcaagtcctgcagggcttttgtccattgcagaagagactttagcagaatttctttctaaggctactggaactgctgttgagtgggtccaaatgccaggcatgaaaccaggaccagactccattggaatcgttgctatttctcacagttgcactggagtagcagcaagagcttgtggtttagtgggactagaacccactagggttgcagaaatcctcaaagatcggcctttgtggtttcaggattgccgagctgttgatgttctcaatgtgctgcccacagcaaatggtggaaccattgagctgctttatatgcagctatatgcaccaaccacattggctcctgctcgagacttctggttgttgcgctacacttctgttttagaagatggcagcttagtgatctgtgagaggtcacttaaaaatactcaaaatggtccaagcatgcctcctgtgcagcattttgttagagcagagatgctgcctagtgggtacctgatcagaccatgtgaaggaggcggttccatcatccacattgttgatcatatgaatttagagccatggagtgtgccagaagtgctacgtccactgtacgagtcatcaacggtactggctcagaagacatctatcgtggccctacgccatctaaggcagatttcacatgaagtttctcagtccaacgtcactgggtggggtaggagaccagcagcactacgagctcttagccaaagattgagccggggtttcaatgaggcactcaatgggtttactgatgagggatggacaacgattggcaatgatggtgtagatgatgttactattctagtgaactcatcccctgacaagttaatgggtctgaatctttcctttgccaatggatttccgtctgtcagtaatgcagtgctatgtgccaaagcatcgatgctattacagaatgtgccccctgccattctccttaggtttctgcgggagcatagatcagaatgggcagacaataatatggatgcttacacagctgctgctattaaagttggcccttgcagcttatcaggatctcgtgttggaaactatggaggtcaagttatactcccccttgcacacacaattgaacatgaggagtttttggaggtcattaaattggaaggaattgctcattctcctgaagacacaataatgcccagagaaatgtttcttttgcaactttgcagtggaatggatgagaatgctgttggcacctgtgctgaacttatatctgctccaattgatgcttcctttgctgatgatgccccccttttaccttctggatttcgcatcattcctcttgaatctggaaaggaagcttccagccccaatcgcacccttgaccttgcatctgctctagacattggttccagtggaaaccgagcttcaaatgaatgtgctggaaattccagctatatgagatctgtgatgacaatagcttttgaatttgcatttgaaagccatatgcaagagcatgtagcatctatggcacgtcaatatgttcggagcattatatcatcggtccaaagggtagcattagcactttctccttctcatttgagttcacatgcagggcttaggtcaccattgggtactcctgaagcgcaaacccttgctcattggatttgcaacagttataggtgctacttgggtgtggagctacttaaatctaataatgaggggaatgaatctttgctcaagtccttgtggcatcactcagatgcaatattgtgctgcactctaaaggcattgccagtgttcactttctcgaaccaggctgggcttgacatgctggagaccacccttgttgcattacaagatacacctttagagaaaatatttgatgatcatggacgaaaaatacttttttcagagtttccccagattattcaacagggttttgtatgtcttcaaggtggtatttgtctttcaagcatggggcgacctgtctcgtacgaaagagttgttgcttggaaggtgctgaatgaagaagagaatgctcattgtatgtgctttatgtttatgaactggtcttttgtt

SEQ ID NO: 11329 - DNA, 2523 bp, Artificial sequence
  miR resistant mutant
atgtcctgcaaggatggtagcagaaacggaatcggaatggataacgggaagtatgtccgttacacgcctgagcaggttgaagccctagaaaggctctatcacgattgccccaaacctagttccattcgccgccagcagctcattcgcgagtgccccattctctccaacatcgaacccaagcaaatcaaggtttggttccagaacagaagatgtagagagaagcagagaaaggagtcgtcgcggctccaagctgtcaataggaagctgactgctatgaacaagctgctgatggaagagaatgataggttgcagaagcaggtgtctcaactcgtctatgaaaatggctattttcgtcaacacaccacccaaaatactaagcagcagccaaccaaagacacaagctgtgaatcagctgtgacgagtggtcagcagcacaatttgacaactcaacatcccccacgggatgcaagtcctgcagggcttttgtccattgcagaagagactttagcagaatttctttctaaggctactggaactgctgttgagtgggtccaaatgcctggcatgaaacctggacctgactccattggaatcgttgctatttctcacagttgcactggagtagcagcaagagcttgtggtttagtgggactagaacccactagggttgcagaaatcctcaaagatcggcctttgtggtttcaggattgccgagctgttgatgttctcaatgtgctgcccacagcaaatggtggaaccattgagctgctttatatgcagctatatgcaccaaccacattggctcctgctcgagacttctggttgttgcgctacacttctgttttagaagatggcagcttagtgatctgtgagaggtcacttaaaaatactcaaaatggtccaagcatgcctcctgtgcagcattttgttagagcagagatgctgcctagtgggtacctgatcagaccatgtgaaggaggcggttccatcatccacattgttgatcatatgaatttagagccatggagtgtgccagaagtgctacgtccactgtacgagtcatcaacggtactggctcagaagacatctatcgtggccctacgccatctaaggcagatttcacatgaagtttctcagtccaacgtcactgggtggggtaggagaccagcagcactacgagctcttagccaaagattgagccggggtttcaatgaggcactcaatgggtttactgatgagggatggacaacgattggcaatgatggtgtagatgatgttactattctagtgaactcatcccctgacaagttaatgggtctgaatctttcctttgccaatggatttccgtctgtcagtaatgcagtgctatgtgccaaagcatcgatgctattacagaatgtgccccctgccattctccttaggtttctgcgggagcatagatcagaatgggcagacaataatatggatgcttacacagctgctgctattaaagttggcccttgcagcttatcaggatctcgtgttggaaactatggaggtcaagttatactcccccttgcacacacaattgaacatgaggagtttttggaggtcattaaattggaaggaattgctcattctcctgaagacacaataatgcccagagaaatgtttcttttgcaactttgcagtggaatggatgagaatgctgttggcacctgtgctgaacttatatctgctccaattgatgcttcctttgctgatgatgccccccttttaccttctggatttcgcatcattcctcttgaatctggaaaggaagcttccagccccaatcgcacccttgaccttgcatctgctctagacattggttccagtggaaaccgagcttcaaatgaatgtgctggaaattccagctatatgagatctgtgatgacaatagcttttgaatttgcatttgaaagccatatgcaagagcatgtagcatctatggcacgtcaatatgttcggagcattatatcatcggtccaaagggtagcattagcactttctccttctcatttgagttcacatgcagggcttaggtcaccattgggtactcctgaagcgcaaacccttgctcattggatttgcaacagttataggtgctacttgggtgtggagctacttaaatctaataatgaggggaatgaatctttgctcaagtccttgtggcatcactcagatgcaatattgtgctgcactctaaaggcattgccagtgttcactttctcgaaccaggctgggcttgacatgctggagaccacccttgttgcattacaagatacacctttagagaaaatatttgatgatcatggacgaaaaatacttttttcagagtttccccagattattcaacagggttttgtatgtcttcaaggtggtatttgtctttcaagcatggggcgacctgtctcgtacgaaagagttgttgcttggaaggtgctgaatgaagaagagaatgctcattgtatgtgctttatgtttatgaactggtcttttgtt

SEQ ID NO: 11330 - DNA, 2547 bp, Artificial sequence
  miR resistant mutant
atggcactttgtatgcagagagattcagcatcaaacaagcaacagctcatggattgtggcaagtatgtgaggtacacacctgaacaggtggaggctttggagagggtttatattgaatgtccaaagcctagttcttccagaaggcaacaaatcattagggagtgtccactccttgctaacattgaaacaaagcagatcaaagtgtggttccagaatcgcagatgtcgtgaaaagcagcggaaggaagcctctcgtctgcagacagtgaatagaaagctgtctgcaatgaacaagttgttgatggaagagaacgaccgactgcagaagcaggtctcacagttggtttatgataatggattcatgaaacaacaaatacatactgcatctgctactactactactgacaatagctgtgaatctgtggtagtgagtggtcaacgccaacatcaaaaccccaaaattcagcatccccagtgggatgccaacaacccagctggtcttcttgcaattgctcaggagaccctggcggcgttcctttcaaaagctactggaactgctgtcaactgggtccaaatgataggaatgaaaccaggaccagactctattggaatcgttgctgtttcccgcaactgtagtggtgtagcggcaagagcctgtggccttgtgagccttgagcccacaaaggttgctgagattctcaaagatcgtccatcatggtatcgtgactgtcgatgcctcaatgtactgagtgtaatccccacagggaatgggggcacgatagagctcatgtacatgcagacatatgcaccaacaacattggcagctgcaagagacttctggactctgagatacactactagtttggaagatggaagtcttgtgatttgtgaaaggtccttgacttcttcaactggtggccccacagggcctgctgcttcaaacttcgtgagagctgaaatgcttcctagtggctatctaattagatcctgtgagggtggtggatctattgttcacattgttgatcatgttgatttagatgtttggagtgttcctgaagtacttagacccctctatgaatcaccaaaattcttggctcagaaattgactactgctgccttgcgaaatgtaagacaaattgcacaagaatcaagtggagaagttcagtatggtgggggtcgtcagcctgctgtcttgaggacatttagtcaaaggctttgcaaagggttcaatgatgctgtcaacgggtttgtggatgatggttggtcattgatgggtaatgatggggttgaagatgtgaccataggcataaactcatctcccaacaagtttttcagttcccattacaatacatcaatgcttcccgcatttggaggtggggtcttgtgtgcgaaagcatcaatgctgctacagaatgttcctcctgctttgcttgttcgttttctgagggagcatcgttcagagtgggctaattatggggttgatgcatactcttctgcatgtctcaaagctagtccttatgcagttccttgtgcaagacctagtggtttcccgagcagccatgtcattataccacttgctcatactattgagcatgaggagttcttggaggtagttcgtattgagggtaatgcatttccccctgatgatgtagctttggcatgtgatatgtatttaatgcagctgtgcagtggaattgatgaaaatgcaatcggagcatgtgcacagcttgtgtttgcacctatcgatgaatcatttgcagatgatgctctcttactgccttctggtttccgcatcataccattggatcctaaaacagatggtccggcttcaactaggacattggacttagcgtcaacactggaaactggatctggtaatgctcgctcagctggtgaaagtgacctgaataactacaaccttaggtcggtcctcacaattgcattccaatttacctttgagaaccatttgcgggacaatgtggctgttatggctcgccagtatgtgcgtaatgttgtgcgatctgttcagagggttgctatggcaattgctccctctaggatcagtacacagttggggccaaagtcacttcctggtccaccagaggcccttaccttagcaagatggatctgcaaaagctacagtctccacacctgcacagagctttttagcgttgagtccacatctggtgatgcaatcttgaagcaactttggcaccatccagatgcaatattgtgctgttctgtaaaaacaaatgcatctccagtgttcacctttgcaaaccaagctggacttgacatgcttgaaaccactcttgttgctcttcaagacataatgctggataaagttcttgatgaagctggcaggaagtttctctgcattgagttctccaagataatgcaacagggatttgcatatctgccagcaggaatatgtgtatcaagtatgaatcgaccagtgtcttatgagcaggccattgcttggaaagttctcgatgatgatgattccaaccactgccttgcctttgtgttcatgaactggtcttttgtc

SEQ ID NO: 11331 - DNA, 2547 bp, Artificial sequence
  miR resistant mutant
atggcactttgtatgcagagagattcagcatcaaacaagcaacagctcatggattgtggcaagtatgtgaggtacacacctgaacaggtggaggctttggagagggtttatattgaatgtccaaagcctagttcttccagaaggcaacaaatcattagggagtgtccactccttgctaacattgaaacaaagcagatcaaagtgtggttccagaatcgcagatgtcgtgaaaagcagcggaaggaagcctctcgtctgcagacagtgaatagaaagctgtctgcaatgaacaagttgttgatggaagagaacgaccgactgcagaagcaggtctcacagttggtttatgataatggattcatgaaacaacaaatacatactgcatctgctactactactactgacaatagctgtgaatctgtggtagtgagtggtcaacgccaacatcaaaaccccaaaattcagcatccccagtgggatgccaacaacccagctggtcttcttgcaattgctcaggagaccctggcggcgttcctttcaaaagctactggaactgctgtcaactgggtccaaatgattggaatgaaaccaggaccagactctattggaatcgttgctgtttcccgcaactgtagtggtgtagcggcaagagcctgtggccttgtgagccttgagcccacaaaggttgctgagattctcaaagatcgtccatcatggtatcgtgactgtcgatgcctcaatgtactgagtgtaatccccacagggaatgggggcacgatagagctcatgtacatgcagacatatgcaccaacaacattggcagctgcaagagacttctggactctgagatacactactagtttggaagatggaagtcttgtgatttgtgaaaggtccttgacttcttcaactggtggccccacagggcctgctgcttcaaacttcgtgagagctgaaatgcttcctagtggctatctaattagatcctgtgagggtggtggatctattgttcacattgttgatcatgttgatttagatgtttggagtgttcctgaagtacttagacccctctatgaatcaccaaaattcttggctcagaaattgactactgctgccttgcgaaatgtaagacaaattgcacaagaatcaagtggagaagttcagtatggtgggggtcgtcagcctgctgtcttgaggacatttagtcaaaggctttgcaaagggttcaatgatgctgtcaacgggtttgtggatgatggttggtcattgatgggtaatgatggggttgaagatgtgaccataggcataaactcatctcccaacaagtttttcagttcccattacaatacatcaatgcttcccgcatttggaggtggggtcttgtgtgcgaaagcatcaatgctgctacagaatgttcctcctgctttgcttgttcgttttctgagggagcatcgttcagagtgggctaattatggggttgatgcatactcttctgcatgtctcaaagctagtccttatgcagttccttgtgcaagacctagtggtttcccgagcagccatgtcattataccacttgctcatactattgagcatgaggagttcttggaggtagttcgtattgagggtaatgcatttccccctgatgatgtagctttggcatgtgatatgtatttaatgcagctgtgcagtggaattgatgaaaatgcaatcggagcatgtgcacagcttgtgtttgcacctatcgatgaatcatttgcagatgatgctctcttactgccttctggtttccgcatcataccattggatcctaaaacagatggtccggcttcaactaggacattggacttagcgtcaacactggaaactggatctggtaatgctcgctcagctggtgaaagtgacctgaataactacaaccttaggtcggtcctcacaattgcattccaatttacctttgagaaccatttgcgggacaatgtggctgttatggctcgccagtatgtgcgtaatgttgtgcgatctgttcagagggttgctatggcaattgctccctctaggatcagtacacagttggggccaaagtcacttcctggtccaccagaggcccttaccttagcaagatggatctgcaaaagctacagtctccacacctgcacagagctttttagcgttgagtccacatctggtgatgcaatcttgaagcaactttggcaccatccagatgcaatattgtgctgttctgtaaaaacaaatgcatctccagtgttcacctttgcaaaccaagctggacttgacatgcttgaaaccactcttgttgctcttcaagacataatgctggataaagttcttgatgaagctggcaggaagtttctctgcattgagttctccaagataatgcaacagggatttgcatatctgccagcaggaatatgtgtatcaagtatgaatcgaccagtgtcttatgagcaggccattgcttggaaagttctcgatgatgatgattccaaccactgccttgcctttgtgttcatgaactggtcttttgtc

SEQ ID NO: 11332 - DNA, 1149 bp, Artificial sequence
  miR resistant mutant
atgcccatattctctgcaagcttgggctccttcacttccatctccttcctctcaacttcacaatcacaatcacaatcacacctttctcctttcaagttaactgtgaagacaccttggcaatggcagcatcatcactatctcacttctaaagtgttggtctctgcctctggcaacacccaaattcctaatactgaacttcttcaacgccctactcctccagaccctctcgatgacgttcgtcaggctcggagatcgtcagattggaaggctgcaaagacatatcaagatagtaaactcatctataatggtagagtggaaggttttaattctggaggcctgctggttcggttttattctattatgggctttctcccattcccccaattgagtccagtgcatgcttctaaagaaccagagaaatctatacaagaaattgcacaaggcttaattggttcaatcatgtcggtgaaggtaattctagcagatgaggataacaagaaattgatcttctctgagaaagaggcagcatggagtaagttttcaaaacaggttaatgtaggggacatttttgaagtaagagttggttatgttgaggactatggtgcttttgttcatttgcgcttccctgacggtctttatcgccttactggactaatacacgtgtcagaagtgtcatgggatctaattcaggatgtcagagatatcttaaaagtgggcgatgaagtgagggtcaaagttgtcggtattgattggggaaaatcaaggattaacctatcaattagacagctagaagaagatccactcttagaaactctggacaaagtaatacctcaggatggttcagctgatcctgattccatgagcggtggtgatagcggtagcattgagcctcttccaggacttgaaacaatccttgaagagctgctacaggaagatggaatatatgacgtaagaatcagccgtcaagggtttgaaaaacgagtggtctcgcaggacttgcagctttggctttgtaatgcacctcccacgaaccaaaggtttactcttcttgctcgggctggaagacaggtgcaggagatacacctgactacatcccttgatcaggaaggtatcaagaaggcattacaacgagtactggagcgtgtcccc

SEQ ID NO: 11333 - DNA, 1149 bp, Artificial sequence
  miR resistant mutant
atgcccatattctctgcaagcttgggctccttcacttccatctccttcctctcaacttcacaatcacaatcacaatcacacctttctcctttcaagttaactgtgaagacaccttggcaatggcagcatcatcactatctcacttctaaagtgttggtctctgcctctggcaacacccaaattcctaatactgaacttcttcaacgccctactcctccagaccctctcgatgacgttcgtcaggctcggagatcgtcagattggaaggctgcaaagacatatcaagatagtaaactcatctataatggtagagtggaaggttttaattctggaggcctgctggttcggttttattctattatgggctttctcccattcccccaattgagtccagtgcatgcttctaaagaaccagagaaatctatacaagaaattgcacaaggcttaattggttcaatcatgtcggtgaaggtaattctagcagatgaggataacaagaaattgatcttctctgagaaggaggcagcatggagtaagttttcaaaacaggttaatgtaggggacatttttgaagtaagagttggttatgttgaggactatggtgcttttgttcatttgcgcttccctgacggtctttatcgccttactggactaatacacgtgtcagaagtgtcatgggatctaattcaggatgtcagagatatcttaaaagtgggcgatgaagtgagggtcaaagttgtcggtattgattggggaaaatcaaggattaacctatcaattagacagctagaagaagatccactcttagaaactctggacaaagtaatacctcaggatggttcagctgatcctgattccatgagcggtggtgatagcggtagcattgagcctcttccaggacttgaaacaatccttgaagagctgctacaggaagatggaatatatgacgtaagaatcagccgtcaagggtttgaaaaacgagtggtctcgcaggacttgcagctttggctttgtaatgcacctcccacgaaccaaaggtttactcttcttgctcgggctggaagacaggtgcaggagatacacctgactacatcccttgatcaggaaggtatcaagaaggcattacaacgagtactggagcgtgtcccc

SEQ ID NO: 11334 - DNA, 2529 bp, Artificial sequence
  miR resistant mutant
atgtcctgcaaggatggtagcagaaacggaatcggaatcggaatggataacgggaagtacgtgcgttacacgcctgagcaggttgaagccctagagaggctctatcacgattgccccaaacctagttccattcgccgcctgcaactcattcgcgagtgccccactctctcccacattgatcccaagcaaatcaaggtttggttccagaacagaagatgtagagagaagcagaggaaggagtcgtcgcggctgcaagctgtaaataggaagttgactgccatgaacaagctgctcatggaggagattgataggttgcagaagcaggtctctcaactcgtctatgaaaatggctattttcgtcaacataccacccaaaatactaagcagcaggcaatcaaagacacaagctgtgaatcagctgtgaggagtggtcagcagcacaatttgataactcaacatcccccacgggatgcaagtcctgcagggcttttgtccattgcagaagagactttagaagaatttctttctaaggctactgggactgctgttgagtgggtccaaatgccaggcatgaaaccaggaccagactccattggaatcgttgctatttctcatggttgcaatggtgtggcagcaagagcttgtggtctagtgggactagaacccactagggttgcagaaatcctcaaagatcggcctttgtggtttcgcgattgccgagctgttgatgttctcaatgtgctgcccacagcaaatggtggaaccattgagctgctttatatgcagctatatgcaccaaccacattggctcccgctcgagacttctggttgttgcgctacacttctgttttagaagatagcagcttagtgatctgtgagaggtcacttaaaaatactcaaaatggtccaagcatgcctcctgtgcagcattttgttagagcagagatgctgcctagtgggtacctgatcagaccttgtgaaggaggcggttccatcatccacattgttgatcatatgaatttagagccatggagtgtgccagaagtgctacgtccactgtacgagtcatctaaagtactgtctcagaagacaactatggcggccctacgtcatttaaggcagatttcacatgaagtttctccgtccaacgtcagtgggtggggtagaagaccatcagcactacgagctcttagccaaagattgagccggggtttcaatgaggcactcaatgggtttactgatgagggatggacaacaattggcaatgatggtgtagatgatgttactattctcgtgaattcatcccctgacaagttaatgggtctgaatctttcctttgccaatggatttccgtctgtcagtaatgcagtgctatgtgccaaagcatcgatgctattacagaatgtgcaccctgccattctccttaggttcctgcgggagcatagatcagaatgggcagacaacaatatggatgcttacacagctgctgctattaaagttggcccttgcagcttttcaggatctcgtgttggaaactatggaggtcaagttatactccccctagcacacacaattgagcatgaagagtttttggaagtcattaaattggaaggagttgctcattctcctgatgacacaataatgcccagagaaatgtttcttttgcaactttgcagtggaatggatgagaatgctgttggcacctgtgctgaacttatatctgctccaattgatgcttcctttgctgatgatgccccccttttaccttctggatttcgcatcattcctcttgaatctggaaaggaagcttccagccccaatcgcacccttgaccttgcatcttcccttgacgttggtcccagtggaaaccgagcttcagatgaatgtgctggaaattccagctatatgagatctgtgatgacaatagcatttgaatttgcatttgaaagccatatgcaagagcatgtagcagctatggcacgtcaatatgttcggagcattatatcatcggttcaaagggtaggattagcactttctccttctcatttgagttcacatgcagggcttaggtcaccattgggtactcctgaagcacaaacccttgctcattggatctgcaacagttataggtgctacttgggtgtggagctacttaaatctaataacgaggggaatgaatctttgctcaagtccttgtggcatcactcagatgcaatattatgctgcactctaaaggcattgccagtgtttactttctcgaaccaggctgggcttgacatgctggagaccaccctagttgcattacaagatatacctttggagaaaatatttgatgatcatgaacgaaaaattctcttttcagagtttccccagattattcaacagggttttgcatgtcttcagggtggtatttgtctttcaagcatggggcggcctgtctcatacgaaagagtcgttgcttggaaggtgctgaatgaagaagagaatgctcattgtatttgctttatgtttatgaactggtcttttgtt

SEQ ID NO: 11335 - DNA, 2529 bp, Artificial sequence
  miR resistant mutant
atgtcctgcaaggatggtagcagaaacggaatcggaatcggaatggataacgggaagtacgtgcgttacacgcctgagcaggttgaagccctagagaggctctatcacgattgccccaaacctagttccattcgccgcctgcaactcattcgcgagtgccccactctctcccacattgatcccaagcaaatcaaggtttggttccagaacagaagatgtagagagaagcagaggaaggagtcgtcgcggctgcaagctgtaaataggaagttgactgccatgaacaagctgctcatggaggagattgataggttgcagaagcaggtctctcaactcgtctatgaaaatggctattttcgtcaacataccacccaaaatactaagcagcaggcaatcaaagacacaagctgtgaatcagctgtgaggagtggtcagcagcacaatttgataactcaacatcccccacgggatgcaagtcctgcagggcttttgtccattgcagaagagactttagaagaatttctttctaaggctactgggactgctgttgagtgggtccaaatgcctggcatgaaacctggacctgactccattggaatcgttgctatttctcatggttgcaatggtgtggcagcaagagcttgtggtctagtgggactagaacccactagggttgcagaaatcctcaaagatcggcctttgtggtttcgcgattgccgagctgttgatgttctcaatgtgctgcccacagcaaatggtggaaccattgagctgctttatatgcagctatatgcaccaaccacattggctcccgctcgagacttctggttgttgcgctacacttctgttttagaagatagcagcttagtgatctgtgagaggtcacttaaaaatactcaaaatggtccaagcatgcctcctgtgcagcattttgttagagcagagatgctgcctagtgggtacctgatcagaccttgtgaaggaggcggttccatcatccacattgttgatcatatgaatttagagccatggagtgtgccagaagtgctacgtccactgtacgagtcatctaaagtactgtctcagaagacaactatggcggccctacgtcatttaaggcagatttcacatgaagtttctccgtccaacgtcagtgggtggggtagaagaccatcagcactacgagctcttagccaaagattgagccggggtttcaatgaggcactcaatgggtttactgatgagggatggacaacaattggcaatgatggtgtagatgatgttactattctcgtgaattcatcccctgacaagttaatgggtctgaatctttcctttgccaatggatttccgtctgtcagtaatgcagtgctatgtgccaaagcatcgatgctattacagaatgtgcaccctgccattctccttaggttcctgcgggagcatagatcagaatgggcagacaacaatatggatgcttacacagctgctgctattaaagttggcccttgcagcttttcaggatctcgtgttggaaactatggaggtcaagttatactccccctagcacacacaattgagcatgaagagtttttggaagtcattaaattggaaggagttgctcattctcctgatgacacaataatgcccagagaaatgtttcttttgcaactttgcagtggaatggatgagaatgctgttggcacctgtgctgaacttatatctgctccaattgatgcttcctttgctgatgatgccccccttttaccttctggatttcgcatcattcctcttgaatctggaaaggaagcttccagccccaatcgcacccttgaccttgcatcttcccttgacgttggtcccagtggaaaccgagcttcagatgaatgtgctggaaattccagctatatgagatctgtgatgacaatagcatttgaatttgcatttgaaagccatatgcaagagcatgtagcagctatggcacgtcaatatgttcggagcattatatcatcggttcaaagggtaggattagcactttctccttctcatttgagttcacatgcagggcttaggtcaccattgggtactcctgaagcacaaacccttgctcattggatctgcaacagttataggtgctacttgggtgtggagctacttaaatctaataacgaggggaatgaatctttgctcaagtccttgtggcatcactcagatgcaatattatgctgcactctaaaggcattgccagtgtttactttctcgaaccaggctgggcttgacatgctggagaccaccctagttgcattacaagatatacctttggagaaaatatttgatgatcatgaacgaaaaattctcttttcagagtttccccagattattcaacagggttttgcatgtcttcagggtggtatttgtctttcaagcatggggcggcctgtctcatacgaaagagtcgttgcttggaaggtgctgaatgaagaagagaatgctcattgtatttgctttatgtttatgaactggtcttttgtt

SEQ ID NO: 11336 - DNA, 2535 bp, Artificial sequence
  miR resistant mutant
atggctatggctgtggctcaacacagagaaagtagcagcagtggaagcattgacaaacacttagattctggcaagtatgtgaggtacactgccgagcaagttgaggctcttgaaagggtctatgctgagtgccctaagcctagttctctgagaaggcaacaattgatcagagagtgccccattctctccaacatcgagcctaagcaaatcaaggtttggttccagaaccgcaggtgtagggagaagcagagaaaagaggcatctaggcttcagactgtgaaccgcaaactcactgcaatgaacaagttgttgatggaggagaatgatcggttgcagaagcaggtgtcacagcttgtgtgtgagaatgggtttatgaggcagcaattgcatactccatcagcagcaactactgatgctagttgtgattcggtggttaccactcctcagcataccatgagagatgctaataaccctgctggactcctatcaattgcagaggaaactttgacagagttcctttcaaaggctacaggaactgctgtagattgggtccagatgccaggaatgaaaccaggaccagactcggttgggatctttgccatttcacaaagttgcagtggagtggcagctcgagcctgtggtcttgttagtttagaacctacgaagattgcagagatccttaaagatcgtccatcttggttccgtgactgtcggagcctagaagtttttactatgtttcctgctggaaatggaggaaccattgaacttgtttacacgcagacatatgctccaacaacactggctcctgcccgggatttctggacgctgagatataccaccagcttggaaaatggtagtcttgtggtttgtgagaggtccctgtctggttctggaacaggccctaatccagctgctgctgctcagtttgtaagagctgaaacacttcctagtggctacttaatccgaccatgtgagggtggagggtcaatcattcacatagtggaccacctaaatctggaggcatggagtgtgccagaagtgttgcggccactttatgaatcatccaaggtggttgctcagaaaatgacaattgcagcgcttcgctatatcaggcaaatagctcaggaaacaagtggtgaggtggtttacggattgggtaggcagcctgctgttctgcggactttcagccagagattgagcagaggcttcaatgacgctgtaaatggattcaatgatgatgggtggactgtattgaactgtgatggtgccgaggatgtatttattgcagttaattcaaccaagaatttgagtggcacttctaacccagcaagttcccttacattccttggaggaattctctgtgcaaaagcttctatgttgcttcaaaatgtccctcctgcagttttggttcgttttctgagggagcaccgctcagagtgggctgatttcagtgttgatgcttattctgctgcatcactgaaagccggcacctatgcctatccagggatgaggcctacaagatttactggcagtcaaataattatgcctcttggtcatacaattgaacatgaagagatgctggaagttattaggctggaaggtcactctcttgctcaagaagatgcttttgtttctagggacattcatctcttacagatatgtagtgggattgatgagaatgctgtgggggcttgttctgagcttgtatttgctccaattgatgaaatgttccccgatgatgctccattgattccttctggtttccgcattatcccattagattcaaaaccaggtgacaaaaaggaagttgctacaaatcggaccctggatttgacatctggttttgaagtgggtcctgcaacaactgctggcacagatgcatcatccagtcaaaacactcgatcagtgttgactattgccttccagttccctttcgacagcagtctgcaagacaatgtcgcagtcatggcacgtcagtatgtccgcagtgtgatttcttccgtgcagagggttgccatggctatatcaccatctggtataagcccatctgttggagctaaactttctcctggttctccagaggctgttacactagctcactggatctgccaaagttatagttactatatagggtctgacttactgagatccgattctcttgtgggtgacatgatgctgaaacaactgtggcatcatcaggatgcaattctatgctgttcactgaaggcaagcaagcttccattgccagtgttcatatttgcaaatcaagctggccttgacatgttggaaacaactctagtagctttacaagacatcacattggataaaatatttgatgaggctggacgcaaggcattgtgtacagactttgccaagttaatggagcagggatttgcttatctgccagctggaatctgcatgtcgacgatgggacgccatgtgtcatatgaccaagccatcgcatggaaagtgcttactggagaagacaacactgttcactgcctggctttctctttcataaattggtcatttgta

SEQ ID NO: 11337 - DNA, 2535 bp, Artificial sequence
  miR resistant mutant
atggctatggctgtggctcaacacagagaaagtagcagcagtggaagcattgacaaacacttagattctggcaagtatgtgaggtacactgccgagcaagttgaggctcttgaaagggtctatgctgagtgccctaagcctagttctctgagaaggcaacaattgatcagagagtgccccattctctccaacatcgagcctaagcaaatcaaggtttggttccagaaccgcaggtgtagggagaagcagagaaaagaggcatctaggcttcagactgtgaaccgcaaactcactgcaatgaacaagttgttgatggaggagaatgatcggttgcagaagcaggtgtcacagcttgtgtgtgagaatgggtttatgaggcagcaattgcatactccatcagcagcaactactgatgctagttgtgattcggtggttaccactcctcagcataccatgagagatgctaataaccctgctggactcctatcaattgcagaggaaactttgacagagttcctttcaaaggctacaggaactgctgtagattgggtccagatgcctggaatgaaacctggacctgactcggttgggatctttgccatttcacaaagttgcagtggagtggcagctcgagcctgtggtcttgttagtttagaacctacgaagattgcagagatccttaaagatcgtccatcttggttccgtgactgtcggagcctagaagtttttactatgtttcctgctggaaatggaggaaccattgaacttgtttacacgcagacatatgctccaacaacactggctcctgcccgggatttctggacgctgagatataccaccagcttggaaaatggtagtcttgtggtttgtgagaggtccctgtctggttctggaacaggccctaatccagctgctgctgctcagtttgtaagagctgaaacacttcctagtggctacttaatccgaccatgtgagggtggagggtcaatcattcacatagtggaccacctaaatctggaggcatggagtgtgccagaagtgttgcggccactttatgaatcatccaaggtggttgctcagaaaatgacaattgcagcgcttcgctatatcaggcaaatagctcaggaaacaagtggtgaggtggtttacggattgggtaggcagcctgctgttctgcggactttcagccagagattgagcagaggcttcaatgacgctgtaaatggattcaatgatgatgggtggactgtattgaactgtgatggtgccgaggatgtatttattgcagttaattcaaccaagaatttgagtggcacttctaacccagcaagttcccttacattccttggaggaattctctgtgcaaaagcttctatgttgcttcaaaatgtccctcctgcagttttggttcgttttctgagggagcaccgctcagagtgggctgatttcagtgttgatgcttattctgctgcatcactgaaagccggcacctatgcctatccagggatgaggcctacaagatttactggcagtcaaataattatgcctcttggtcatacaattgaacatgaagagatgctggaagttattaggctggaaggtcactctcttgctcaagaagatgcttttgtttctagggacattcatctcttacagatatgtagtgggattgatgagaatgctgtgggggcttgttctgagcttgtatttgctccaattgatgaaatgttccccgatgatgctccattgattccttctggtttccgcattatcccattagattcaaaaccaggtgacaaaaaggaagttgctacaaatcggaccctggatttgacatctggttttgaagtgggtcctgcaacaactgctggcacagatgcatcatccagtcaaaacactcgatcagtgttgactattgccttccagttccctttcgacagcagtctgcaagacaatgtcgcagtcatggcacgtcagtatgtccgcagtgtgatttcttccgtgcagagggttgccatggctatatcaccatctggtataagcccatctgttggagctaaactttctcctggttctccagaggctgttacactagctcactggatctgccaaagttatagttactatatagggtctgacttactgagatccgattctcttgtgggtgacatgatgctgaaacaactgtggcatcatcaggatgcaattctatgctgttcactgaaggcaagcaagcttccattgccagtgttcatatttgcaaatcaagctggccttgacatgttggaaacaactctagtagctttacaagacatcacattggataaaatatttgatgaggctggacgcaaggcattgtgtacagactttgccaagttaatggagcagggatttgcttatctgccagctggaatctgcatgtcgacgatgggacgccatgtgtcatatgaccaagccatcgcatggaaagtgcttactggagaagacaacactgttcactgcctggctttctctttcataaattggtcatttgta

SEQ ID NO: 11338 - DNA, 2532 bp, Artificial sequence
  miR resistant mutant
atggctatggctgtggctcaacacagagaaagtagcagcagtggaagcattgacaaacacttagattctggcaagtatgtgaggtacactgccgagcaagttgaggctcttgaaagggtctatgctgagtgccctaagcctagttctctgagaaggcaacaattgatcagagagtgccccattctctccaacatcgagcctaagcaaatcaaggtttggttccagaaccgcaggtgtagggagaagcagagaaaagaggcatctaggcttcagactgtgaaccgcaaactcactgcaatgaacaagttgttgatggaggagaatgatcggttgcagaagcaggtgtcacagcttgtgtgtgagaatgggtttatgaggcagcaattgcatactccatcagcagcaactactgatgctagttgtgattcggtggttaccactcctcagcataccatgagagatgctaataaccctgctggactcctatcaattgcagaggaaactttgacagagttcctttcaaaggctacaggaactgctgtagattgggtccagatgccaggaatgaaaccaggaccagactcggttgggatctttgccatttcacaaagttgcagtggagtggcagctcgagcctgtggtcttgttagtttagaacctacgaagattgcagagatccttaaagatcgtccatcttggttccgtgactgtcggagcctagaagtttttactatgtttcctgctggaaatggaggaaccattgaacttgtttacacgcagacatatgctccaacaacactggctcctgcccgggatttctggacgctgagatataccaccagcttggaaaatggtagtcttgtggtttgtgagaggtccctgtctggttctggaacaggccctaatccagctgctgctgctcagtttgtaagagctgaaacacttcctagtggctacttaatccgaccatgtgagggtggagggtcaatcattcacatagtggaccacctaaatctggaggcatggagtgtgccagaagtgttgcggccactttatgaatcatccaaggtggttgctcagaaaatgacaattgcagcgcttcgctatatcaggcaaatagctcaggaaacaagtggtgaggtggtttacggattgggtaggcagcctgctgttctgcggactttcagccagagattgagcagaggcttcaatgacgctgtaaatggattcaatgatgatgggtggactgtattgaactgtgatggtgccgaggatgtatttattgcagttaattcaaccaagaatttgagtggcacttctaacccagcaagttcccttacattccttggaggaattctctgtgcaaaagcttctatgttgcttcaaaatgtccctcctgcagttttggttcgttttctgagggagcaccgctcagagtgggctgatttcagtgttgatgcttattctgctgcatcactgaaagccggcacctatgcctatccagggatgaggcctacaagatttactggcagtcaaataattatgcctcttggtcatacaattgaacatgaagagatgctggaagttattaggctggaaggtcactctcttgctcaagaagatgcttttgtttctagggacattcatctcttacagatatgtagtgggattgatgagaatgctgtgggggcttgttctgagcttgtatttgctccaattgatgaaatgttccccgatgatgctccattgattccttctggtttccgcattatcccattagattcaaaaccagttaagttttgttcctctgtaaatcggaccctggatttgacatctggttttgaagtgggtcctgcaacaactgctggcacagatgcatcatccagtcaaaacactcgatcagtgttgactattgccttccagttccctttcgacagcagtctgcaagacaatgtcgcagtcatggcacgtcagtatgtccgcagtgtgatttcttccgtgcagagggttgccatggctatatcaccatctggtataagcccatctgttggagctaaactttctcctggttctccagaggctgttacactagctcactggatctgccaaagttatagttactatatagggtctgacttactgagatccgattctcttgtgggtgacatgatgctgaaacaactgtggcatcatcaggatgcaattctatgctgttcactgaaggcaagcaagcttccattgccagtgttcatatttgcaaatcaagctggccttgacatgttggaaacaactctagtagctttacaagacatcacattggataaaatatttgatgaggctggacgcaaggcattgtgtacagactttgccaagttaatggagcagggatttgcttatctgccagctggaatctgcatgtcgacgatgggacgccatgtgtcatatgaccaagccatcgcatggaaagtgcttactggagaagacaacactgttcactgcctggctttctctttcataaattggtcatttgta

SEQ ID NO: 11339 - DNA, 2532 bp, Artificial sequence
  miR resistant mutant
atggctatggctgtggctcaacacagagaaagtagcagcagtggaagcattgacaaacacttagattctggcaagtatgtgaggtacactgccgagcaagttgaggctcttgaaagggtctatgctgagtgccctaagcctagttctctgagaaggcaacaattgatcagagagtgccccattctctccaacatcgagcctaagcaaatcaaggtttggttccagaaccgcaggtgtagggagaagcagagaaaagaggcatctaggcttcagactgtgaaccgcaaactcactgcaatgaacaagttgttgatggaggagaatgatcggttgcagaagcaggtgtcacagcttgtgtgtgagaatgggtttatgaggcagcaattgcatactccatcagcagcaactactgatgctagttgtgattcggtggttaccactcctcagcataccatgagagatgctaataaccctgctggactcctatcaattgcagaggaaactttgacagagttcctttcaaaggctacaggaactgctgtagattgggtccagatgcctggaatgaaacctggacctgactcggttgggatctttgccatttcacaaagttgcagtggagtggcagctcgagcctgtggtcttgttagtttagaacctacgaagattgcagagatccttaaagatcgtccatcttggttccgtgactgtcggagcctagaagtttttactatgtttcctgctggaaatggaggaaccattgaacttgtttacacgcagacatatgctccaacaacactggctcctgcccgggatttctggacgctgagatataccaccagcttggaaaatggtagtcttgtggtttgtgagaggtccctgtctggttctggaacaggccctaatccagctgctgctgctcagtttgtaagagctgaaacacttcctagtggctacttaatccgaccatgtgagggtggagggtcaatcattcacatagtggaccacctaaatctggaggcatggagtgtgccagaagtgttgcggccactttatgaatcatccaaggtggttgctcagaaaatgacaattgcagcgcttcgctatatcaggcaaatagctcaggaaacaagtggtgaggtggtttacggattgggtaggcagcctgctgttctgcggactttcagccagagattgagcagaggcttcaatgacgctgtaaatggattcaatgatgatgggtggactgtattgaactgtgatggtgccgaggatgtatttattgcagttaattcaaccaagaatttgagtggcacttctaacccagcaagttcccttacattccttggaggaattctctgtgcaaaagcttctatgttgcttcaaaatgtccctcctgcagttttggttcgttttctgagggagcaccgctcagagtgggctgatttcagtgttgatgcttattctgctgcatcactgaaagccggcacctatgcctatccagggatgaggcctacaagatttactggcagtcaaataattatgcctcttggtcatacaattgaacatgaagagatgctggaagttattaggctggaaggtcactctcttgctcaagaagatgcttttgtttctagggacattcatctcttacagatatgtagtgggattgatgagaatgctgtgggggcttgttctgagcttgtatttgctccaattgatgaaatgttccccgatgatgctccattgattccttctggtttccgcattatcccattagattcaaaaccagttaagttttgttcctctgtaaatcggaccctggatttgacatctggttttgaagtgggtcctgcaacaactgctggcacagatgcatcatccagtcaaaacactcgatcagtgttgactattgccttccagttccctttcgacagcagtctgcaagacaatgtcgcagtcatggcacgtcagtatgtccgcagtgtgatttcttccgtgcagagggttgccatggctatatcaccatctggtataagcccatctgttggagctaaactttctcctggttctccagaggctgttacactagctcactggatctgccaaagttatagttactatatagggtctgacttactgagatccgattctcttgtgggtgacatgatgctgaaacaactgtggcatcatcaggatgcaattctatgctgttcactgaaggcaagcaagcttccattgccagtgttcatatttgcaaatcaagctggccttgacatgttggaaacaactctagtagctttacaagacatcacattggataaaatatttgatgaggctggacgcaaggcattgtgtacagactttgccaagttaatggagcagggatttgcttatctgccagctggaatctgcatgtcgacgatgggacgccatgtgtcatatgaccaagccatcgcatggaaagtgcttactggagaagacaacactgttcactgcctggctttctctttcataaattggtcatttgta

SEQ ID NO: 11340 - DNA, 2073 bp, Artificial sequence
  miR resistant mutant
atggaaatgtatgatgtttctgaaactagaaatgcagatgcttatttgattgaaggcactgatttaaacttacatctgacaagcccaaatattcaacaatttcaagccatgtttaatgatggagcccctgaatttgttgctgatcagaacttgtattaccctgctgccaccaattatgggtattactgtacaggatttgaatcacccggagaatgggaggaccaccataggatttttggtgtagatggtcctgatattcagtacacaggtgcacaaaacgaaagttttccatatgtatattatacacctagctatggatttgcacagtctccatacaatccatacaatccttatattcctggtgcaatgataggagttgatggttcatttggaggagcagagcaatattactccctccccaattatcaaaacactatttcttcacctgcttatattcctgttgttcaacctgacaatttccctaacagttctgttgactcatcgtttgataccagtgcttctgtcagcagacctgatggaaaaggtttaaaacataagttcaattcagcttctggttcctttactaggaactcttcaaaatcattatcaaatcccacaagttccttggccaggatatcagaaggtccgagagataatactggggtgaagaaagatttgacaagtggcaggggttttcttaatatggcttcctcacctgccagaagcattgatgcctcgacccatgctgtagatatttccaatggaaatgttttgtcccatagtaatcaattaaaaatagcttcccctctgagtagtggattttctgattatggatctaatgctaatggacagtctgtggttgctaaacttcgaccaaaggttcatgtaggtaaaggactgagtgaagtaaatggaagttctgatgttttaggtgagcaaaatcggggcccgagaattagtaattataagtcaaaatttccactggctgtcaaagcctatgcaaataaaggagatgacaatacacaagagaatatcatcatttctactgatcaatataaccgagaagactttccagtaaactacgaaaatgcaaagttttttgttataaaatcgtacagtgaagatgatgtgcacaaaagcattaaatataatgtgtggtcatcaacacctcatggaaacaagaagctgcagagtactcatgaagatgctaagagaatagcttctggaaattttggaagctgccctatctttcttttcttttctgttaatgcaagtggtcaattttgtggggttgcagagatgattggacctgttgacttcaataaggacatggacttttggcagcaagataaatggagtgggagcttccctgtaaagtggcacatcataaaagatgtgccaaatgcaaattttaggcacattatactagagaacaatgagaacaaacctgtcactaatagcagagacacacaagagataatgtatagtaaaggtttggaaatgctgaaaatattcaaaaaccataatttgaagacatctttgcttgatgactttatgtattatgaaaatcgtcagaagatcatgcaggaagaaaaggccaagttgctaattagaagttttaaaaatccgttagtgttacccacattagaaccacctcgtaagttgaattttgtcattgacatccctccagttggtgatgagaaaaatgcaaagatggatgacgaggttgatagcctaaaacagatttcaagtgctggacatattgttagtagttctgagatcaccagcactacatctgtggatgaaaaggctgagaaaggttcagttgataaagaagatattgcttctgtccttaagattggttcagttactattaccccaaaacaggtggagactaaaccatctggcattagtgttgctaataaggaaccgcttgatgttatcacagtaggctcaatgcaaatcagagttaatggatttgccgagtcatccggttttttgaagattgggactattccccttgatccaagaacactacagctggacggaggttctcgtgttaaaaatggatct

SEQ ID NO: 11341 - DNA, 2073 bp, Artificial sequence
  miR resistant mutant
atggaaatgtatgatgtttctgaaactagaaatgcagatgcttatttgattgaaggcactgatttaaacttacatctgacaagcccaaatattcaacaatttcaagccatgtttaatgatggagcccctgaatttgttgctgatcagaacttgtattaccctgctgccaccaattatgggtattactgtacaggatttgaatcacccggagaatgggaggaccaccataggatttttggtgtagatggtcctgatattcagtacacaggtgcacaaaacgaaagttttccatatgtatattatacacctagctatggatttgcacagtctccatacaatccatacaatccttatattcctggtgcaatgataggagttgatggttcatttggaggagcagagcaatattactccctccccaattatcaaaacactatttcttcacctgcttatattcctgttgttcaacctgacaatttccctaacagttctgttgactcatcgtttgataccagtgcttctgtcagcagacctgatggaaaaggtttaaaacataagttcaattcagcttctggttcctttactaggaactcttcaaaatcattatcaaatcccacaagttccttggccaggatatcagaaggtccgagagataatactggggtgaagaaagatttgacaagtggcaggggttttcttaatatggcttcctcacctgccagaagcattgatgcctcgacccatgctgtagatatttccaatggaaatgttttgtcccatagtaatcaattaaaaatagcttcccctctgagtagtggattttctgattatggatctaatgctaatggacagtctgtggttgctaaacttcgaccaaaggttcatgtaggtaaaggactgagtgaagtaaatggaagttctgatgttttaggtgagcaaaatcggggcccgagaattagtaattataagtcaaaatttccactggctgtcaaagcctatgcaaataaaggagatgacaatacacaagagaatatcatcatttctactgatcaatataacagggaagactttccagtaaactacgaaaatgcaaagttttttgttataaaatcgtacagtgaagatgatgtgcacaaaagcattaaatataatgtgtggtcatcaacacctcatggaaacaagaagctgcagagtactcatgaagatgctaagagaatagcttctggaaattttggaagctgccctatctttcttttcttttctgttaatgcaagtggtcaattttgtggggttgcagagatgattggacctgttgacttcaataaggacatggacttttggcagcaagataaatggagtgggagcttccctgtaaagtggcacatcataaaagatgtgccaaatgcaaattttaggcacattatactagagaacaatgagaacaaacctgtcactaatagcagagacacacaagagataatgtatagtaaaggtttggaaatgctgaaaatattcaaaaaccataatttgaagacatctttgcttgatgactttatgtattatgaaaatcgtcagaagatcatgcaggaagaaaaggccaagttgctaattagaagttttaaaaatccgttagtgttacccacattagaaccacctcgtaagttgaattttgtcattgacatccctccagttggtgatgagaaaaatgcaaagatggatgacgaggttgatagcctaaaacagatttcaagtgctggacatattgttagtagttctgagatcaccagcactacatctgtggatgaaaaggctgagaaaggttcagttgataaagaagatattgcttctgtccttaagattggttcagttactattaccccaaaacaggtggagactaaaccatctggcattagtgttgctaataaggaaccgcttgatgttatcacagtaggctcaatgcaaatcagagttaatggatttgccgagtcatccggttttttgaagattgggactattccccttgatccaagaacactacagctggacggaggttctcgtgttaaaaatggatct

SEQ ID NO: 11342 - DNA, 2073 bp, Artificial sequence; identical to SEQ ID NO: 11341
  miR resistant mutant

SEQ ID NO: 11343 - DNA, 2073 bp, Artificial sequence; identical to SEQ ID NO: 11341
  miR resistant mutant

SEQ ID NO: 11344 - DNA, 573 bp, Artificial sequence
  miR resistant mutant
atggaaagcaatacacctgtaatagcaaagaaagaattgagcataatacatgtggccttgttcatgttgaggaaaggcatctctaaggggaagctaatgatgcacctcaacaacatgatgctcaaacgccccggcaaagccatcgccaacctcatgttccaccacaaccacggtgtctccggcaacagcctccatttctccgccgccagggagtacgagttcagctgcagcaacactccaaacaacttcttcgcggccattgccagcagcaacaaaagacatagacatataccatttttcacgtgcgctcacgcgccgcccaccctcgacgacgacgtggctacggttaatgcagttaagggcgtgttggagatgctgaacaatgagaccgtcgtggaggcatcaccggccgcgcttcccgggttcggacgtagccctatggtgaggcagttgatcagggtgacggactctccgttcccacttgttgagtcccaggatgacaaggacaaccaagtggacaaggctgcggaagagttcataaagaggttctacaaagagttgaggaagcagact

SEQ ID NO: 11345 - DNA, 573 bp, Artificial sequence
  miR resistant mutant
atggaaagcaatacacctgtaatagcaaagaaagaattgagcataatacatgtggccttgttcatgttgaggaaaggcatctctaaggggaagctaatgatgcacctcaacaacatgatgctcaaacgccccggcaaagccatcgccaacctcatgttccaccacaaccacggtgtctccggcaacagcctccatttctccgccgccagggagtacgagttcagctgcagcaacactccaaacaacttcttcgcggccattgccagcagcaacaagagacatagacatataccatttttcacgtgcgctcacgcgccgcccaccctcgacgacgacgtggctacggttaatgcagttaagggcgtgttggagatgctgaacaatgagaccgtcgtggaggcatcaccggccgcgcttcccgggttcggacgtagccctatggtgaggcagttgatcagggtgacggactctccgttcccacttgttgagtcccaggatgacaaggacaaccaagtggacaaggctgcggaagagttcataaagaggttctacaaagagttgaggaagcagact

SEQ ID NO: 11346 - DNA, 2586 bp, Artificial sequence
  miR resistant mutant
atgtgtgcacccttcaacattctagttctcttgttatcacttttactcacttcttcttcttgttcttcttctttttcacagcctcgccgtgttctccatcaaccactttttccgagaatatctgttccgccagcacaagctccaagctatttatctcctgagcctcaaccgaagcaacaacatctacaacccaagcttccattttcttctatttcatcttcttcaccaccaccgccgcagaaatctttcttcccttcctaccattctccacccttacccccaagtccagccgtcctcgctacttttccggccaacatctcctccctccttctcccccgccccatctcccgtcaccaccgctccgccgctgccctcgccgtctccctctctctttgctcaatcgccctcctcgccgccgccgccgccttcctcctccaccaccgccgccgcacacactcctcctctgatgtcaacgacgacgacgacgacaaggcctcgagatcggacagcctccgcctgttcccgccgaacaccgccgcctccgacggcgccgaacgtaaaccccgcggcaaaacgagtcccacatcggagcttctctacctcggcacggtggcgaactccgtaaccaccaccaccacctcaactacaacaacagcaaccactgactcaagctccagccaccatgaaagttttcggccaccgtatcagaaactcggcgactcgccagagctcaacccgctgccgccattgccacgtcacaaattcaaaccatggaccactgaagaagagaataatgataaagatatcatagaaaaggaaaatgaagaagaagaagaagaagaacagtttttttctccaagtggttcttctggtgggaaaattaacaaacaacaaaagagttctccttctccttctggtgttgttgcttccagctcacgtgttttccacgtggataaattcggttccagaagcttcacttctcgaaccccttcttacccacgctccaattcactctctttttctcgttccccttctctgaatttcagccccccaagtgttaaatcattgccaccgaacaacaaccctgcttccccttctttctcttcatcctcttcttctccgagggaagaatggcatgttccatctcagaggaaaaattctccagcggccaccgatttacctactcctccgccgccacctcctccgccaccgccgcagttttgggaggctccggttgataaaagtgttacttttaggaacgagagtgaggagactccgaagccaaagttgaaagctttacattgggacaaagttaaggccagctcggacagggtcatggtttgggatcgcttgggaccaagttcttttcagttgaacgaggacatgattgaaacacttttcatggtaaataataataataataattccaaggagggtttcgttcattctgcgtctccaatgcccttggagaatagggtgcttgaccctaagaagtctcagaacattgccattttgcttagagcgctgaatgtgactattgatgaagtttgtgatgctcttagggaaggcaattgtgatacgttggggacggaacttcttgaaagtttattgaagatggctccaactaaagatgaagaatctaagctgaaggagtttcaagatgaatcgcccttcaagcttggcccggctgagaaatttcttaaagtcgtgcttgatataccttttgcttttaagagagtggatgctatgctctacattgcaaactttgattctgaattagaataccttaagaagtcctttgaaactctggaggtggcctgtgaggaattaaggaaaagccgcatgtttctgaagatactcgaagctgttctcagaacaggaaatcgaatgaatgttggaaccaatcgtggtgatgctcatgcgttcaaactggacacacttttgaagttagttgatattaaagggactgatggaaagaccactctcttacatttcgttgtatgggaaattgttagaactgagggttctcatatttctggttctaacaataaccatgccgccgacaatgaccaccaatatactcttcaagatgaggttgacttcaaaaagcttggtctgcaagttgtttcaggtttgagtggggagctcaccaatgttaagaaaacagctgctatggattcggacatgctcagtagtgatgttgctaaacttgccagaggaatcgaaaaaattgtgcaagttgtaaaattgaacgaggagtcacctttgaaagaaactaaccaaaaattttctgacgcaatgaaatgtttcttggagaggggagagcaagagatttcaacaatccagggccaagagaaaaatgccctctcttcagtgaaggagataactgagtatttccatggaaattcagcaaaggaagaagctcatccttttagaattttcatggttgtgagggatttcctttcaatcctagatggtgtttgcaaggaaattggtaaagtaaatgagaggacgttggttggttcccgtcaatctgtaatgcctgcaaatcctataatgcaaacctttttccctgaaattattggt

SEQ ID NO: 11347 - DNA, 2586 bp, Artificial sequence
  miR resistant mutant
atgtgtgcacccttcaacattctagttctcttgttatcacttttactcacttcttcttcttgttcttcttctttttcacagcctcgccgtgttctccatcaaccactttttccgagaatatctgttccgccagcacaagctccaagctatttatctcctgagcctcaaccgaagcaacaacatctacaacccaagcttccattttcttctatttcatcttcttcaccaccaccgccgcagaaatctttcttcccttcctaccattctccgcccttacccccgagtccggccgtcctcgctacttttccggccaacatctcctccctccttctcccccgccccatctcccgtcaccaccgctccgccgctgccctcgccgtctccctctctctttgctcaatcgccctcctcgccgccgccgccgccttcctcctccaccaccgccgccgcacacactcctcctctgatgtcaacgacgacgacgacgacaaggcctcgagatcggacagcctccgcctgttcccgccgaacaccgccgcctccgacggcgccgaacgtaaaccccgcggcaaaacgagtcccacatcggagcttctctacctcggcacggtggcgaactccgtaaccaccaccaccacctcaactacaacaacagcaaccactgactcaagctccagccaccatgaaagttttcggccaccgtatcagaaactcggcgactcgccagagctcaacccgctgccgccattgccacgtcacaaattcaaaccatggaccactgaagaagagaataatgataaagatatcatagaaaaggaaaatgaagaagaagaagaagaagaacagtttttttctccaagtggttcttctggtgggaaaattaacaaacaacaaaagagttctccttctccttctggtgttgttgcttccagctcacgtgttttccacgtggataaattcggttccagaagcttcacttctcgaaccccttcttacccacgctccaattcactctctttttctcgttccccttctctgaatttcagccccccaagtgttaaatcattgccaccgaacaacaaccctgcttccccttctttctcttcatcctcttcttctccgagggaagaatggcatgttccatctcagaggaaaaattctccagcggccaccgatttacctactcctccgccgccacctcctccgccaccgccgcagttttgggaggctccggttgataaaagtgttacttttaggaacgagagtgaggagactccgaagccaaagttgaaagctttacattgggacaaagttaaggccagctcggacagggtcatggtttgggatcgcttgggaccaagttcttttcagttgaacgaggacatgattgaaacacttttcatggtaaataataataataataattccaaggagggtttcgttcattctgcgtctccaatgcccttggagaatagggtgcttgaccctaagaagtctcagaacattgccattttgcttagagcgctgaatgtgactattgatgaagtttgtgatgctcttagggaaggcaattgtgatacgttggggacggaacttcttgaaagtttattgaagatggctccaactaaagatgaagaatctaagctgaaggagtttcaagatgaatcgcccttcaagcttggcccggctgagaaatttcttaaagtcgtgcttgatataccttttgcttttaagagagtggatgctatgctctacattgcaaactttgattctgaattagaataccttaagaagtcctttgaaactctggaggtggcctgtgaggaattaaggaaaagccgcatgtttctgaagatactcgaagctgttctcagaacaggaaatcgaatgaatgttggaaccaatcgtggtgatgctcatgcgttcaaactggacacacttttgaagttagttgatattaaagggactgatggaaagaccactctcttacatttcgttgtatgggaaattgttagaactgagggttctcatatttctggttctaacaataaccatgccgccgacaatgaccaccaatatactcttcaagatgaggttgacttcaaaaagcttggtctgcaagttgtttcaggtttgagtggggagctcaccaatgttaagaaaacagctgctatggattcggacatgctcagtagtgatgttgctaaacttgccagaggaatcgaaaaaattgtgcaagttgtaaaattgaacgaggagtcacctttgaaagaaactaaccaaaaattttctgacgcaatgaaatgtttcttggagaggggagagcaagagatttcaacaatccagggccaagagaaaaatgccctctcttcagtgaaggagataactgagtatttccatggaaattcagcaaaggaagaagctcatccttttagaattttcatggttgtgagggatttcctttcaatcctagatggtgtttgcaaggaaattggtaaagtaaatgagaggacgttggttggttcccgtcaatctgtaatgcctgcaaatcctataatgcaaacctttttccctgaaattattggt

SEQ ID NO: 11348 - DNA, 2250 bp, Artificial sequence
  miR resistant mutant
atgggaatcaatatttgtctctctctttgcttcttctacatcactacccttcaccgcacaatttccacgttggcccagtctgagaattatatcatccacatggacatatcagccatgcccaaagcatactcctcccatcacacttggtatctctccactctctcttcagcattggagaattccaaagccaccaccgacaaccttaattctaagctgatttacatctacaccaatgtcatcaatggtttcagtgcaaacctgtcacctaaagagcttgaagctctcaaaacctcccctggttacgtttcttccatgcgagatttacgcgccaagcgtgacacaacacactcaccacagttccttggcctcaacaagaatgtgggggcgtggccagcgtctcaatttggcaaagatatcattgttggtttggtggacactggaatttctcctgaaagcaaaagctataacgatgagggattgactaaaattccttctcgatggaaaggccaatgtgaaagtagcatcaaatgcaacaacaaactcattggagcgaggttcttcatcaaagggtttctggcaaagcaccccaacaccaccaataatgtttcttcaacgcgtgacactgatggtcacgggactcacacatcaagcactgcagctgggagtgttgttgagggtgcatcatactatgggtatgcttctggatcagccacaggaatagcttcacgtgcgagagtggccatgtacaaggccttgtgggatgaaggagattacgcatctgatataatagctgcaattgatagtgctatatcagacggggttgatgttctttccttgtcatttggttttgatgatgtacccttgtacgaagaccctgtagcaatcgcaacattcagcgcaatggagaaaggaatttttgtgtccacgtcagcaggaaacgaagggcctttccttggaagacttcacaatggaataccatgggtcataaccgtggctgctggcaccttggaccgtgaatttcatggtactcttacacttggcaatggtgtccaaataactggcatgtctctctatcatggaaacttctcttccagcaatgttccaattgttttcatgggcttgtgcgacaacgtgaaggaactagccaaggtgaaaagcaagattgtggtgtgtgaagacaagaatggaactatcattgatgttcaggcagctaagctgattgatgcaaatgttgtcgcggctgtgttaatttcaaacagctcttacagttcgtttttcttagacaatagctttgcgtctattattgtttccccaataaacggggaaactgtcaaagcttacattaagagtactaactatggcacaaaaggaaccttgtcttttaagaagacagttttgggttctagaccagctccgagtgtggatgattacagttctagagggccttcaagtagtgttccatttgtgttgaaaccggacatcactgctcctggtacatcaatcttagctgcatggcctcaaaatgttccggtggaagtgtttgggtcccaaaatattttcagcaacttcaatttgttaagtggcacatccatggcatgcccccatgttgctggtgtggcagcactgttaagaggagcacaccctgattggagcgttgcagccattaggtcagccattatgacaacatcggacatgtttgacaacaccatgggactcatcaaagacgttggtgatgattacaaaccagccactcctttagccatgggagctggtcatgtcaacccaaatagagcccttgaccctggacttgtttacgatgtgggagttcaagattatgttaatcttctctgtgcacttggctacacccaaaagaacatcaccgttatcacaggaacctcttccaatgattgttcgaaaccctctttggacctcaactacccttcttttattgctttcttcaagagcaacagttcaagtacaacacaagaatttgagagaaccgtgaccaatgttggggagggacagacaatctatgttgccagcgttacacccgtcaaagggtaccacgtgagcgttatccccaagaaattggtgttcaaggagaagaatgagaagcagagttacaagttgagaattgaaggtccaataaagaagaaagagaagaatgtcgcttttgggtatctcacttggacggacttgaagcatgtgattcggagccccattgtggtctctaccctcacattcgatttc

SEQ ID NO: 11349 - DNA, 2250 bp, Artificial sequence
  miR resistant mutant
atgggaatcaatatttgtctctctctttgcttcttctacatcactacccttcaccgcacaatttccacgttggcccagtctgagaattatatcatccacatggacatatcagccatgcccaaagcatactcctcccatcacacttggtatctctccactctctcttcagcattggagaattccaaagccaccaccgacaaccttaattctaagctgatttacatctacaccaatgtcatcaatggtttcagtgcaaacctgtcacctaaagagcttgaagctctcaaaacctcccctggttacgtttcttccatgcgagatttacgcgccaagcgtgacacaacacactcaccacagttccttggcctcaacaagaatgtgggggcgtggccagcgtctcaatttggcaaagatatcattgttggtttggtggacactggaatttctcctgaaagcaaaagctataacgatgagggattgactaaaattccttctcgatggaaaggccaatgtgaaagtagcatcaaatgcaacaacaaactcattggagcgaggttcttcatcaaagggtttctggcaaagcaccccaacaccaccaataatgtttcttcaacgcgtgacactgatggtcacgggactcacacatcaagcactgcagctgggagtgttgttgagggtgcatcatactatgggtatgcttctggatcagccacaggaatagcttcacgtgcgagagtggccatgtacaaggccttgtgggatgaaggagattacgcatctgatataatagctgcaattgatagtgctatatcagacggggttgatgttctttccttgtcatttggttttgatgatgtacccttgtacgaagaccctgttgcaatcgcaacattcagcgcaatggagaaaggaatttttgtgtccacgtcagcaggaaacgaagggcctttccttggaagacttcacaatggaataccatgggtcataaccgtggctgctggcaccttggaccgtgaatttcatggtactcttacacttggcaatggtgtccaaataactggcatgtctctctatcatggaaacttctcttccagcaatgttccaattgttttcatgggcttgtgcgacaacgtgaaggaactagccaaggtgaaaagcaagattgtggtgtgtgaagacaagaatggaactatcattgatgttcaggcagctaagctgattgatgcaaatgttgtcgcggctgtgttaatttcaaacagctcttacagttcgtttttcttagacaatagctttgcgtctattattgtttccccaataaacggggaaactgtcaaagcttacattaagagtactaactatggcacaaaaggaaccttgtcttttaagaagacagttttgggttctagaccagctccgagtgtggatgattacagttctagagggccttcaagtagtgttccatttgtgttgaaaccggacatcactgctcctggtacatcaatcttagctgcatggcctcaaaatgttccggtggaagtgtttgggtcccaaaatattttcagcaacttcaatttgttaagtggcacatccatggcatgcccccatgttgctggtgtggcagcactgttaagaggagcacaccctgattggagcgttgcagccattaggtcagccattatgacaacatcggacatgtttgacaacaccatgggactcatcaaagacgttggtgatgattacaaaccagccactcctttagccatgggagctggtcatgtcaacccaaatagagcccttgaccctggacttgtttacgatgtgggagttcaagattatgttaatcttctctgtgcacttggctacacccaaaagaacatcaccgttatcacaggaacctcttccaatgattgttcgaaaccctctttggacctcaactacccttcttttattgctttcttcaagagcaacagttcaagtacaacacaagaatttgagagaaccgtgaccaatgttggggagggacagacaatctatgttgccagcgttacacccgtcaaagggtaccacgtgagcgttatccccaagaaattggtgttcaaggagaagaatgagaagcagagttacaagttgagaattgaaggtccaataaagaagaaagagaagaatgtcgcttttgggtatctcacttggacggacttgaagcatgtgattcggagccccattgtggtctctaccctcacattcgatttc

SEQ ID NO: 11350 - DNA, 576 bp, Artificial sequence
  miR resistant mutant
atggcgatgagaaatatgatagtgataacagttacgacgacaatggtgacggtgatgataagcatagtgggaggatcagcgagttggtgcgtggcgaagattggcgcgagcgaggaagcactgcagacggcattggactctgcatgtgaagccggtggtggagctgattgtgcacccattcagcctgacggattatgttatgtaccaaatactcttcaagctcatgcttcttatgctttcaacagcttctaccagcgcaacactagagctccccatgcatgcctcttccacggtgcttccaccatcgcacaaaccgatcccagctatggatcttgcgtgtacccatcctccgcaaccccaagtactgctggagttacaaatacaaatacaacagtgacaacacctgcagcgatgccgaatgtggcagcacctaccacaacaactccaatccatggcggggatggtgtaggaatgaaccctctaatccctgaaaattctacatcagcacccaattcgaacacaatattaaccactacctcatttttagttttccttctcattatgtcccttatccct

SEQ ID NO: 11351 - DNA, 576 bp, Artificial sequence
  miR resistant mutant
atggcgatgagaaatatgatagtgataacagttacgacgacaatggtgacggtgatgataagcatagtgggaggatcagcgagttggtgcgtggcgaagattggcgcgagcgaggaagcactgcagacggcattggactctgcatgtgaagccggtggtggagctgattgtgcacccattcagcctgatggattatgttatgtaccaaatactcttcaagctcatgcttcttatgctttcaacagcttctaccagcgcaacactagagctccccatgcatgcctcttccacggtgcttccaccatcgcacaaaccgatcccagctatggatcttgcgtgtacccatcctccgcaaccccaagtactgctggagttacaaatacaaatacaacagtgacaacacctgcagcgatgccgaatgtggcagcacctaccacaacaactccaatccatggcggggatggtgtaggaatgaaccctctaatccctgaaaattctacatcagcacccaattcgaacacaatattaaccactacctcatttttagttttccttctcattatgtcccttatccct

SEQ ID NO: 11352 - DNA, 2355 bp, Artificial sequence
  miR resistant mutant
atgctaacaccaaccccaaaccctccctcccattccgatgcatgcgtgcaccttctccaatctgcaatcaaatcacgagacccattcatcggaagatgcattcacgctcgaatcatcaaacacggccttcgctacctcggcgtcttcctcacaaacaacctcctcaacctctacgtcaaaaccggctcctcctctgacgcccatcgcctgttcgatgaaatgccccttaagaccaccttctcatggaacaccattctctccgcgcatgccaaggctggcaacttggactccgcgcgccgagtgtttgatgaaattccccaaccagattctgtgtcctggaccaccatgatagtggggtataaccacttgggtcttttcaaaagcgctgttcacgcgtttctccgaatggtttcctctggaatttcgccgacccagttcacgtttaccaatgttcttgcctcatgtgctgcagctcaggctctggatgttggaaagaaggttcattcctttgtcgtaaaactggggcaatccggggttgttcccgtggcaaactcactgcttaacatgtatgcaaagtgtggtgattctgttatggcaaaggttgtttttgaccggatgaggctgaaggatacatctacttggaatactatgatttctatgcatatgcagttttgtcaatttgaccttgcacttgcactctttgatcaaatgactgacccggatattgtctcttggaattccatcatcactgggtactgtcatcaaggctacgatatacgcgcactagaaacattttcttttatgcttaagagttcgtctttgaagccagataagttcaccttgggaagtgttctgtcagcttgtgccaatcgggaaagcttgaaacttgggaaacaaatccatgcacatattgtaagagccgatgttgacatcgctggggcagtggggaatgccctgatctcaatgtatgcgaaatcgggtgctgttgaagttgctcataggattgtagaaataaccggtactccaagtcttaatgttatagcattcacgtcactgttggatggctatttcaaaattggggatatagaccctgcaagagccatatttgattcattgaagcaccgtgatgtagttgcctggactgccatgattgttggttatgcacagaatggcttaattagtgatgctttggtgctgtttaggttaatgattagagaaggtccaaagccaaacaactataccctggcagcggtattaagtgtcatttcaagtttggcttctctggatcacggtaagcagcttcatgcagttgccataagattggaagaagtatcatcagtttctgtgggtaatgctttgattaccatgtactcaagatctggtagcatcaaagatgctagaaaaatattcaatcacatatgctcctacagggatacattgacttggacttccatgattttatctctagctcaacatggtcttggaaatgaggccatagaactgtttgaaaagatgctgagaattaacctaaagcctgatcacattacttatgttggtgtgttgtctgcttgcacgcatgtgggattggtagaacagggtaaaagttactttaatttgatgaaaaatgttcataacattgaacccacttctagccactatgcatgcatgattgacctgcttggacgtgctggattgcttgaagaagcatataattttattagaaatatgcctattgaaccagatgttgtagcttggggttcgcttttgtcttcgtgtagggttcataaatatgtcgatctggctaaagtggctgctgaaaaattgcttcttattgatcctaataatagtggggcttacttagcgcttgctaatacactttcagcctgtggtaaatgggaggatgctgctaaggttaggaagtcaatgaaggacaaagcagtaaagaaagaacaaggattcagttgggttcaaatcaagaacaaagtccatatttttggggttgaggatgctcttcacccgcaaagagatgcaatctactgtatgatttccaaaatatggaaggagataaagaaaatgggctttattcctgacaccaattctgtattgcatgacctagagcaagaagtgaaagaacagatccttagacatcatagtgaaaaactcgccattgcatttgcattaataaatacaccaaagcatactacagtgaggatcatgaagaaccttagagtctgtaatgactgtcattctgccataagatatatctctttgcttgtggaaagagaaattatagtaagagatgcaacgcgttttcatcattttaaggatggttcttgctcctgtcaggattactgg

SEQ ID NO: 11353 - DNA, 2355 bp, Artificial sequence
  miR resistant mutant
atgctaacaccaaccccaaaccctccctcccattccgatgcatgcgtgcaccttctccaatctgcaatcaaatcacgagacccattcatcggaagatgcattcacgctcgaatcatcaaacacggccttcgctacctcggcgtcttcctcacaaacaacctcctcaacctctacgtcaaaaccggctcctcctctgacgcccatcgcctgttcgatgaaatgccccttaagaccaccttctcatggaacaccattctctccgcgcatgccaaggctggcaacttggactccgcgcgccgagtgtttgatgaaattccccaaccagattctgtgtcctggaccaccatgatagtggggtataaccacttgggtcttttcaaaagcgctgttcacgcgtttctccgaatggtttcctctggaatttcgccgacccagttcacgtttaccaatgttcttgcctcatgtgctgcagctcaggctctggatgttggaaagaaggttcattcctttgtcgtaaaactggggcaatccggggttgttcccgtggcaaactcactgcttaacatgtatgcaaagtgtggtgattctgttatggcaaaggttgtttttgaccggatgaggctgaaggatacatctacttggaatactatgatttctatgcatatgcagttttgtcaatttgaccttgcacttgcactctttgatcaaatgactgacccggatattgtctcttggaattccatcatcactgggtactgtcatcagggctacgatatacgcgcactagaaacattttcttttatgcttaagagttcgtctttgaagccagataagttcaccttgggaagtgttctgtcagcttgtgccaatcgggaaagcttgaaacttgggaaacaaatccatgcacatattgtaagagccgatgttgacatcgctggggcagtggggaatgccctgatctcaatgtatgcgaaatcgggtgctgttgaagttgctcataggattgtagaaataaccggtactccaagtcttaatgttatagcattcacgtcactgttggatggctatttcaaaattggggatatagaccctgcaagagccatatttgattcattgaagcaccgtgatgtagttgcctggactgccatgattgttggttatgcacagaatggcttaattagtgatgctttggtgctgtttaggttaatgattagagaaggtccaaagccaaacaactataccctggcagcggtattaagtgtcatttcaagtttggcttctctggatcacggtaagcagcttcatgcagttgccataagattggaagaagtatcatcagtttctgtgggtaatgctttgattaccatgtactcaagatctggtagcatcaaagatgctagaaaaatattcaatcacatatgctcctacagggatacattgacttggacttccatgattttatctctagctcaacatggtcttggaaatgaggccatagaactgtttgaaaagatgctgagaattaacctaaagcctgatcacattacttatgttggtgtgttgtctgcttgcacgcatgtgggattggtagaacagggtaaaagttactttaatttgatgaaaaatgttcataacattgaacccacttctagccactatgcatgcatgattgacctgcttggacgtgctggattgcttgaagaagcatataattttattagaaatatgcctattgaaccagatgttgtagcttggggttcgcttttgtcttcgtgtagggttcataaatatgtcgatctggctaaagtggctgctgaaaaattgcttcttattgatcctaataatagtggggcttacttagcgcttgctaatacactttcagcctgtggtaaatgggaggatgctgctaaggttaggaagtcaatgaaggacaaagcagtaaagaaagaacaaggattcagttgggttcaaatcaagaacaaagtccatatttttggggttgaggatgctcttcacccgcaaagagatgcaatctactgtatgatttccaaaatatggaaggagataaagaaaatgggctttattcctgacaccaattctgtattgcatgacctagagcaagaagtgaaagaacagatccttagacatcatagtgaaaaactcgccattgcatttgcattaataaatacaccaaagcatactacagtgaggatcatgaagaaccttagagtctgtaatgactgtcattctgccataagatatatctctttgcttgtggaaagagaaattatagtaagagatgcaacgcgttttcatcattttaaggatggttcttgctcctgtcaggattactgg

SEQ ID NO: 11354 - DNA, 2355 bp, Artificial sequence
  miR resistant mutant
atgctaacaccaaccccaaaccctccctcccattccgatgcatgcgtgcaccttctccaatctgcaatcaaatcacgagacccattcatcggaagatgcattcacgctcgaatcatcaaacacggccttcgctacctcggcgtcttcctcacaaacaacctcctcaacctctacgtcaaaaccggctcctcctctgacgcccatcgcctgttcgatgaaatgccccttaagaccaccttctcatggaacaccattctctccgcgcatgccaaggctggcaacttggactccgcgcgccgagtgtttgatgaaattccccaaccagattctgtgtcctggaccaccatgatagtggggtataaccacttgggtcttttcaaaagcgctgttcacgcgtttctccgaatggtttcctctggaatttcgccgacccagttcacgtttaccaatgttcttgcctcatgtgctgcagctcaggctctggatgttggaaagaaggttcattcctttgtcgtaaaactggggcaatccggggttgttcccgtggcaaactcactgcttaacatgtatgcaaagtgtggtgattctgttatggcaaaggttgtttttgaccggatgaggctgaaggatacatctacttggaatactatgatttctatgcatatgcagttttgtcaatttgaccttgcacttgcactctttgatcaaatgactgacccggatattgtctcttggaattccatcatcactgggtactgtcatcaaggatacgatatacgcgcactagaaacattttcttttatgcttaagagttcgtctttgaagccagataagttcaccttgggaagtgttctgtcagcttgtgccaatcgggaaagcttgaaacttgggaaacaaatccatgcacatattgtaagagccgatgttgacatcgctggggcagtggggaatgccctgatctcaatgtatgcgaaatcgggtgctgttgaagttgctcataggattgtagaaataaccggtactccaagtcttaatgttatagcattcacgtcactgttggatggctatttcaaaattggggatatagaccctgcaagagccatatttgattcattgaagcaccgtgatgtagttgcctggactgccatgattgttggttatgcacagaatggcttaattagtgatgctttggtgctgtttaggttaatgattagagaaggtccaaagccaaacaactataccctggcagcggtattaagtgtcatttcaagtttggcttctctggatcacggtaagcagcttcatgcagttgccataagattggaagaagtatcatcagtttctgtgggtaatgctttgattaccatgtactcaagatctggtagcatcaaagatgctagaaaaatattcaatcacatatgctcctacagggatacattgacttggacttccatgattttatctctagctcaacatggtcttggaaatgaggccatagaactgtttgaaaagatgctgagaattaacctaaagcctgatcacattacttatgttggtgtgttgtctgcttgcacgcatgtgggattggtagaacagggtaaaagttactttaatttgatgaaaaatgttcataacattgaacccacttctagccactatgcatgcatgattgacctgcttggacgtgctggattgcttgaagaagcatataattttattagaaatatgcctattgaaccagatgttgtagcttggggttcgcttttgtcttcgtgtagggttcataaatatgtcgatctggctaaagtggctgctgaaaaattgcttcttattgatcctaataatagtggggcttacttagcgcttgctaatacactttcagcctgtggtaaatgggaggatgctgctaaggttaggaagtcaatgaaggacaaagcagtaaagaaagaacaaggattcagttgggttcaaatcaagaacaaagtccatatttttggggttgaggatgctcttcacccgcaaagagatgcaatctactgtatgatttccaaaatatggaaggagataaagaaaatgggctttattcctgacaccaattctgtattgcatgacctagagcaagaagtgaaagaacagatccttagacatcatagtgaaaaactcgccattgcatttgcattaataaatacaccaaagcatactacagtgaggatcatgaagaaccttagagtctgtaatgactgtcattctgccataagatatatctctttgcttgtggaaagagaaattatagtaagagatgcaacgcgttttcatcattttaaggatggttcttgctcctgtcaggattactgg

SEQ ID NO: 11355 - DNA, 2355 bp, Artificial sequence
  miR resistant mutant
atgctaacaccaaccccaaaccctccctcccattccgatgcatgcgtgcaccttctccaatctgcaatcaaatcacgagacccattcatcggaagatgcattcacgctcgaatcatcaaacacggccttcgctacctcggcgtcttcctcacaaacaacctcctcaacctctacgtcaaaaccggctcctcctctgacgcccatcgcctgttcgatgaaatgccccttaagaccaccttctcatggaacaccattctctccgcgcatgccaaggctggcaacttggactccgcgcgccgagtgtttgatgaaattccccaaccagattctgtgtcctggaccaccatgatagtggggtataaccacttgggtcttttcaaaagcgctgttcacgcgtttctccgaatggtttcctctggaatttcgccgacccagttcacgtttaccaatgttcttgcctcatgtgctgcagctcaggctctggatgttggaaagaaggttcattcctttgtcgtaaaactggggcaatccggggttgttcccgtggcaaactcactgcttaacatgtatgcaaagtgtggtgattctgttatggcaaaggttgtttttgaccggatgaggctgaaggatacatctacttggaatactatgatttctatgcatatgcagttttgtcaatttgaccttgcacttgcactctttgatcaaatgactgacccggatattgtctcttggaattccatcatcactgggtactgtcatcaaggctacgacatacgcgcactagaaacattttcttttatgcttaagagttcgtctttgaagccagataagttcaccttgggaagtgttctgtcagcttgtgccaatcgggaaagcttgaaacttgggaaacaaatccatgcacatattgtaagagccgatgttgacatcgctggggcagtggggaatgccctgatctcaatgtatgcgaaatcgggtgctgttgaagttgctcataggattgtagaaataaccggtactccaagtcttaatgttatagcattcacgtcactgttggatggctatttcaaaattggggatatagaccctgcaagagccatatttgattcattgaagcaccgtgatgtagttgcctggactgccatgattgttggttatgcacagaatggcttaattagtgatgctttggtgctgtttaggttaatgattagagaaggtccaaagccaaacaactataccctggcagcggtattaagtgtcatttcaagtttggcttctctggatcacggtaagcagcttcatgcagttgccataagattggaagaagtatcatcagtttctgtgggtaatgctttgattaccatgtactcaagatctggtagcatcaaagatgctagaaaaatattcaatcacatatgctcctacagggatacattgacttggacttccatgattttatctctagctcaacatggtcttggaaatgaggccatagaactgtttgaaaagatgctgagaattaacctaaagcctgatcacattacttatgttggtgtgttgtctgcttgcacgcatgtgggattggtagaacagggtaaaagttactttaatttgatgaaaaatgttcataacattgaacccacttctagccactatgcatgcatgattgacctgcttggacgtgctggattgcttgaagaagcatataattttattagaaatatgcctattgaaccagatgttgtagcttggggttcgcttttgtcttcgtgtagggttcataaatatgtcgatctggctaaagtggctgctgaaaaattgcttcttattgatcctaataatagtggggcttacttagcgcttgctaatacactttcagcctgtggtaaatgggaggatgctgctaaggttaggaagtcaatgaaggacaaagcagtaaagaaagaacaaggattcagttgggttcaaatcaagaacaaagtccatatttttggggttgaggatgctcttcacccgcaaagagatgcaatctactgtatgatttccaaaatatggaaggagataaagaaaatgggctttattcctgacaccaattctgtattgcatgacctagagcaagaagtgaaagaacagatccttagacatcatagtgaaaaactcgccattgcatttgcattaataaatacaccaaagcatactacagtgaggatcatgaagaaccttagagtctgtaatgactgtcattctgccataagatatatctctttgcttgtggaaagagaaattatagtaagagatgcaacgcgttttcatcattttaaggatggttcttgctcctgtcaggattactgg

SEQ ID NO: 11356 - DNA, 780 bp, Artificial sequence
  miR resistant mutant
atgtcaacctttgcattcacttctttattccaaatcacagtctcatcttcatcttcatctctacacgcaatacgcgcaagcgcttctgagtatgttccctcccaacacacccttagaagggaattcttgaagggtgttgctgctttgatgcctcttccacttgttgtgctgatagagccacccccttcagatgctagagaagttgaggttggctccttccttccaccttcaccctctgacccttctttcgttctcttcaaggcctctgccaaggacactccagcccttcgtgcaggaaatgtgcagccatacaagtttatcctccccccgacgtggaaacaggctcgtgtagcaaatatactatctggaaattactgccagcctaaatgtgcagagccctgggtggaggttaagtttgaagatgaaaaacaaggaaaagttcaggtagtggcttcgcccttgatacgccttaccaacaaaccaaatgcaacaattgaggacattgggagcccagaaaaactgattgcttctcttggaccatttgtcactggaaacacttttgatccagaagagctccttgagacttcagttgaaaagcttggtgatcagacatactacaaatacgtgctcgaaacaccatatgctctcacaggcacacacaatcttgcaaaagcaacagcaaagggaaacactgttgttttgtttgtggttagtgccaatgacaagcagtggcaaacttctgaggagactctaaaagccgtgcttaattcctttgaagtt

SEQ ID NO: 11357 - DNA, 780 bp, Artificial sequence
  miR resistant mutant
atgtcaacctttgcattcacttctttattccaaatcacagtctcatcttcatcttcatctttgcacgcaatacgcgcaagcgcttctgagtatgttccctcccaacacacccttagaagggaattcttgaagggtgttgctgctttgatgcctcttccacttgttgtgctgatagagccacccccttcagatgctagagaagttgaggttggctccttccttccaccttcaccctctgacccttctttcgttctcttcaaggcctctgccaaggacactccagcccttcgtgcaggaaatgtgcagccatacaagtttatcctccccccgacgtggaaacaggctcgtgtagcaaatatactatctggaaattactgccagcctaaatgtgcagagccctgggtggaggttaagtttgaagatgaaaaacaaggaaaagttcaggtagtggcttcgcccttgatacgccttaccaacaaaccaaatgcaacaattgaggacattgggagcccagaaaaactgattgcttctcttggaccatttgtcactggaaacacttttgatccagaagagctccttgagacttcagttgaaaagcttggtgatcagacatactacaaatacgtgctcgaaacaccatatgctctcacaggcacacacaatcttgcaaaagcaacagcaaagggaaacactgttgttttgtttgtggttagtgccaatgacaagcagtggcaaacttctgaggagactctaaaagccgtgcttaattcctttgaagtt

SEQ ID NO: 11358 - DNA, 780 bp, Artificial sequence; identical to SEQ ID NO: 11357
  miR resistant mutant

SEQ ID NO: 11359 - DNA, 780 bp, Artificial sequence; identical to SEQ ID NO: 11357
  miR resistant mutant

SEQ ID NO: 11360 - DNA, 25 bp, Artificial sequence
  Mimic Reverse Complement Mir
tccaccgttaatctaacagaatcct

SEQ ID NO: 11361 - DNA, 26 bp, Artificial sequence
  Mimic Reverse Complement Mir
tctcatctccttgctatacctcttct

SEQ ID NO: 11362 - DNA, 24 bp, Artificial sequence
  Mimic Reverse Complement Mir
tagagctccctctatcagtccaaa

SEQ ID NO: 11363 - DNA, 24 bp, Artificial sequence
  Mimic Reverse Complement Mir
gtgctctctatctacttctgtcaa

SEQ ID NO: 11364 - DNA, 24 bp, Artificial sequence
  Mimic Reverse Complement Mir
aagagctccctctatcaatccaaa

SEQ ID NO: 11365 - DNA, 24 bp, Artificial sequence
  Mimic Reverse Complement Mir
aggagctccctctatcaatccaaa

SEQ ID NO: 11366 - DNA, 23 bp, Artificial sequence
  Mimic Reverse Complement Mir
ctctcactccctatccaccggtg

SEQ ID NO: 11367 - DNA, 23 bp, Artificial sequence
  Mimic Reverse Complement Mir
atcttgatctctattccaccacc

SEQ ID NO: 11368 - DNA, 26 bp, Artificial sequence
  Mimic Reverse Complement Mir
accacctggccgactagtaccaccat

SEQ ID NO: 11369 - DNA, 23 bp, Artificial sequence
  Mimic Reverse Complement Mir
cgtcctccatctactccttcgat

SEQ ID NO: 11370 - DNA, 23 bp, Artificial sequence
  Mimic Reverse Complement Mir
ataatcagcactaccacccaagt

SEQ ID NO: 11371 - DNA, 25 bp, Artificial sequence
  Mimic Reverse Complement Mir
caacaggttgttctacctccttctt

SEQ ID NO: 11372 - DNA, 27 bp, Artificial sequence
  Mimic Reverse Complement Mir
ccgatcaagaagtactatccaccgcca

SEQ ID NO: 11373 - DNA, 24 bp, Artificial sequence
  Mimic Reverse Complement Mir
ctcctctgcttctacttcagctaa

SEQ ID NO: 11374 - DNA, 25 bp, Artificial sequence
  Mimic Reverse Complement Mir
tcctccacctccctaaggaactgca

SEQ ID NO: 11375 - DNA, 23 bp, Artificial sequence
  Mimic Reverse Complement Mir
cacacttggactagtcctcccac

SEQ ID NO: 11376 - DNA, 23 bp, Artificial sequence
  Mimic Reverse Complement Mir
tcttgcttccctatctccacaag

SEQ ID NO: 11377 - DNA, 23 bp, Artificial sequence
  Mimic Reverse Complement Mir
aaccatgcttctacttcaccacc

SEQ ID NO: 11378 - DNA, 24 bp, Artificial sequence
  Mimic Reverse Complement Mir
actacctcctgctaatacgcctca

SEQ ID NO: 11379 - DNA, 24 bp, Artificial sequence
  Mimic Reverse Complement Mir
ctctttctcatctacgcaaacctc

SEQ ID NO: 11380 - DNA, 24 bp, Artificial sequence
  Mimic Reverse Complement Mir
gctcctctgttctatctccgatga

SEQ ID NO: 11381 - DNA, 24 bp, Artificial sequence
  Mimic Reverse Complement Mir
tacccatgcacctatgcctcttcc

SEQ ID NO: 11382 - DNA, 25 bp, Artificial sequence
  Mimic Reverse Complement Mir
atcttgcttcctctaccacaagaaa

SEQ ID NO: 11383 - DNA, 27 bp, Artificial sequence
  Mimic Reverse Complement Mir
gtgctctcttctctctattctctacaa

SEQ ID NO: 11384 - DNA, 27 bp, Artificial sequence
  Mimic Reverse Complement Mir
caccctactcccacctatcccactcca

SEQ ID NO: 11385 - DNA, 27 bp, Artificial sequence
  Mimic Reverse Complement Mir
ctcttcttcttgttctagttgttgtcg

SEQ ID NO: 11386 - DNA, 24 bp, Artificial sequence
  Mimic Reverse Complement Mir
tattccaccccctactgcacacca

SEQ ID NO: 11387 - DNA, 23 bp, Artificial sequence
  Mimic Reverse Complement Mir
ctgtgctctcctatatcttctgt

SEQ ID NO: 11388 - DNA, 24 bp, Artificial sequence
  Mimic Reverse Complement Mir
gtgctctctagctatcttctgtca

SEQ ID NO: 11389 - DNA, 24 bp, Artificial sequence
  Mimic Reverse Complement Mir
tagagctccctctatcaatccaaa

SEQ ID NO: 11390 - DNA, 24 bp, Artificial sequence
  Mimic Reverse Complement Mir
atgctctctatctacttctgtcaa

SEQ ID NO: 11391 - DNA, 24 bp, Artificial sequence
  Mimic Reverse Complement Mir
tgttcccaaacctaagcccattcc

SEQ ID NO: 11392 - DNA, 24 bp, Artificial sequence
  Mimic Reverse Complement Mir
ctactccacacctactccctttga

SEQ ID NO: 11393 - DNA, 24 bp, Artificial sequence
  Mimic Reverse Complement Mir
aggagctccctctatcaatccaat

SEQ ID NO: 11394 - DNA, 24 bp, Artificial sequence
  Mimic Reverse Complement Mir
tagagctccctctatcaatccaag

SEQ ID NO: 11395 - DNA, 24 bp, Artificial sequence
  Mimic Reverse Complement Mir
ccccaatctccctacaactttcca

SEQ ID NO: 11396 - DNA, 24 bp, Artificial sequence
  Mimic Reverse Complement Mir
gccccactccgctatcctcctctc

SEQ ID NO: 11397 - DNA, 27 bp, Artificial sequence
  Mimic Reverse Complement Mir
tacctcccatgcctctaattgttctca

SEQ ID NO: 11398 - DNA, 27 bp, Artificial sequence
  Mimic Reverse Complement Mir
catcgggttacaccctatccatccata

SEQ ID NO: 11399 - DNA, 27 bp, Artificial sequence
  Mimic Reverse Complement Mir
ccacctcatccctactaaaccaaacac

SEQ ID NO: 11400 - DNA, 27 bp, Artificial sequence
  Mimic Reverse Complement Mir
acaccaccacgctactacaataacatt

SEQ ID NO: 11401 - DNA, 24 bp, Artificial sequence
  Mimic Reverse Complement Mir
gaaaccaccttctacccaaggaaa

SEQ ID NO: 11402 - DNA, 25 bp, Artificial sequence
  Mimic Reverse Complement Mir
tctccttcttcgctaacgaggccaa

SEQ ID NO: 11403 - DNA, 24 bp, Artificial sequence
  Mimic Reverse Complement Mir
agcaccgtcgcctaatcctccagc

SEQ ID NO: 11404 - DNA, 24 bp, Artificial sequence
  Mimic Reverse Complement Mir
caccttcaccactaacgtcacagg

SEQ ID NO: 11405 - DNA, 25 bp, Artificial sequence
  Mimic Reverse Complement Mir
tctcctccaactctaccggcaaacc

SEQ ID NO: 11406 - DNA, 26 bp, Artificial sequence
  Mimic Reverse Complement Mir
actccaccgtcatctacgtcggcgcg

SEQ ID NO: 11407 - DNA, 26 bp, Artificial sequence
  Mimic Reverse Complement Mir
tgtcacctccttcctacaaaatccct

SEQ ID NO: 11408 - DNA, 26 bp, Artificial sequence
  Mimic Reverse Complement Mir
tttggcacagctcctacacctccacc

SEQ ID NO: 11409 - DNA, 22 bp, Artificial sequence
  Mimic Reverse Complement Mir
gccacctccctaaacaccgatg

SEQ ID NO: 11410 - DNA, 24 bp, Artificial sequence
  Mimic Reverse Complement Mir
gggacctccttctatgcacggttt

SEQ ID NO: 11411 - DNA, 24 bp, Artificial sequence
  Mimic Reverse Complement Mir
agaacaccaccctatcctccgcgt

SEQ ID NO: 11412 - DNA, 23 bp, Artificial sequence
  Mimic Reverse Complement Mir
aggccctcctctatctagcgcca

SEQ ID NO: 11413 - DNA, 24 bp, Artificial sequence
  Mimic Reverse Complement Mir
ctatcttcctcctaaccaccggaa

SEQ ID NO: 11414 - DNA, 25 bp, Artificial sequence
  Mimic Reverse Complement Mir
taccaacacctcctagctaagctac

SEQ ID NO: 11415 - DNA, 24 bp, Artificial sequence
  Mimic Reverse Complement Mir
tggagctccctctatcaatccaag

SEQ ID NO: 11416 - DNA, 23 bp, Artificial sequence
  Mimic Reverse Complement Mir
gatgtgctctctactatcttctg

SEQ ID NO: 11417 - DNA, 23 bp, Artificial sequence
  Mimic Reverse Complement Mir
gttgtgctctctactatcttctg

SEQ ID NO: 11418 - DNA, 26 bp, Artificial sequence
  Mimic Reverse Complement Mir
accctccgttcaactatcaccgccaa

SEQ ID NO: 11419 - DNA, 23 bp, Artificial sequence
  Mimic Reverse Complement Mir
ctccaccaccctaaggtgcacca

SEQ ID NO: 11420 - DNA, 26 bp, Artificial sequence
  Mimic Reverse Complement Mir
aagctctccatctctaccccaaagga

SEQ ID NO: 11421 - DNA, 24 bp, Artificial sequence
  Mimic Reverse Complement Mir
ttagagctcccctattcaatccaa

SEQ ID NO: 11422 - DNA, 23 bp, Artificial sequence
  Mimic Reverse Complement Mir
cacctcacttctagctttccaaa

SEQ ID NO: 11423 - DNA, 23 bp, Artificial sequence
  Mimic Reverse Complement Mir
tccagagtccctaagctccccaa

SEQ ID NO: 11424 - DNA, 24 bp, Artificial sequence
  Mimic Reverse Complement Mir
tcctccagcagctacaagcccaac

SEQ ID NO: 11425 - DNA, 24 bp, Artificial sequence
  Mimic Reverse Complement Mir
cactggaccacctacacctagatg

SEQ ID NO: 11426 - DNA, 23 bp, Artificial sequence
  Mimic Reverse Complement Mir
tcagtgctctctactatcttctg

SEQ ID NO: 11427 - DNA, 23 bp, Artificial sequence
  Mimic Reverse Complement Mir
ccacccccaactactctaagttg

SEQ ID NO: 11428 - DNA, 26 bp, Artificial sequence
  Mimic Reverse Complement Mir
attcctcccaaccctaattcaccaag

SEQ ID NO: 11429 - DNA, 25 bp, Artificial sequence
  Mimic Reverse Complement Mir
ccacacccacctctaccaagttggg

SEQ ID NO: 11430 - DNA, 24 bp, Artificial sequence
  Mimic Reverse Complement Mir
ggcaaccttctctaccacactttc

SEQ ID NO: 11431 - DNA, 24 bp, Artificial sequence
  Mimic Reverse Complement Mir
tagctccatccctaatgctctgcc

SEQ ID NO: 11432 - DNA, 24 bp, Artificial sequence
  Mimic Reverse Complement Mir
cagagctccctctatcaatccaaa

SEQ ID NO: 11433 - DNA, 27 bp, Artificial sequence
  Mimic Reverse Complement Mir
acaagaatgcacctctacctttttcca

SEQ ID NO: 11434 - DNA, 24 bp, Artificial sequence
  Mimic Reverse Complement Mir
gtgctctctatctacttctgtcag

SEQ ID NO: 11435 - DNA, 25 bp, Artificial sequence
  Mimic Reverse Complement Mir
tcgccatcatacctaagcccaaccg

SEQ ID NO: 11436 - DNA, 22 bp, Artificial sequence
  Mimic Reverse Complement Mir
aaggctcctctatcatctccca

SEQ ID NO: 11437 - DNA, 543 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaatccaccgttaatctaacagaatcctagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11438 - DNA, 544 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaatctcatctccttgctatacctcttctagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11439 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaatagagctccctctatcagtccaaaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11440 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaagtgctctctatctacttctgtcaaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11441 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaaagagctccctctatcaatccaaaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11442 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaaggagctccctctatcaatccaaaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11443 - DNA, 541 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaactctcactccctatccaccggtgagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11444 - DNA, 541 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaatcttgatctctattccaccaccagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11445 - DNA, 544 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaaccacctggccgactagtaccaccatagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11446 - DNA, 541 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaacgtcctccatctactccttcgatagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11447 - DNA, 541 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaataatcagcactaccacccaagtagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11448 - DNA, 543 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaacaacaggttgttctacctccttcttagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11449 - DNA, 545 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaccgatcaagaagtactatccaccgccaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11450 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaactcctctgcttctacttcagctaaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11451 - DNA, 543 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaatcctccacctccctaaggaactgcaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11452 - DNA, 541 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaacacacttggactagtcctcccacagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11453 - DNA, 541 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaatcttgcttccctatctccacaagagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11454 - DNA, 541 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaaaccatgcttctacttcaccaccagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11455 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaactacctcctgctaatacgcctcaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11456 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaactctttctcatctacgcaaacctcagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11457 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaagctcctctgttctatctccgatgaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11458 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaatacccatgcacctatgcctcttccagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11459 - DNA, 543 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaatcttgcttcctctaccacaagaaaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11460 - DNA, 545 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaagtgctctcttctctctattctctacaaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11461 - DNA, 545 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaacaccctactcccacctatcccactccaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11462 - DNA, 545 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaactcttcttcttgttctagttgttgtcgagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11463 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaatattccaccccctactgcacaccaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11464 - DNA, 541 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaactgtgctctcctatatcttctgtagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11465 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaagtgctctctagctatcttctgtcaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11466 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaatagagctccctctatcaatccaaaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11467 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaatgctctctatctacttctgtcaaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11468 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaatgttcccaaacctaagcccattccagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11469 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaactactccacacctactccctttgaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11470 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaaggagctccctctatcaatccaatagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11471 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaatagagctccctctatcaatccaagagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11472 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaccccaatctccctacaactttccaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11473 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaagccccactccgctatcctcctctcagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11474 - DNA, 545 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaatacctcccatgcctctaattgttctcaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11475 - DNA, 545 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaacatcgggttacaccctatccatccataagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11476 - DNA, 545 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaccacctcatccctactaaaccaaacacagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11477 - DNA, 545 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaacaccaccacgctactacaataacattagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11478 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaagaaaccaccttctacccaaggaaaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11479 - DNA, 543 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaatctccttcttcgctaacgaggccaaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11480 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaagcaccgtcgcctaatcctccagcagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11481 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaacaccttcaccactaacgtcacaggagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11482 - DNA, 543 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaatctcctccaactctaccggcaaaccagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11483 - DNA, 544 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaactccaccgtcatctacgtcggcgcgagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11484 - DNA, 544 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaatgtcacctccttcctacaaaatccctagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11485 - DNA, 544 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaatttggcacagctcctacacctccaccagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11486 - DNA, 540 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaagccacctccctaaacaccgatgagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11487 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaagggacctccttctatgcacggtttagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11488 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaagaacaccaccctatcctccgcgtagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11489 - DNA, 541 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaaggccctcctctatctagcgccaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11490 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaactatcttcctcctaaccaccggaaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11491 - DNA, 543 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaataccaacacctcctagctaagctacagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11492 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaatggagctccctctatcaatccaagagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11493 - DNA, 541 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaagatgtgctctctactatcttctgagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11494 - DNA, 541 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaagttgtgctctctactatcttctgagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11495 - DNA, 544 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaaccctccgttcaactatcaccgccaaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11496 - DNA, 541 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaactccaccaccctaaggtgcaccaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11497 - DNA, 544 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaaagctctccatctctaccccaaaggaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11498 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaattagagctcccctattcaatccaaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11499 - DNA, 541 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaacacctcacttctagctttccaaaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11500 - DNA, 541 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaatccagagtccctaagctccccaaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11501 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaatcctccagcagctacaagcccaacagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11502 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaacactggaccacctacacctagatgagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11503 - DNA, 541 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaatcagtgctctctactatcttctgagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11504 - DNA, 541 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaccacccccaactactctaagttgagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11505 - DNA, 544 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaattcctcccaaccctaattcaccaagagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11506 - DNA, 543 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaccacacccacctctaccaagttgggagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11507 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaggcaaccttctctaccacactttcagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11508 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaatagctccatccctaatgctctgccagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11509 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaacagagctccctctatcaatccaaaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11510 - DNA, 545 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaacaagaatgcacctctacctttttccaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11511 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaagtgctctctatctacttctgtcagagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11512 - DNA, 543 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaatcgccatcatacctaagcccaaccgagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11513 - DNA, 540 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaaaggctcctctatcatctcccaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11514 - DNA, 24 bp, Artificial sequence
  Full Target Mimic Nucleotide Sequence
catgcttggctctaccttgtacgc

SEQ ID NO: 11515 - DNA, 24 bp, Artificial sequence
  Full Target Mimic Nucleotide Sequence
cttcccacagcctatttattgaac

SEQ ID NO: 11516 - DNA, 24 bp, Artificial sequence
  Full Target Mimic Nucleotide Sequence
tttcccacagcctatttcttgagc

SEQ ID NO: 11517 - DNA, 27 bp, Artificial sequence
  Full Target Mimic Nucleotide Sequence
tcactcgaccccctctatggtcgagtg

SEQ ID NO: 11518 - DNA, 23 bp, Artificial sequence
  Full Target Mimic Nucleotide Sequence
gattcagttgctaatgcaaggcg

SEQ ID NO: 11519 - DNA, 26 bp, Artificial sequence
  Full Target Mimic Nucleotide Sequence
atcactcgaccccctacaggctgagt

SEQ ID NO: 11520 - DNA, 25 bp, Artificial sequence
  Full Target Mimic Nucleotide Sequence
gttcatcaacgcctatgcactcaat

SEQ ID NO: 11521 - DNA, 24 bp, Artificial sequence
  Full Target Mimic Nucleotide Sequence
taaacctcaggctaatgcagatta

SEQ ID NO: 11522 - DNA, 24 bp, Artificial sequence
  Full Target Mimic Nucleotide Sequence
tatgcatggctctacctcatacgc

SEQ ID NO: 11523 - DNA, 25 bp, Artificial sequence
  Full Target Mimic Nucleotide Sequence
gatcgatgaaccctagctgcctcca

SEQ ID NO: 11524 - DNA, 24 bp, Artificial sequence
  Full Target Mimic Nucleotide Sequence
ggagatattgactacgcggctcaa

SEQ ID NO: 11525 - DNA, 25 bp, Artificial sequence
  Full Target Mimic Nucleotide Sequence
tcagacgatgtactatggaatgaga

SEQ ID NO: 11526 - DNA, 24 bp, Artificial sequence
  Full Target Mimic Nucleotide Sequence
ggagttccttcctactcggactcg

SEQ ID NO: 11527 - DNA, 24 bp, Artificial sequence
  Full Target Mimic Nucleotide Sequence
gggatccatagctactaagcagct

SEQ ID NO: 11528 - DNA, 24 bp, Artificial sequence
  Full Target Mimic Nucleotide Sequence
ttcccctacaactactccctttga

SEQ ID NO: 11529 - DNA, 27 bp, Artificial sequence
  Full Target Mimic Nucleotide Sequence
gccatattctcccactacagctttctt

SEQ ID NO: 11530 - DNA, 27 bp, Artificial sequence
  Full Target Mimic Nucleotide Sequence
actccgtctaccacctagtcatcactt

SEQ ID NO: 11531 - DNA, 25 bp, Artificial sequence
  Full Target Mimic Nucleotide Sequence
acagcgtcatctctactcctgcgta

SEQ ID NO: 11532 - DNA, 24 bp, Artificial sequence
  Full Target Mimic Nucleotide Sequence
gttgtggggatctactacgccact

SEQ ID NO: 11533 - DNA, 23 bp, Artificial sequence
  Full Target Mimic Nucleotide Sequence
cctaggtgagctaagcgacccgt

SEQ ID NO: 11534 - DNA, 27 bp, Artificial sequence
  Full Target Mimic Nucleotide Sequence
taggaatgggcggactaattgggaaga

SEQ ID NO: 11535 - DNA, 25 bp, Artificial sequence
  Full Target Mimic Nucleotide Sequence
attccttcccaactatccccccata

SEQ ID NO: 11536 - DNA, 23 bp, Artificial sequence
  Full Target Mimic Nucleotide Sequence
agccaaggccctaaacttgccga

SEQ ID NO: 11537 - DNA, 24 bp, Artificial sequence
  Full Target Mimic Nucleotide Sequence
gtatgggaggtctagtagggaaga

SEQ ID NO: 11538 - DNA, 24 bp, Artificial sequence
  Full Target Mimic Nucleotide Sequence
ctggatgcagactaggtttatcga

SEQ ID NO: 11539 - DNA, 23 bp, Artificial sequence
  Full Target Mimic Nucleotide Sequence
tggtcccggcctactcctcgttg

SEQ ID NO: 11540 - DNA, 25 bp, Artificial sequence
  Full Target Mimic Nucleotide Sequence
cacgctcgcatcctaccctcgccgc

SEQ ID NO: 11541 - DNA, 24 bp, Artificial sequence
  Full Target Mimic Nucleotide Sequence
ctccgtcccaactaaatatagcca

SEQ ID NO: 11542 - DNA, 25 bp, Artificial sequence
  Full Target Mimic Nucleotide Sequence
agaagctcccccctaaaacagtcca

SEQ ID NO: 11543 - DNA, 24 bp, Artificial sequence
  Full Target Mimic Nucleotide Sequence
ccttggctgcactatcctgctctc

SEQ ID NO: 11544 - DNA, 25 bp, Artificial sequence
  Full Target Mimic Nucleotide Sequence
cccccgtttcagctagttataagac

SEQ ID NO: 11545 - DNA, 24 bp, Artificial sequence
  Full Target Mimic Nucleotide Sequence
aaggaatgatgctacctggtccga

SEQ ID NO: 11546 - DNA, 24 bp, Artificial sequence
  Full Target Mimic Nucleotide Sequence
ccctcacagccctatggacagctc

SEQ ID NO: 11547 - DNA, 24 bp, Artificial sequence
  Full Target Mimic Nucleotide Sequence
ctgggatgaagctacctggtccgg

SEQ ID NO: 11548 - DNA, 24 bp, Artificial sequence
  Full Target Mimic Nucleotide Sequence
aaggaatggagctacctggtccga

SEQ ID NO: 11549 - DNA, 24 bp, Artificial sequence
  Full Target Mimic Nucleotide Sequence
tggtgagtttcctacctgtcaatg

SEQ ID NO: 11550 - DNA, 23 bp, Artificial sequence
  Full Target Mimic Nucleotide Sequence
tagccacagcctacacgttccca

SEQ ID NO: 11551 - DNA, 23 bp, Artificial sequence
  Full Target Mimic Nucleotide Sequence
ccgctcccttctaaggtttgcag

SEQ ID NO: 11552 - DNA, 27 bp, Artificial sequence
  Full Target Mimic Nucleotide Sequence
gcacgtgccctgctctatctccatctt

SEQ ID NO: 11553 - DNA, 26 bp, Artificial sequence
  Full Target Mimic Nucleotide Sequence
agcgccatctctcctactgcgacaag

SEQ ID NO: 11554 - DNA, 25 bp, Artificial sequence
  Full Target Mimic Nucleotide Sequence
ttgacatggtatctacagagccttg

SEQ ID NO: 11555 - DNA, 23 bp, Artificial sequence
  Full Target Mimic Nucleotide Sequence
aacatggtatctacagagccttg

SEQ ID NO: 11556 - DNA, 23 bp, Artificial sequence
  Full Target Mimic Nucleotide Sequence
aacctcaggactatgcagattac

SEQ ID NO: 11557 - DNA, 24 bp, Artificial sequence
  Full Target Mimic Nucleotide Sequence
cttgggtcttgctacagcccctcc

SEQ ID NO: 11558 - DNA, 26 bp, Artificial sequence
  Full Target Mimic Nucleotide Sequence
cccggttgactcgctaccaggtcgac

SEQ ID NO: 11559 - DNA, 24 bp, Artificial sequence
  Full Target Mimic Nucleotide Sequence
tagacctcaggctaatgcagatta

SEQ ID NO: 11560 - DNA, 23 bp, Artificial sequence
  Full Target Mimic Nucleotide Sequence
ggaggtggacctaagaatgccaa

SEQ ID NO: 11561 - DNA, 23 bp, Artificial sequence
  Full Target Mimic Nucleotide Sequence
cagatcatgtctaggcagcttca

SEQ ID NO: 11562 - DNA, 24 bp, Artificial sequence
  Full Target Mimic Nucleotide Sequence
tttcccacagcctatttattgaac

SEQ ID NO: 11563 - DNA, 24 bp, Artificial sequence
  Full Target Mimic Nucleotide Sequence
catgtgttctcctaagttcgcccc

SEQ ID NO: 11564 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaacatgcttggctctaccttgtacgcagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11565 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaacttcccacagcctatttattgaacagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11566 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaatttcccacagcctatttcttgagcagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11567 - DNA, 545 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaatcactcgaccccctctatggtcgagtgagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11568 - DNA, 541 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaagattcagttgctaatgcaaggcgagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11569 - DNA, 544 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaatcactcgaccccctacaggctgagtagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11570 - DNA, 543 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaagttcatcaacgcctatgcactcaatagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11571 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaataaacctcaggctaatgcagattaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11572 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaatatgcatggctctacctcatacgcagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11573 - DNA, 543 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaagatcgatgaaccctagctgcctccaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11574 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaggagatattgactacgcggctcaaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11575 - DNA, 543 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaatcagacgatgtactatggaatgagaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11576 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaggagttccttcctactcggactcgagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11577 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaagggatccatagctactaagcagctagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11578 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaattcccctacaactactccctttgaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11579 - DNA, 545 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaagccatattctcccactacagctttcttagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11580 - DNA, 545 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaactccgtctaccacctagtcatcacttagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11581 - DNA, 543 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaacagcgtcatctctactcctgcgtaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11582 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaagttgtggggatctactacgccactagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11583 - DNA, 541 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaacctaggtgagctaagcgacccgtagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11584 - DNA, 545 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaataggaatgggcggactaattgggaagaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11585 - DNA, 543 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaattccttcccaactatccccccataagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11586 - DNA, 541 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaagccaaggccctaaacttgccgaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11587 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaagtatgggaggtctagtagggaagaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11588 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaactggatgcagactaggtttatcgaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11589 - DNA, 541 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaatggtcccggcctactcctcgttgagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11590 - DNA, 543 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaacacgctcgcatcctaccctcgccgcagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11591 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaactccgtcccaactaaatatagccaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11592 - DNA, 543 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaagaagctcccccctaaaacagtccaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11593 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaccttggctgcactatcctgctctcagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11594 - DNA, 543 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaacccccgtttcagctagttataagacagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11595 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaaaggaatgatgctacctggtccgaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11596 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaccctcacagccctatggacagctcagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11597 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaactgggatgaagctacctggtccggagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11598 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaaaggaatggagctacctggtccgaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11599 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaatggtgagtttcctacctgtcaatgagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11600 - DNA, 541 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaatagccacagcctacacgttcccaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11601 - DNA, 541 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaccgctcccttctaaggtttgcagagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11602 - DNA, 545 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaagcacgtgccctgctctatctccatcttagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11603 - DNA, 544 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaagcgccatctctcctactgcgacaagagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11604 - DNA, 543 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaattgacatggtatctacagagccttgagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11605 - DNA, 541 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaaacatggtatctacagagccttgagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11606 - DNA, 541 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaaacctcaggactatgcagattacagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11607 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaacttgggtcttgctacagcccctccagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11608 - DNA, 544 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaacccggttgactcgctaccaggtcgacagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11609 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaatagacctcaggctaatgcagattaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11610 - DNA, 541 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaaggaggtggacctaagaatgccaaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11611 - DNA, 541 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaacagatcatgtctaggcagcttcaagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11612 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaatttcccacagcctatttattgaacagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11613 - DNA, 542 bp, Artificial sequence
  Full Target Mimic Nucleotide Sequence
aaaacaccacaaaaacaaaagaaaaatggccatcccctagctaggtgaagaagaatgaaaacctctaatttatctagaggttattcatcttttaggggatggcctaaatacaaaatgaaaactctctaattaagtggttttgtgttcatgtaaggaaagcgttttaagatatggagcaatgaagactgcagaaggctgattcagactgcgagttttgtttatctccctctagaaacatgtgttctcctaagttcgccccagcttcggttcccctcggaatcagcagattatgtatctttaattttgtaatactctctctcttctctatgctttgtttttcttcattatgtttgggttgtacccactcccgcgcgttgtgtgttctttgtgtgaggaataaaaaaatattcggatttgagaactaaaactagagtagttttattgatattcttgtttttcatttagtatctaataagtttggagaatagtcagaccagtgcatgtaaatttgcttccgattctctttatagtgaattcctctt

SEQ ID NO: 11614 - DNA, 20 bp, Artificial sequence
  Single strand DNA oligonucleotide
tttagcgatgaacttcactc

SEQ ID NO: 11615 - DNA, 87 bp, Glycine max
ttttacttttctttctttgtgttttggggttaggttatcaaaaacaaacaaaaatcttagccgcagaggcagaggaggagatggaga

SEQ ID NO: 11616 - DNA, 21 bp, Glycine max
ttagccgcagaggcagaggag

SEQ ID NO: 11617 - DNA, 16 bp, Artificial sequence
  Single strand DNA oligonucleotide
gtgcagggtccgaggt

SEQ ID NO: 11618 - DNA, 50 bp, Artificial sequence
  Single strand DNA oligonucleotide
gtcgtatccagtgcagggtccgaggtattcgcactggatacgactccacc

SEQ ID NO: 11619 - DNA, 22 bp, Artificial sequence
  Single strand DNA oligonucleotide
cggcggaggattctgtattaac

SEQ ID NO: 11620 - DNA, 50 bp, Artificial sequence
  Single strand DNA oligonucleotide
gtcgtatccagtgcagggtccgaggtattcgcactggatacgaccttccc

SEQ ID NO: 11621 - DNA, 21 bp, Artificial sequence
  Single strand DNA oligonucleotide
cggcgggttcaataaagctgt

SEQ ID NO: 11622 - DNA, 50 bp, Artificial sequence
  Single strand DNA oligonucleotide
gtcgtatccagtgcagggtccgaggtattcgcactggatacgactttccc

SEQ ID NO: 11623 - DNA, 21 bp, Artificial sequence
  Single strand DNA oligonucleotide
cggcgggctcaagaaagctgt

SEQ ID NO: 11624 - DNA, 50 bp, Artificial sequence
  Single strand DNA oligonucleotide
gtcgtatccagtgcagggtccgaggtattcgcactggatacgactctcat

SEQ ID NO: 11625 - DNA, 23 bp, Artificial sequence
  Single strand DNA oligonucleotide
cggcggagaagaggtacaaggag

SEQ ID NO: 11626 - DNA, 51 bp, Artificial sequence
  Single strand DNA oligonucleotide
gtcgtatccagtgcagggtccgaggtattcgcactggatacgactcactcg

SEQ ID NO: 11627 - DNA, 21 bp, Artificial sequence
  Single strand DNA oligonucleotide
cgctcactcgaccaagggggt

SEQ ID NO: 11628 - DNA, 50 bp, Artificial sequence
  Single strand DNA oligonucleotide
gtcgtatccagtgcagggtccgaggtattcgcactggatacgacatcact

SEQ ID NO: 11629 - DNA, 21 bp, Artificial sequence
  Single strand DNA oligonucleotide
ttccactcagcctgggggtcg

SEQ ID NO: 11630 - DNA, 50 bp, Artificial sequence
  Single strand DNA oligonucleotide
gtcgtatccagtgcagggtccgaggtattcgcactggatacgacctcctc

SEQ ID NO: 11631 - DNA, 21 bp, Artificial sequence
  Single strand DNA oligonucleotide
cggcggttagctgaagaagca

SEQ ID NO: 11632 - DNA, 50 bp, Artificial sequence; identical to SEQ ID NO: 11630
  Single strand DNA oligonucleotide

SEQ ID NO: 11633 - DNA, 19 bp, Artificial sequence
  Single strand DNA oligonucleotide
gagcttagccgcagaggca

SEQ ID NO: 11634 - DNA, 50 bp, Artificial sequence
  Single strand DNA oligonucleotide
gtcgtatccagtgcagggtccgaggtattcgcactggatacgacctcttt

SEQ ID NO: 11635 - DNA, 19 bp, Artificial sequence
  Single strand DNA oligonucleotide
cggcgaggtttgcgatgag

SEQ ID NO: 11636 - DNA, 50 bp, Artificial sequence
  Single strand DNA oligonucleotide
gtcgtatccagtgcagggtccgaggtattcgcactggatacgacatcttg

SEQ ID NO: 11637 - DNA, 22 bp, Artificial sequence
  Single strand DNA oligonucleotide
cggcggtttcttgtggaggaag

SEQ ID NO: 11638 - DNA, 50 bp, Artificial sequence
  Single strand DNA oligonucleotide
gtcgtatccagtgcagggtccgaggtattcgcactggatacgacgatcga

SEQ ID NO: 11639 - DNA, 20 bp, Artificial sequence
  Single strand DNA oligonucleotide
cgtctggaggcagcggttca

SEQ ID NO: 11640 - DNA, 50 bp, Artificial sequence
  Single strand DNA oligonucleotide
gtcgtatccagtgcagggtccgaggtattcgcactggatacgacctcttc

SEQ ID NO: 11641 - DNA, 23 bp, Artificial sequence
  Single strand DNA oligonucleotide
cgcgccgacaacaacaacaagaa

SEQ ID NO: 11642 - DNA, 50 bp, Artificial sequence
  Single strand DNA oligonucleotide
gtcgtatccagtgcagggtccgaggtattcgcactggatacgacgggatc

SEQ ID NO: 11643 - DNA, 21 bp, Artificial sequence
  Single strand DNA oligonucleotide
cggcggagctgcttagctatg

SEQ ID NO: 11644 - DNA, 50 bp, Artificial sequence
  Single strand DNA oligonucleotide
gtcgtatccagtgcagggtccgaggtattcgcactggatacgacgccata

SEQ ID NO: 11645 - DNA, 23 bp, Artificial sequence
  Single strand DNA oligonucleotide
cgcgcaagaaagctgtgggagaa

SEQ ID NO: 11646 - DNA, 50 bp, Artificial sequence
  Single strand DNA oligonucleotide
gtcgtatccagtgcagggtccgaggtattcgcactggatacgacacagcg

SEQ ID NO: 11647 - DNA, 22 bp, Artificial sequence
  Single strand DNA oligonucleotide
ggccggtacgcaggagagatga

SEQ ID NO: 11648 - DNA, 50 bp, Artificial sequence
  Single strand DNA oligonucleotide
gtcgtatccagtgcagggtccgaggtattcgcactggatacgacgttgtg

SEQ ID NO: 11649 - DNA, 19 bp, Artificial sequence
  Single strand DNA oligonucleotide
ttccagtggcgtagatccc

SEQ ID NO: 11650 - DNA, 50 bp, Artificial sequence
  Single strand DNA oligonucleotide
gtcgtatccagtgcagggtccgaggtattcgcactggatacgaccctagg

SEQ ID NO: 11651 - DNA, 18 bp, Artificial sequence
  Single strand DNA oligonucleotide
cggcacgggtcgctctca

SEQ ID NO: 11652 - DNA, 50 bp, Artificial sequence
  Single strand DNA oligonucleotide
gtcgtatccagtgcagggtccgaggtattcgcactggatacgactaggaa

SEQ ID NO: 11653 - DNA, 22 bp, Artificial sequence
  Single strand DNA oligonucleotide
cgtctcttcccaattccgccca

SEQ ID NO: 11654 - DNA, 51 bp, Artificial sequence
  Single strand DNA oligonucleotide
gtcgtatccagtgcagggtccgaggtattcgcactggatacgacagccaag

SEQ ID NO: 11655 - DNA, 18 bp, Artificial sequence
  Single strand DNA oligonucleotide
gttactcggcaagttggc

SEQ ID NO: 11656 - DNA, 50 bp, Artificial sequence
  Single strand DNA oligonucleotide
gtcgtatccagtgcagggtccgaggtattcgcactggatacgacctactc

SEQ ID NO: 11657 - DNA, 21 bp, Artificial sequence
  Single strand DNA oligonucleotide
cggcggtcaaagggaggtgtg

SEQ ID NO: 11658 - DNA, 50 bp, Artificial sequence
  Single strand DNA oligonucleotide
gtcgtatccagtgcagggtccgaggtattcgcactggatacgaccatcgg

SEQ ID NO: 11659 - DNA, 24 bp, Artificial sequence
  Single strand DNA oligonucleotide
cggcggtatggatggaggtgtaac

SEQ ID NO: 11660 - DNA, 50 bp, Artificial sequence
  Single strand DNA oligonucleotide
gtcgtatccagtgcagggtccgaggtattcgcactggatacgactctcct

SEQ ID NO: 11661 - DNA, 20 bp, Artificial sequence
  Single strand DNA oligonucleotide
ccggttggcctcgtcgaaga

SEQ ID NO: 11662 - DNA, 50 bp, Artificial sequence
  Single strand DNA oligonucleotide
gtcgtatccagtgcagggtccgaggtattcgcactggatacgacctccgt

SEQ ID NO: 11663 - DNA, 21 bp, Artificial sequence
  Single strand DNA oligonucleotide
cggcggtggctatattttggg

SEQ ID NO: 11664 - DNA, 50 bp, Artificial sequence
  Single strand DNA oligonucleotide
gtcgtatccagtgcagggtccgaggtattcgcactggatacgacagcacc

SEQ ID NO: 11665 - DNA, 19 bp, Artificial sequence
  Single strand DNA oligonucleotide
cgatgctggaggatgcgac

SEQ ID NO: 11666 - DNA, 50 bp, Artificial sequence
  Single strand DNA oligonucleotide
gtcgtatccagtgcagggtccgaggtattcgcactggatacgaccacctt

SEQ ID NO: 11667 - DNA, 19 bp, Artificial sequence
  Single strand DNA oligonucleotide
cggccctgtgacgttggtg

SEQ ID NO: 11668 - DNA, 50 bp, Artificial sequence
  Single strand DNA oligonucleotide
gtcgtatccagtgcagggtccgaggtattcgcactggatacgacgggacc

SEQ ID NO: 11669 - DNA, 19 bp, Artificial sequence
  Single strand DNA oligonucleotide
gcgcaaaccgtgcaaagga

SEQ ID NO: 11670 - DNA, 50 bp, Artificial sequence
  Single strand DNA oligonucleotide
gtcgtatccagtgcagggtccgaggtattcgcactggatacgacaggccc

SEQ ID NO: 11671 - DNA, 19 bp, Artificial sequence
  Single strand DNA oligonucleotide
ggccctggcgctagaagga

SEQ ID NO: 11672 - DNA, 50 bp, Artificial sequence
  Single strand DNA oligonucleotide
gtcgtatccagtgcagggtccgaggtattcgcactggatacgacccctca

SEQ ID NO: 11673 - DNA, 19 bp, Artificial sequence
  Single strand DNA oligonucleotide
cggcgagctgtccaggctg

SEQ ID NO: 11674 - DNA, 50 bp, Artificial sequence
  Single strand DNA oligonucleotide
gtcgtatccagtgcagggtccgaggtattcgcactggatacgactaccaa

SEQ ID NO: 11675 - DNA, 22 bp, Artificial sequence
  Single strand DNA oligonucleotide
cggcgggtagcttagcgaggtg

SEQ ID NO: 11676 - DNA, 50 bp, Artificial sequence
  Single strand DNA oligonucleotide
gtcgtatccagtgcagggtccgaggtattcgcactggatacgaccacctc

SEQ ID NO: 11677 - DNA, 20 bp, Artificial sequence
  Single strand DNA oligonucleotide
cggcggtttggaaagcaagt

SEQ ID NO: 11678 - DNA, 50 bp, Artificial sequence
  Single strand DNA oligonucleotide
gtcgtatccagtgcagggtccgaggtattcgcactggatacgactccaga

SEQ ID NO: 11679 - DNA, 19 bp, Artificial sequence
  Single strand DNA oligonucleotide
cgcgcttggggagctggac

SEQ ID NO: 11680 - DNA, 50 bp, Artificial sequence
  Single strand DNA oligonucleotide
gtcgtatccagtgcagggtccgaggtattcgcactggatacgactcctcc

SEQ ID NO: 11681 - DNA, 19 bp, Artificial sequence
  Single strand DNA oligonucleotide
cggcgttgggcttgctgct

SEQ ID NO: 11682 - DNA, 50 bp, Artificial sequence
  Single strand DNA oligonucleotide
gtcgtatccagtgcagggtccgaggtattcgcactggatacgactagctc

SEQ ID NO: 11683 - DNA, 19 bp, Artificial sequence
  Single strand DNA oligonucleotide
cggcggcagagcatggatg

SEQ ID NO: 11684 - DNA, 50 bp, Artificial sequence
  Single strand DNA oligonucleotide
gtcgtatccagtgcagggtccgaggtattcgcactggatacgaccttggg

SEQ ID NO: 11685 - DNA, 19 bp, Artificial sequence
  Single strand DNA oligonucleotide
cgtcggaggggctgcaaga

SEQ ID NO: 11686 - DNA, 50 bp, Artificial sequence
  Single strand DNA oligonucleotide
gtcgtatccagtgcagggtccgaggtattcgcactggatacgacacaaga

SEQ ID NO: 11687 - DNA, 22 bp, Artificial sequence
  Single strand DNA oligonucleotide
cggctggaaaaaggaggtgcat

SEQ ID NO: 11688 - DNA, 50 bp, Artificial sequence; identical to SEQ ID NO: 11622
  Single strand DNA oligonucleotide

SEQ ID NO: 11689 - DNA, 21 bp, Artificial sequence
  Single strand DNA oligonucleotide
cggcgggttcaataaagctgt

SEQ ID NO: 11690 - DNA, 50 bp, Artificial sequence
  Single strand DNA oligonucleotide
gtcgtatccagtgcagggtccgaggtattcgcactggatacgacaaggct

SEQ ID NO: 11691 - DNA, 19 bp, Artificial sequence
  Single strand DNA oligonucleotide
cggcggtgggagatgaagg

SEQ ID NO: 11692 - DNA, 50 bp, Artificial sequence
  Single strand DNA oligonucleotide
gtcgtatccagtgcagggtccgaggtattcgcactggatacgaccatgct

SEQ ID NO: 11693 - DNA, 20 bp, Artificial sequence
  Single strand DNA oligonucleotide
gaatcgcgtacaaggagcca

SEQ ID NO: 11694 - DNA, 50 bp, Artificial sequence
  Single strand DNA oligonucleotide
gtcgtatccagtgcagggtccgaggtattcgcactggatacgactagagc

SEQ ID NO: 11695 - DNA, 21 bp, Artificial sequence
  Single strand DNA oligonucleotide
cggcggtttggactgaaggga

SEQ ID NO: 11696 - DNA, 50 bp, Artificial sequence
  Single strand DNA oligonucleotide
gtcgtatccagtgcagggtccgaggtattcgcactggatacgacgtgctc

SEQ ID NO: 11697 - DNA, 21 bp, Artificial sequence
  Single strand DNA oligonucleotide
cggcggttgacagaagataga

SEQ ID NO: 11698 - DNA, 50 bp, Artificial sequence
  Single strand DNA oligonucleotide
gtcgtatccagtgcagggtccgaggtattcgcactggatacgacaagagc

SEQ ID NO: 11699 - DNA, 21 bp, Artificial sequence
  Single strand DNA oligonucleotide
cggcggtttggattgaaggga

SEQ ID NO: 11700 - DNA, 50 bp, Artificial sequence
  Single strand DNA oligonucleotide
gtcgtatccagtgcagggtccgaggtattcgcactggatacgacaggagc

SEQ ID NO: 11701 - DNA, 21 bp, Artificial sequence
  Single strand DNA oligonucleotide
cggcggtttggattgaaggga

SEQ ID NO: 11702 - DNA, 50 bp, Artificial sequence
  Single strand DNA oligonucleotide
gtcgtatccagtgcagggtccgaggtattcgcactggatacgacctctca

SEQ ID NO: 11703 - DNA, 18 bp, Artificial sequence
  Single strand DNA oligonucleotide
ggcccaccggtggaggag

SEQ ID NO: 11704 - DNA, 50 bp, Artificial sequence; identical to SEQ ID NO: 11636
  Single strand DNA oligonucleotide

SEQ ID NO: 11705 - DNA, 20 bp, Artificial sequence
  Single strand DNA oligonucleotide
cggcggggtggtggaaagat

SEQ ID NO: 11706 - DNA, 50 bp, Artificial sequence
  Single strand DNA oligonucleotide
gtcgtatccagtgcagggtccgaggtattcgcactggatacgacaccacc

SEQ ID NO: 11707 - DNA, 21 bp, Artificial sequence
  Single strand DNA oligonucleotide
cgtcatggtggtactcggcca

SEQ ID NO: 11708 - DNA, 50 bp, Artificial sequence
  Single strand DNA oligonucleotide
gtcgtatccagtgcagggtccgaggtattcgcactggatacgacgattca

SEQ ID NO: 11709 - DNA, 18 bp, Artificial sequence
  Single strand DNA oligonucleotide
cggccgccttgcatcaac

SEQ ID NO: 11710 - DNA, 50 bp, Artificial sequence
  Single strand DNA oligonucleotide
gtcgtatccagtgcagggtccgaggtattcgcactggatacgaccgtcct

SEQ ID NO: 11711 - DNA, 20 bp, Artificial sequence
  Single strand DNA oligonucleotide
cggcggatcgaaggagatgg

SEQ ID NO: 11712 - DNA, 50 bp, Artificial sequence
  Single strand DNA oligonucleotide
gtcgtatccagtgcagggtccgaggtattcgcactggatacgacataatc

SEQ ID NO: 11713 - DNA, 21 bp, Artificial sequence
  Single strand DNA oligonucleotide
aaggcctacttgggtggtgct

SEQ ID NO: 11714 - DNA, 50 bp, Artificial sequence
  Single strand DNA oligonucleotide
gtcgtatccagtgcagggtccgaggtattcgcactggatacgaccaacag

SEQ ID NO: 11715 - DNA, 22 bp, Artificial sequence
  Single strand DNA oligonucleotide
cggcggaagaaggaggaacaac

SEQ ID NO: 11716 - DNA, 50 bp, Artificial sequence
  Single strand DNA oligonucleotide
gtcgtatccagtgcagggtccgaggtattcgcactggatacgacccgatc

SEQ ID NO: 11717 - DNA, 22 bp, Artificial sequence
  Single strand DNA oligonucleotide
cggctggcggtggatacttctt

SEQ ID NO: 11718 - DNA, 50 bp, Artificial sequence; identical to SEQ ID NO: 11680
  Single strand DNA oligonucleotide

SEQ ID NO: 11719 - DNA, 21 bp, Artificial sequence
  Single strand DNA oligonucleotide
cgcgctgcagttcctggaggt

SEQ ID NO: 11720 - DNA, 50 bp, Artificial sequence
  Single strand DNA oligonucleotide
gtcgtatccagtgcagggtccgaggtattcgcactggatacgaccacact

SEQ ID NO: 11721 - DNA, 18 bp, Artificial sequence
  Single strand DNA oligonucleotide
cggcgtgggaggactcca

SEQ ID NO: 11722 - DNA, 50 bp, Artificial sequence
  Single strand DNA oligonucleotide
gtcgtatccagtgcagggtccgaggtattcgcactggatacgactcttgc

SEQ ID NO: 11723 - DNA, 20 bp, Artificial sequence
  Single strand DNA oligonucleotide
cggcggcttgtggagaggaa

SEQ ID NO: 11724 - DNA, 50 bp, Artificial sequence
  Single strand DNA oligonucleotide
gtcgtatccagtgcagggtccgaggtattcgcactggatacgacaaccat

SEQ ID NO: 11725 - DNA, 19 bp, Artificial sequence
  Single strand DNA oligonucleotide
cgcgcggtggtgaagaagc

SEQ ID NO: 11726 - DNA, 50 bp, Artificial sequence
  Single strand DNA oligonucleotide
gtcgtatccagtgcagggtccgaggtattcgcactggatacgacactacc

SEQ ID NO: 11727 - DNA, 21 bp, Artificial sequence
  Single strand DNA oligonucleotide
cgtaggtgaggcgtatcagga

SEQ ID NO: 11728 - DNA, 50 bp, Artificial sequence
  Single strand DNA oligonucleotide
gtcgtatccagtgcagggtccgaggtattcgcactggatacgacgctcct

SEQ ID NO: 11729 - DNA, 21 bp, Artificial sequence
  Single strand DNA oligonucleotide
cggcggtcatcggagaaacag

SEQ ID NO: 11730 - DNA, 51 bp, Artificial sequence
  Single strand DNA oligonucleotide
gtcgtatccagtgcagggtccgaggtattcgcactggatacgactacccat

SEQ ID NO: 11731 - DNA, 20 bp, Artificial sequence
  Single strand DNA oligonucleotide
aatcctggaagaggcagtgc

SEQ ID NO: 11732 - DNA, 50 bp, Artificial sequence
  Single strand DNA oligonucleotide
gtcgtatccagtgcagggtccgaggtattcgcactggatacgacgttcat

SEQ ID NO: 11733 - DNA, 20 bp, Artificial sequence
  Single strand DNA oligonucleotide
cggcattgagtgcagcgttg

SEQ ID NO: 11734 - DNA, 50 bp, Artificial sequence
  Single strand DNA oligonucleotide
gtcgtatccagtgcagggtccgaggtattcgcactggatacgactaaacc

SEQ ID NO: 11735 - DNA, 21 bp, Artificial sequence
  Single strand DNA oligonucleotide
cggcggtaatctgcatcctga

SEQ ID NO: 11736 - DNA, 50 bp, Artificial sequence
  Single strand DNA oligonucleotide
gtcgtatccagtgcagggtccgaggtattcgcactggatacgactatgca

SEQ ID NO: 11737 - DNA, 20 bp, Artificial sequence
  Single strand DNA oligonucleotide
gaatcgcgtatgaggagcca

SEQ ID NO: 11738 - DNA, 50 bp, Artificial sequence; identical to SEQ ID NO: 11696
  Single strand DNA oligonucleotide

SEQ ID NO: 11739 - DNA, 24 bp, Artificial sequence
  Single strand DNA oligonucleotide
cggcggttgtagagaaagagaaga

SEQ ID NO: 11740 - DNA, 50 bp, Artificial sequence
  Single strand DNA oligonucleotide
gtcgtatccagtgcagggtccgaggtattcgcactggatacgaccaccct

SEQ ID NO: 11741 - DNA, 22 bp, Artificial sequence
  Single strand DNA oligonucleotide
cggctggagtgggagtgggagt

SEQ ID NO: 11742 - DNA, 50 bp, Artificial sequence
  Single strand DNA oligonucleotide
gtcgtatccagtgcagggtccgaggtattcgcactggatacgacggagat

SEQ ID NO: 11743 - DNA, 21 bp, Artificial sequence
  Single strand DNA oligonucleotide
aatcctttgagccgcgtcaat

SEQ ID NO: 11744 - DNA, 50 bp, Artificial sequence
  Single strand DNA oligonucleotide
gtcgtatccagtgcagggtccgaggtattcgcactggatacgactattcc

SEQ ID NO: 11745 - DNA, 19 bp, Artificial sequence
  Single strand DNA oligonucleotide
cgtctggtgtgcagggggt

SEQ ID NO: 11746 - DNA, 50 bp, Artificial sequence
  Single strand DNA oligonucleotide
gtcgtatccagtgcagggtccgaggtattcgcactggatacgactcagac

SEQ ID NO: 11747 - DNA, 22 bp, Artificial sequence
  Single strand DNA oligonucleotide
cggcggtctcattccatacatc

SEQ ID NO: 11748 - DNA, 50 bp, Artificial sequence
  Single strand DNA oligonucleotide
gtcgtatccagtgcagggtccgaggtattcgcactggatacgacggagtt

SEQ ID NO: 11749 - DNA, 19 bp, Artificial sequence
  Single strand DNA oligonucleotide
gcgccgagtccgaggaagg

SEQ ID NO: 11750 - DNA, 50 bp, Artificial sequence
  Single strand DNA oligonucleotide
gtcgtatccagtgcagggtccgaggtattcgcactggatacgacctgtgc

SEQ ID NO: 11751 - DNA, 21 bp, Artificial sequence
  Single strand DNA oligonucleotide
gcggcggacagaagatagaga

SEQ ID NO: 11752 - DNA, 50 bp, Artificial sequence; identical to SEQ ID NO: 11696
  Single strand DNA oligonucleotide

SEQ ID NO: 11753 - DNA, 21 bp, Artificial sequence
  Single strand DNA oligonucleotide
cggcggtgacagaagactaga

SEQ ID NO: 11754 - DNA, 50 bp, Artificial sequence; identical to SEQ ID NO: 11694
  Single strand DNA oligonucleotide

SEQ ID NO: 11755 - DNA, 21 bp, Artificial sequence
  Single strand DNA oligonucleotide
cggcggtttggattgaaggga

SEQ ID NO: 11756 - DNA, 50 bp, Artificial sequence
  Single strand DNA oligonucleotide
gtcgtatccagtgcagggtccgaggtattcgcactggatacgacttcccc

SEQ ID NO: 11757 - DNA, 21 bp, Artificial sequence
  Single strand DNA oligonucleotide
cggcggtcaaagggagttgta

SEQ ID NO: 11758 - DNA, 50 bp, Artificial sequence
  Single strand DNA oligonucleotide
gtcgtatccagtgcagggtccgaggtattcgcactggatacgacactccg

SEQ ID NO: 11759 - DNA, 24 bp, Artificial sequence
  Single strand DNA oligonucleotide
cggcggaagtgatgacgtggtaga

SEQ ID NO: 11760 - DNA, 50 bp, Artificial sequence
  Single strand DNA oligonucleotide
gtcgtatccagtgcagggtccgaggtattcgcactggatacgacattcct

SEQ ID NO: 11761 - DNA, 20 bp, Artificial sequence
  Single strand DNA oligonucleotide
cggctatggggggattggga

SEQ ID NO: 11762 - DNA, 50 bp, Artificial sequence
  Single strand DNA oligonucleotide
gtcgtatccagtgcagggtccgaggtattcgcactggatacgacgtatgg

SEQ ID NO: 11763 - DNA, 21 bp, Artificial sequence
  Single strand DNA oligonucleotide
cggcggtcttccctacacctc

SEQ ID NO: 11764 - DNA, 50 bp, Artificial sequence
  Single strand DNA oligonucleotide
gtcgtatccagtgcagggtccgaggtattcgcactggatacgacatgctc

SEQ ID NO: 11765 - DNA, 21 bp, Artificial sequence
  Single strand DNA oligonucleotide
cggcggttgacagaagataga

SEQ ID NO: 11766 - DNA, 50 bp, Artificial sequence
  Single strand DNA oligonucleotide
gtcgtatccagtgcagggtccgaggtattcgcactggatacgactgttcc

SEQ ID NO: 11767 - DNA, 19 bp, Artificial sequence
  Single strand DNA oligonucleotide
cggcggaatgggctgtttg

SEQ ID NO: 11768 - DNA, 50 bp, Artificial sequence; identical to SEQ ID NO: 11700
  Single strand DNA oligonucleotide

SEQ ID NO: 11769 - DNA, 21 bp, Artificial sequence
  Single strand DNA oligonucleotide
cggcggattggattgaaggga

SEQ ID NO: 11770 - DNA, 50 bp, Artificial sequence; identical to SEQ ID NO: 11694
  Single strand DNA oligonucleotide

SEQ ID NO: 11771 - DNA, 22 bp, Artificial sequence
  Single strand DNA oligonucleotide
aaggcctcttggattgaaggga

SEQ ID NO: 11772 - DNA, 50 bp, Artificial sequence
  Single strand DNA oligonucleotide
gtcgtatccagtgcagggtccgaggtattcgcactggatacgacctggat

SEQ ID NO: 11773 - DNA, 21 bp, Artificial sequence
  Single strand DNA oligonucleotide
cggcggtcgataaacctctgc

SEQ ID NO: 11774 - DNA, 50 bp, Artificial sequence
  Single strand DNA oligonucleotide
gtcgtatccagtgcagggtccgaggtattcgcactggatacgactggtcc

SEQ ID NO: 11775 - DNA, 18 bp, Artificial sequence
  Single strand DNA oligonucleotide
cgtccaacgaggaggccg

SEQ ID NO: 11776 - DNA, 50 bp, Artificial sequence
  Single strand DNA oligonucleotide
gtcgtatccagtgcagggtccgaggtattcgcactggatacgacccccaa

SEQ ID NO: 11777 - DNA, 21 bp, Artificial sequence
  Single strand DNA oligonucleotide
cggcggtggaaagttgggaga

SEQ ID NO: 11778 - DNA, 50 bp, Artificial sequence
  Single strand DNA oligonucleotide
gtcgtatccagtgcagggtccgaggtattcgcactggatacgacgcccca

SEQ ID NO: 11779 - DNA, 19 bp, Artificial sequence
  Single strand DNA oligonucleotide
cggcgagaggaggacggag

SEQ ID NO: 11780 - DNA, 50 bp, Artificial sequence
  Single strand DNA oligonucleotide
gtcgtatccagtgcagggtccgaggtattcgcactggatacgactacctc

SEQ ID NO: 11781 - DNA, 23 bp, Artificial sequence
  Single strand DNA oligonucleotide
cgcgctgagaacaataggcatgg

SEQ ID NO: 11782 - DNA, 50 bp, Artificial sequence
  Single strand DNA oligonucleotide
gtcgtatccagtgcagggtccgaggtattcgcactggatacgacccacct

SEQ ID NO: 11783 - DNA, 23 bp, Artificial sequence
  Single strand DNA oligonucleotide
cgcgcgtgtttggtttagggatg

SEQ ID NO: 11784 - DNA, 50 bp, Artificial sequence
  Single strand DNA oligonucleotide
gtcgtatccagtgcagggtccgaggtattcgcactggatacgacacacca

SEQ ID NO: 11785 - DNA, 24 bp, Artificial sequence
  Single strand DNA oligonucleotide
cggcggaatgttattgtagcgtgg

SEQ ID NO: 11786 - DNA, 50 bp, Artificial sequence
  Single strand DNA oligonucleotide
gtcgtatccagtgcagggtccgaggtattcgcactggatacgacgaaacc

SEQ ID NO: 11787 - DNA, 22 bp, Artificial sequence
  Single strand DNA oligonucleotide
aaggccttttccttgggaaggt

SEQ ID NO: 11788 - DNA, 50 bp, Artificial sequence
  Single strand DNA oligonucleotide
gtcgtatccagtgcagggtccgaggtattcgcactggatacgaccacgct

SEQ ID NO: 11789 - DNA, 19 bp, Artificial sequence
  Single strand DNA oligonucleotide
ttagcggcgaggggatgcg

SEQ ID NO: 11790 - DNA, 50 bp, Artificial sequence
  Single strand DNA oligonucleotide
gtcgtatccagtgcagggtccgaggtattcgcactggatacgacagaagc

SEQ ID NO: 11791 - DNA, 20 bp, Artificial sequence
  Single strand DNA oligonucleotide
cggctggactgtttggggga

SEQ ID NO: 11792 - DNA, 50 bp, Artificial sequence; identical to SEQ ID NO: 11660
  Single strand DNA oligonucleotide

SEQ ID NO: 11793 - DNA, 19 bp, Artificial sequence
  Single strand DNA oligonucleotide
tagggtttgccggagttgg

SEQ ID NO: 11794 - DNA, 51 bp, Artificial sequence
  Single strand DNA oligonucleotide
gtcgtatccagtgcagggtccgaggtattcgcactggatacgacactccac

SEQ ID NO: 11795 - DNA, 19 bp, Artificial sequence
  Single strand DNA oligonucleotide
tagcgcgccgacgatgacg

SEQ ID NO: 11796 - DNA, 50 bp, Artificial sequence
  Single strand DNA oligonucleotide
gtcgtatccagtgcagggtccgaggtattcgcactggatacgactgtcac

SEQ ID NO: 11797 - DNA, 22 bp, Artificial sequence
  Single strand DNA oligonucleotide
cgcgcagggattttggaaggag

SEQ ID NO: 11798 - DNA, 50 bp, Artificial sequence
  Single strand DNA oligonucleotide
gtcgtatccagtgcagggtccgaggtattcgcactggatacgactttggc

SEQ ID NO: 11799 - DNA, 21 bp, Artificial sequence
  Single strand DNA oligonucleotide
cgtcggtggaggtggagctgt

SEQ ID NO: 11800 - DNA, 50 bp, Artificial sequence
  Single strand DNA oligonucleotide
gtcgtatccagtgcagggtccgaggtattcgcactggatacgacccttgg

SEQ ID NO: 11801 - DNA, 19 bp, Artificial sequence
  Single strand DNA oligonucleotide
cggcgagagcaggatgcag

SEQ ID NO: 11802 - DNA, 50 bp, Artificial sequence
  Single strand DNA oligonucleotide
gtcgtatccagtgcagggtccgaggtattcgcactggatacgacgccacc

SEQ ID NO: 11803 - DNA, 18 bp, Artificial sequence
  Single strand DNA oligonucleotide
cgcgccatcggtgttgga

SEQ ID NO: 11804 - DNA, 50 bp, Artificial sequence
  Single strand DNA oligonucleotide
gtcgtatccagtgcagggtccgaggtattcgcactggatacgacagaaca

SEQ ID NO: 11805 - DNA, 19 bp, Artificial sequence
  Single strand DNA oligonucleotide
cgtcacgcggaggaggtgg

SEQ ID NO: 11806 - DNA, 50 bp, Artificial sequence
  Single strand DNA oligonucleotide
gtcgtatccagtgcagggtccgaggtattcgcactggatacgaccccccg

SEQ ID NO: 11807 - DNA, 22 bp, Artificial sequence
  Single strand DNA oligonucleotide
cggcgggtcttataacctgaaa

SEQ ID NO: 11808 - DNA, 50 bp, Artificial sequence
  Single strand DNA oligonucleotide
gtcgtatccagtgcagggtccgaggtattcgcactggatacgacctatct

SEQ ID NO: 11809 - DNA, 19 bp, Artificial sequence
  Single strand DNA oligonucleotide
gcgcttccggtggtgagga

SEQ ID NO: 11810 - DNA, 50 bp, Artificial sequence
  Single strand DNA oligonucleotide
gtcgtatccagtgcagggtccgaggtattcgcactggatacgacaaggaa

SEQ ID NO: 11811 - DNA, 19 bp, Artificial sequence
  Single strand DNA oligonucleotide
cggctcggaccaggcatca

SEQ ID NO: 11812 - DNA, 50 bp, Artificial sequence
  Single strand DNA oligonucleotide
gtcgtatccagtgcagggtccgaggtattcgcactggatacgactggagc

SEQ ID NO: 11813 - DNA, 22 bp, Artificial sequence
  Single strand DNA oligonucleotide
aaggcctcttggattgaaggga

SEQ ID NO: 11814 - DNA, 50 bp, Artificial sequence
  Single strand DNA oligonucleotide
gtcgtatccagtgcagggtccgaggtattcgcactggatacgacgatgtg

SEQ ID NO: 11815 - DNA, 20 bp, Artificial sequence
  Single strand DNA oligonucleotide
cggcggcagaagatagagag

SEQ ID NO: 11816 - DNA, 50 bp, Artificial sequence; identical to SEQ ID NO: 11648
  Single strand DNA oligonucleotide

SEQ ID NO: 11817 - DNA, 20 bp, Artificial sequence
  Single strand DNA oligonucleotide
cggcggcagaagatagagag

SEQ ID NO: 11818 - DNA, 50 bp, Artificial sequence
  Single strand DNA oligonucleotide
gtcgtatccagtgcagggtccgaggtattcgcactggatacgacctggga

SEQ ID NO: 11819 - DNA, 19 bp, Artificial sequence
  Single strand DNA oligonucleotide
cgtcccggaccaggcttca

SEQ ID NO: 11820 - DNA, 50 bp, Artificial sequence; identical to SEQ ID NO: 11810
  Single strand DNA oligonucleotide

SEQ ID NO: 11821 - DNA, 19 bp, Artificial sequence
  Single strand DNA oligonucleotide
cgtctcggaccaggctcca

SEQ ID NO: 11822 - DNA, 50 bp, Artificial sequence
  Single strand DNA oligonucleotide
gtcgtatccagtgcagggtccgaggtattcgcactggatacgactggtga

SEQ ID NO: 11823 - DNA, 21 bp, Artificial sequence
  Single strand DNA oligonucleotide
cggcggcattgacagggaaac

SEQ ID NO: 11824 - DNA, 50 bp, Artificial sequence
  Single strand DNA oligonucleotide
gtcgtatccagtgcagggtccgaggtattcgcactggatacgacaccctc

SEQ ID NO: 11825 - DNA, 21 bp, Artificial sequence
  Single strand DNA oligonucleotide
cgtcttggcggtgattgaacg

SEQ ID NO: 11826 - DNA, 50 bp, Artificial sequence
  Single strand DNA oligonucleotide
gtcgtatccagtgcagggtccgaggtattcgcactggatacgacctccac

SEQ ID NO: 11827 - DNA, 18 bp, Artificial sequence
  Single strand DNA oligonucleotide
cggctggtgcacctggtg

SEQ ID NO: 11828 - DNA, 50 bp, Artificial sequence
  Single strand DNA oligonucleotide
gtcgtatccagtgcagggtccgaggtattcgcactggatacgacaagctc

SEQ ID NO: 11829 - DNA, 23 bp, Artificial sequence
  Single strand DNA oligonucleotide
aatccttcctttggggagatgga

SEQ ID NO: 11830 - DNA, 50 bp, Artificial sequence
  Single strand DNA oligonucleotide
gtcgtatccagtgcagggtccgaggtattcgcactggatacgacttagag

SEQ ID NO: 11831 - DNA, 21 bp, Artificial sequence
  Single strand DNA oligonucleotide
cggcggttggattgaagggag

SEQ ID NO: 11832 - DNA, 50 bp, Artificial sequence
  Single strand DNA oligonucleotide
gtcgtatccagtgcagggtccgaggtattcgcactggatacgaccactgg

SEQ ID NO: 11833 - DNA, 21 bp, Artificial sequence
  Single strand DNA oligonucleotide
cggcggcatctaggtggtggt

SEQ ID NO: 11834 - DNA, 50 bp, Artificial sequence
  Single strand DNA oligonucleotide
gtcgtatccagtgcagggtccgaggtattcgcactggatacgactagcca

SEQ ID NO: 11835 - DNA, 18 bp, Artificial sequence
  Single strand DNA oligonucleotide
cggctgggaacgtggctg

SEQ ID NO: 11836 - DNA, 50 bp, Artificial sequence
  Single strand DNA oligonucleotide
gtcgtatccagtgcagggtccgaggtattcgcactggatacgactcagtg

SEQ ID NO: 11837 - DNA, 20 bp, Artificial sequence
  Single strand DNA oligonucleotide
cggcggcagaagatagagag

SEQ ID NO: 11838 - DNA, 50 bp, Artificial sequence
  Single strand DNA oligonucleotide
gtcgtatccagtgcagggtccgaggtattcgcactggatacgacccgctc

SEQ ID NO: 11839 - DNA, 20 bp, Artificial sequence
  Single strand DNA oligonucleotide
cggcggctgcaaacctaagg

SEQ ID NO: 11840 - DNA, 50 bp, Artificial sequence
  Single strand DNA oligonucleotide
gtcgtatccagtgcagggtccgaggtattcgcactggatacgacgcacgt

SEQ ID NO: 11841 - DNA, 22 bp, Artificial sequence
  Single strand DNA oligonucleotide
cggcaagatggagaagcagggc

SEQ ID NO: 11842 - DNA, 50 bp, Artificial sequence
  Single strand DNA oligonucleotide
gtcgtatccagtgcagggtccgaggtattcgcactggatacgacccaccc

SEQ ID NO: 11843 - DNA, 21 bp, Artificial sequence
  Single strand DNA oligonucleotide
cgccgatcaacttagagttgg

SEQ ID NO: 11844 - DNA, 50 bp, Artificial sequence
  Single strand DNA oligonucleotide
gtcgtatccagtgcagggtccgaggtattcgcactggatacgacagcgcc

SEQ ID NO: 11845 - DNA, 21 bp, Artificial sequence
  Single strand DNA oligonucleotide
cggccttgtcgcaggagagat

SEQ ID NO: 11846 - DNA, 50 bp, Artificial sequence
  Single strand DNA oligonucleotide
gtcgtatccagtgcagggtccgaggtattcgcactggatacgacttgaca

SEQ ID NO: 11847 - DNA, 21 bp, Artificial sequence
  Single strand DNA oligonucleotide
cgcgccaaggctctgatacca

SEQ ID NO: 11848 - DNA, 50 bp, Artificial sequence
  Single strand DNA oligonucleotide
gtcgtatccagtgcagggtccgaggtattcgcactggatacgacaacatg

SEQ ID NO: 11849 - DNA, 20 bp, Artificial sequence
  Single strand DNA oligonucleotide
cggcggcaaggctctgatac

SEQ ID NO: 11850 - DNA, 50 bp, Artificial sequence; identical to SEQ ID NO: 11760
  Single strand DNA oligonucleotide

SEQ ID NO: 11851 - DNA, 21 bp, Artificial sequence
  Single strand DNA oligonucleotide
cggccttggtgaatggttggg

SEQ ID NO: 11852 - DNA, 50 bp, Artificial sequence
  Single strand DNA oligonucleotide
gtcgtatccagtgcagggtccgaggtattcgcactggatacgacccacac

SEQ ID NO: 11853 - DNA, 20 bp, Artificial sequence
  Single strand DNA oligonucleotide
cggccccaacttggaggtgg

SEQ ID NO: 11854 - DNA, 50 bp, Artificial sequence
  Single strand DNA oligonucleotide
gtcgtatccagtgcagggtccgaggtattcgcactggatacgacggcaac

SEQ ID NO: 11855 - DNA, 21 bp, Artificial sequence
  Single strand DNA oligonucleotide
cggcgggaaagtgtggagaag

SEQ ID NO: 11856 - DNA, 50 bp, Artificial sequence
  Single strand DNA oligonucleotide
gtcgtatccagtgcagggtccgaggtattcgcactggatacgacaacctc

SEQ ID NO: 11857 - DNA, 20 bp, Artificial sequence
  Single strand DNA oligonucleotide
cggcgggtaatctgcatcct

SEQ ID NO: 11858 - DNA, 50 bp, Artificial sequence
  Single strand DNA oligonucleotide
gtcgtatccagtgcagggtccgaggtattcgcactggatacgaccccggt

SEQ ID NO: 11859 - DNA, 21 bp, Artificial sequence
  Single strand DNA oligonucleotide
ttccgtcgacctggcgagtca

SEQ ID NO: 11860 - DNA, 50 bp, Artificial sequence
  Single strand DNA oligonucleotide
gtcgtatccagtgcagggtccgaggtattcgcactggatacgaccagagc

SEQ ID NO: 11861 - DNA, 21 bp, Artificial sequence
  Single strand DNA oligonucleotide
cggcggtttggattgaaggga

SEQ ID NO: 11862 - DNA, 50 bp, Artificial sequence; identical to SEQ ID NO: 11696
  Single strand DNA oligonucleotide

SEQ ID NO: 11863 - DNA, 21 bp, Artificial sequence
  Single strand DNA oligonucleotide
cggcggctgacagaagataga

SEQ ID NO: 11864 - DNA, 50 bp, Artificial sequence
  Single strand DNA oligonucleotide
gtcgtatccagtgcagggtccgaggtattcgcactggatacgactcgcca

SEQ ID NO: 11865 - DNA, 19 bp, Artificial sequence
  Single strand DNA oligonucleotide
aaccggttgggctgtatga

SEQ ID NO: 11866 - DNA, 50 bp, Artificial sequence
  Single strand DNA oligonucleotide
gtcgtatccagtgcagggtccgaggtattcgcactggatacgactagacc

SEQ ID NO: 11867 - DNA, 21 bp, Artificial sequence
  Single strand DNA oligonucleotide
cggcggtaatctgcatcctga

SEQ ID NO: 11868 - DNA, 50 bp, Artificial sequence
  Single strand DNA oligonucleotide
gtcgtatccagtgcagggtccgaggtattcgcactggatacgacggaggt

SEQ ID NO: 11869 - DNA, 20 bp, Artificial sequence
  Single strand DNA oligonucleotide
cggcggttggcattctgtcc

SEQ ID NO: 11870 - DNA, 50 bp, Artificial sequence
  Single strand DNA oligonucleotide
gtcgtatccagtgcagggtccgaggtattcgcactggatacgaccagatc

SEQ ID NO: 11871 - DNA, 20 bp, Artificial sequence
  Single strand DNA oligonucleotide
ccggggtgaagctgccacat

SEQ ID NO: 11872 - DNA, 50 bp, Artificial sequence
  Single strand DNA oligonucleotide
gtcgtatccagtgcagggtccgaggtattcgcactggatacgaccatgtg

SEQ ID NO: 11873 - DNA, 19 bp, Artificial sequence
  Single strand DNA oligonucleotide
cggcggggcgaactgagaa

SEQ ID NO: 11874 - DNA, 19 bp, Zea mays
tgggagatgaaggagcctt

SEQ ID NO: 11875 - DNA, 110 bp, Arabidopsis thaliana
ggacttctcatcttctttcttagccgccggtgctccagctccaccaccgtgtcctccaacattaccgtggcttccagttccaccggtggaggagtgagagtgggaagttt

SEQ ID NO: 11876 - DNA, 75 bp, Arabidopsis thaliana
gatttctcgtcctccggcaatccttcgaactcatcttcatcccagtaatcgaaggagatggaggacgaaggcttc

SEQ ID NO: 11877 - DNA, 151 bp, Arabidopsis thaliana
ctctagatctcaacaggtttcctcctccttctttctatttagctacttggtttcaattgtttcaagcctaggtaagcatatgtaaaaaagagacaattgaaaccaagtaactaaatagaaagaaggaggaacaacctgttgagatctagag

SEQ ID NO: 11878 - DNA, 107 bp, Arabidopsis thaliana
tttgtttgtttagctgaagaagcagaggagtcggcattggggcacagtcactcatcgatgctgcaatgggtaagtcctctgcatacttttgctgagataggaataga

SEQ ID NO: 11879 - DNA, 123 bp, Arabidopsis thaliana
ggtgccgctgcagttcctggaggtggaggaggtggtggtggggccactgcagctcttggaggtggaggcggtggaggtggagccgctatagttgttggaagtggaggaggtggcggtggtggt

SEQ ID NO: 11880 - DNA, 145 bp, Arabidopsis thaliana
ttgtaatttcttgtggagaggaagcaagaggatgtgcttggttgtggaaatatagggcccttaaaatatattcatcgtattcactcacataacaaaaattccacaagtaagcacatcatcttgcttcctccacaagaaattacaa

SEQ ID NO: 11881 - DNA, 55 bp, Arabidopsis thaliana
tgaggcgtatcaggaggtagtgttcttggtgggacaatttgtgttgtatgtttca

SEQ ID NO: 11882 - DNA, 131 bp, Arabidopsis thaliana
gatgttggaggtttgcgatgagaaagagattggccggaagaattatcagccatcaacatcgagattgtgagataatcggaagacctgtaattgtgaaggtaactctttctcatctgcaaatctcaactgtc

SEQ ID NO: 11883 - DNA, 98 bp, Arabidopsis thaliana
ttgtctctgttcatcggagaaacagaggagcaagacgtttcaaacggttcttggctcataatttgcttctctgttaccttggatgacaagaaagacaa

SEQ ID NO: 11884 - DNA, 99 bp, Arabidopsis thaliana
agggagccagggaagaggcagtgcatgggtagagacaaaacagagtcgtttaatgttttagtaaactcaatccatgctctgcttgttccctgtctctct

SEQ ID NO: 11885 - DNA, 145 bp, Arabidopsis thaliana
ttgtaatttcttgtggaggaagcaagatgatgtgcttacttgtggaatttttgttatgtgagtgaatacgatgaatatattttaagggccctatatttccacaaccaagcacatcctcttgcttcctctccacaagaaattacaa

SEQ ID NO: 11886 - DNA, 140 bp, Oryza sativa
ctgcgagcctccagcagcggcacaggaggaggccattgcagctgtcaaggacgttgagaaactcgcacttgggcaggaaggggagcgaggggtcaacaaacgggcggccttcccctgtgacgttggtgaaggtgtcggag

SEQ ID NO: 11887 - DNA, 147 bp, Oryza sativa
ccagccatccctctagagccggcgaactcctcccctcccccctcccccttccactcccaccccaccccaccccgggaccctaacccgtagggtcctcgccggcgccagagaagaagaggtttgccggagttggaggagatgacatgg

SEQ ID NO: 11888 - DNA, 105 bp, Oryza sativa
tataatataagggattttggaaggaggtgacatattctaggactatgtatctggatccagagatactaggatgtgttacctccctctaaaatcccttatattatg

SEQ ID NO: 11889 - DNA, 109 bp, Oryza sativa
ggtggaggtggaggtggagctgtgccaaataggccctgagttgtatgcaccaccagttcaacccaatagcttaagggtctgcttggcacagctccagctccacgcagcc

SEQ ID NO: 11890 - DNA, 125 bp, Oryza sativa
catcggtgttggaggtggcggggacgaggtgcttctctagagcggtgccactactgccaccaccgtggaattgacgaggcacaatgcccacctcaccctccgctgccactctgctgccaccgatg

SEQ ID NO: 11891 - DNA, 128 bp, Oryza sativa
ttacttaaaccgtgcaaaggaggtcccatggcagtatttgcacccgtttttactaacgtggcatcctgttgtacggttttttttgacgcaaatactgccatgggacctcttttgcatggtttgagtaa

SEQ ID NO: 11892 - DNA, 71 bp, Oryza sativa
gcacgcggaggaggtggtgttctcgccggagtacgaggagttcgccgtcaggaacgccgccctctgcgtcc

SEQ ID NO: 11893 - DNA, 133 bp, Populus trichocarpa
ctagttccggagcccggtgaactttatcaccacttcctgctcctcttggcaagcttccaggtggaggaggtggacgaggtggtccaccaggtggaggaggtggtggtggtggtgcacctggtggtggaggtgg

SEQ ID NO: 11894 - DNA, 104 bp, Populus trichocarpa
atggttggagaagcttccgatctccctcaaaggcttcctctataattgccttacatgatggcattagtggactcctttggggagatggagagcttactccccat

SEQ ID NO: 11895 - DNA, 174 bp, Populus trichocarpa
gggagtggagctccttgaagtccaatagaggttcttgctgggtagattaagctgctaagctatggatccacagtcctatctatcaaccgaaggataggtttgcggcttgcatatctcaggagctttattgcctaatgttagatccctttttggattgaagggagctctaaaccc

SEQ ID NO: 11896 - DNA, 105 bp, Populus trichocarpa
tatacatatatctcacttgctttctcaactatctcacttttcttttcagatttcaaaaaaacgacatcatgagacagtttggaaagcaagtgaggtgtgtgtata

SEQ ID NO: 11897 - DNA, 90 bp, Populus trichocarpa
tgacggattcggagaacagctgtcggtgttgatggtggctgtgggcagaggacatttcagaatttggggagctggactctggagcagtgg

SEQ ID NO: 11898 - DNA, 104 bp, Populus trichocarpa
tctgcttcgggtggcaggtctggcggttgtagagggggcagcgacgttgatgatcttcgctcctgttggttgccgtggcggttgggcttgctgctggaggaaga

SEQ ID NO: 11899 - DNA, 87 bp, Populus trichocarpa
gttgacagaagatagagagcactgacgatgaaatgcatggagcttaattgcatctcactcctttgtgctctctagtcttctgtcatc

SEQ ID NO: 11900 - DNA, 129 bp, Populus trichocarpa
tgggacagcttggtgaatggttgggaggaatgtctttaatgtggttatgcatcagtgaaactctagtaagattctctgtccactcctctgcatccggcacttctcttaaccgtgcacctgctttaacca

SEQ ID NO: 11901 - DNA, 95 bp, Populus trichocarpa
gcgtccagacccaacttggaggtgggtgtggacgcgtccaaccccaagttgggcgtggatgcgtccaggcctaatttcgagttgggcgtagacgc

SEQ ID NO: 11902 - DNA, 79 bp, Populus trichocarpa
acttttctacgaaagtgtggagaaggttgcccctaaaaaatcttttatggcgactttctcgacattttggtagaaaagt

SEQ ID NO: 11903 - DNA, 79 bp, Populus trichocarpa
cggggaacaggcagagcatggatggagctactaacagaagtacttgttttggctctacccatgcactgcctcttccctg

SEQ ID NO: 11904 - DNA, 122 bp, Zea mays; identical to SEQ ID NO: 200

SEQ ID NO: 11905 - DNA, 101 bp, Glycine soja
agccaaggatgacttgccggcattagccaagtgaatgagcatcatatatatatatatatatatatatgactcatgttcttgtcggcaagttggccttggct

SEQ ID NO: 11906 - DNA, 110 bp, Oryza sativa
tactacctccatttcaggttataagactttctagtgttgctcacattcatatatatgttaataaattcattaacatatagaaagtcttataacctgaaacgggggaagta

SEQ ID NO: 11907 - DNA, 171 bp, Populus trichocarpa
gtgtgtgagcaagatggagaagcagggcacgtgcactactaactcatgcacacagagagggagacgcatttcttgctggagttacgagttacgactcttacctactattgattttgttagctccagtgagttagttattcatgtgcctgtcttcctcatcatgatcactac

SEQ ID NO: 11908 - DNA, 119 bp, Populus trichocarpa
cttggtcatcaaggctctgataccatgtcaaagaatcatattttgagaccttatctaacagcttaagctattgggttgagatggttccttgacatgatatcagagccttgatgacgaag

SEQ ID NO: 11909 - DNA, 167 bp, Populus trichocarpa
gcttggtcatcaaggctctgataccatgttaaagaaccatctcaacctaataccatgttagagaataatataaatcatatctagagactttacctaacagcttaagctattggcctattggattagtatggttctttgacatggtatcagagccttgataaccaagt

SEQ ID NO: 11910 - DNA, 105 bp, Populus trichocarpa; identical to SEQ ID NO: 11896

SEQ ID NO: 11911 - DNA, 140 bp, Oryza sativa; identical to SEQ ID NO: 11886

SEQ ID NO: 11912 - DNA, 128 bp, Oryza sativa; identical to SEQ ID NO: 11891

SEQ ID NO: 11913 - DNA, 104 bp, Populus trichocarpa; identical to SEQ ID NO: 11898

SEQ ID NO: 11914 - DNA, 98 bp, Oryza sativa
gccggctagtacaatcgaatccactagcaccgaggcttgggtcactagatcccgtggccctagcctaattgctggaggatgcgacggtgcttgtgagc

SEQ ID NO: 11915 - DNA, 109 bp, Oryza sativa; identical to SEQ ID NO: 11889

SEQ ID NO: 11916 - DNA, 125 bp, Oryza sativa; identical to SEQ ID NO: 11890

SEQ ID NO: 11917 - DNA, 95 bp, Populus trichocarpa; identical to SEQ ID NO: 11901

SEQ ID NO: 11918 - DNA, 79 bp, Populus trichocarpa; identical to SEQ ID NO: 11902

SEQ ID NO: 11919 - DNA, 145 bp, Arabidopsis thaliana; identical to SEQ ID NO: 11885

SEQ ID NO: 11920 - DNA, 83 bp, Arabidopsis thaliana
aaacatgtgggaggactccaagtgtggttatatcctcggtattatctcgatgtgaaccacacttggagtcctcccacatgttt

SEQ ID NO: 11921 - DNA, 123 bp, Arabidopsis thaliana; identical to SEQ ID NO: 11879

SEQ ID NO: 11922 - DNA, 133 bp, Populus trichocarpa; identical to SEQ ID NO: 11893

SEQ ID NO: 11923 - DNA, 147 bp, Oryza sativa; identical to SEQ ID NO: 11887

SEQ ID NO: 11924 - DNA, 129 bp, Arabidopsis thaliana
tcctcgacttcctggtagagtggtgtgatcgagtgatggtcaggtgtggaggtgatgatactcgaccaggtggtcaagtgaagtgatcaagtgactctcatggtggtactcggccaggtggtcgagtgg

SEQ ID NO: 11925 - DNA, 55 bp, Arabidopsis thaliana; identical to SEQ ID NO: 11881

SEQ ID NO: 11926 - DNA, 85 bp, Oryza sativa
cgccgtctccctcgccgtcgccggcgtcgccggagatgacgagaagacgtgccccggcgcgccgacgatgacggtggagtcggcg

SEQ ID NO: 11927 - DNA, 105 bp, Oryza sativa; identical to SEQ ID NO: 11888

SEQ ID NO: 11928 - DNA, 75 bp, Arabidopsis thaliana; identical to SEQ ID NO: 11876

SEQ ID NO: 11929 - DNA, 110 bp, Arabidopsis thaliana; identical to SEQ ID NO: 11875

SEQ ID NO: 11930 - DNA, 89 bp, Arabidopsis thaliana
tggtaagtgataatcattaccacccaagctaacattcaaaccaaaaaccagtttaagttaacttgggtggtgctgattatcacttgtcg

SEQ ID NO: 11931 - DNA, 155 bp, Arabidopsis thaliana
ggcggtggtgaagaagcatggtttggaaatctcacagcctggattagagccatatgaagggctcacatgggagatgaccaagaaaagagacgacactgaagtccacaagttagaattatatagtgaagtttctacattattttctcaccaccgct

SEQ ID NO: 11932 - DNA, 76 bp, Populus trichocarpa
tcttaccattggaccacctactagatgattaaaaactacatcatctaaccatctaggtggtggtccagtggtaaga

SEQ ID NO: 11933 - DNA, 71 bp, Oryza sativa; identical to SEQ ID NO: 11892

SEQ ID NO: 11934 - DNA, 104 bp, Populus trichocarpa; identical to SEQ ID NO: 11894

SEQ ID NO: 11935 - DNA, 129 bp, Populus trichocarpa; identical to SEQ ID NO: 11900

SEQ ID NO: 11936 - DNA, 131 bp, Arabidopsis thaliana; identical to SEQ ID NO: 11882

SEQ ID NO: 11937 - DNA, 125 bp, Arabidopsis thaliana
gtggatactgttctggtggaggatacttcaccggcggatgagggtaagtcttgatcggtggtggatacttcaccggtggatgctcgtatggtggcggtggatacttcttgatcggtggtggatac

SEQ ID NO: 11938 - DNA, 134 bp, Populus trichocarpa
gagaaacgctctaattaatcatcgttatgccacgtgtctatttacggataacgcaacgctactaaatcgcgaattttagtttgagtggaagatcttggccgttggattggcggtgattgaacggagggttgatc

SEQ ID NO: 11939 - DNA, 97 bp, Populus trichocarpa
gcccttaaccaacttagagttgggggtgggcacgtcatgggtcaacctagggttggtctcggactcgcccttgctcaacttagagttgggtacgggc

SEQ ID NO: 11940 - DNA, 98 bp, Arabidopsis thaliana
ggtgaagacactcgacctcgtggtcgagtgatgtgatcgagtggtggtcagaagatggagatgaagtcactcgaccaagggggtcgagtgatgtgatc

SEQ ID NO: 11941 - DNA, 129 bp, Arabidopsis thaliana
tcgggctcggattcgcttggtgcaggtcgggaaccaattcggctgacacagcctcgtgacttttaaacctttattggtttgtgagcagggattggatcccgccttgcatcaactgaatcggatcctcga

SEQ ID NO: 11942 - DNA, 98 bp, Arabidopsis thaliana
tgatggtgatactcgacatccaggtagagtgatgaggtcgagtagaggtctggcaatgggatgaagtcactcagcctgggggtcgagtgatgtgatcg

SEQ ID NO: 11943 - DNA, 74 bp, Oryza sativa
gctggactgtttgggggagcttctgattttgggagaaacggctatagctagaagctccccgaaacaggcccaac

SEQ ID NO: 11944 - DNA, 147 bp, Oryza sativa
gaagaggcagagagcaggatgcagccaaggatgacttgccggccggcgatggccgacggcgaggttaattaattggccggagactggcagtccttctctgttgatccggcaagtttgtccttggctacaccttgctctcttctcgtc

SEQ ID NO: 11945 - DNA, 110 bp, Oryza sativa; identical to SEQ ID NO: 11906

SEQ ID NO: 11946 - DNA, 147 bp, Populus trichocarpa
ttgctgtggtgagtttccctgtcagtgctcactacgatatttaatgaagaagaaaaataaagcaagagataaaaaaggcatttcctcgattcagatttcagggtgcagcattgcattgagcattgacagggaaactcaccacggcaa

SEQ ID NO: 11947 - DNA, 93 bp, Populus trichocarpa
gccctgtttgggaacgtggctgtggctacactgatgcttctggtttggaaatggaggtgcaactgaagttatgggaacgttcccaaacagggc

SEQ ID NO: 11948 - DNA, 73 bp, Populus trichocarpa
ctgcaaacctaagggagcggttttgcagaccccaagcgcacaagtctgcagacccgctcgcttgggtctgcag

SEQ ID NO: 11949 - DNA, 171 bp, Populus trichocarpa; identical to SEQ ID NO: 11907

SEQ ID NO: 11950 - DNA, 149 bp, Populus trichocarpa
ttgggggtttcttgtcgcaggagagatggcgctagctaaccatggtcatatcatatatatcatatggcaagtattacttgctctttgtatgtatcagctgtaaagatagctcagctaaagccatcctcctgcgactggacaccctgcaa

SEQ ID NO: 11951 - DNA, 119 bp, Populus trichocarpa; identical to SEQ ID NO: 11908

SEQ ID NO: 11952 - DNA, 80 bp, Populus trichocarpa
aggattgggtaatctgcatcctgaggtttggatcaccacatgttttgatctagtccttgggttgcagattacctcttcct

SEQ ID NO: 11953 - DNA, 95 bp, Populus trichocarpa
cttgggccaggaggggctgcaagacccaagtgacttgggtctgcgctcttgccacacccaagcaacttgggtcagacgcccttccaagccccaag

SEQ ID NO: 11954 - DNA, 124 bp, Populus trichocarpa
tgagtcgacctggcgagtcaaccgggtttgattgtttttttatccttgctagtctttcaccttactaggaccggtccagccaccgggttaatcgagtcccgggttgacttgctgggccgtctgg

SEQ ID NO: 11955 - DNA, 140 bp, Zea mays
gggggcgaactgagaacacatgagaataatgagatgagattgctcgcctcgcggtacggttcgtgctggcctggaccaccgtcgtcgccgttcatcttgtacgcataataatgctgcatgtgttctcaggtcgcccccgc

SEQ ID NO: 11956 - DNA, 107 bp, Arabidopsis thaliana; identical to SEQ ID NO: 11878

SEQ ID NO: 11957 - DNA, 131 bp, Arabidopsis thaliana; identical to SEQ ID NO: 11882

SEQ ID NO: 11958 - DNA, 102 bp, Oryza sativa
tctcgttcttggagaggcccttgccgaccttggcgatgcgcttgccggccctggaccagcgggacgccgcggtctcctgcttggcctcgtcgaagaaggaga

SEQ ID NO: 11959 - DNA, 98 bp, Arabidopsis thaliana; identical to SEQ ID NO: 11942

SEQ ID NO: 11960 - DNA, 82 bp, Oryza sativa
gtatactacctccgtcccaaaatatagccacttttagattcataaacaaaagtggctatattttgggacggagggagtatat

SEQ ID NO: 11961 - DNA, 95 bp, Poptlus trichocarpa; identical to SEQ ID NO: 11953
